US008278038B2

(12) United States Patent
Bryant et al.

(10) Patent No.: US 8,278,038 B2

(45) Date of Patent: Oct. 2, 2012

(54) METHODS FOR THE IDENTIFICATION, ASSESSMENT, AND TREATMENT OF PATIENTS WITH CANCER THERAPY

(75) Inventors: Barbara M. Bryant, Cambridge, MA (US); Andrew I. Damokosh, West Hartford, CT (US); George Mulligan, Lexington, MA (US)

(73) Assignee: Millennium Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 11/449,195

(22) Filed: Jun. 8, 2006

(65) Prior Publication Data

US 2006/0281122 A1 Dec. 14, 2006

Related U.S. Application Data

(60) Provisional application No. 60/688,634, filed on Jun. 8, 2005.

(51) Int. Cl.
*C12Q 1/68* (2006.01)

(52) U.S. Cl. ........................................................ 435/6.1

(58) Field of Classification Search ........................ None
See application file for complete search history.

(56) References Cited

U.S. PATENT DOCUMENTS

2004/0156854 A1 8/2004 Mulligan et al.

FOREIGN PATENT DOCUMENTS

WO WO 2004/053066 A2 6/2004

OTHER PUBLICATIONS

Tockman et al (Cancer Res., 1992, 52:2711s-2718s).*
Ferrandina et al (BMC Cancer, Jul. 2006, 6(182): 1-5).*
Chauhan et al (Oncogene, 2002, 21: 1346-1358).*
Hideshima et al (Cancer Research, 2001, 61: 3071-3076).*
Alberts et al. (Molecular Biology of the Cell, 3rd edition, 1994, p. 465).*
Greenbaum et al. (Genome Biology, 2003, vol. 4, Issue 9, pp. 117.1-117.8).*
Lichtinghagen et al (European Urology, 2002, 42:398-406).*
Adams, Julian, et al., "Proteasome Inhibitors: A Novel Class of Potent and Effective Antitumor Agents," *Cancer Research*, vol. 59 (Jun. 1, 1999) pp. 2615-2622.
Adams, Julian, "Development of the Proteasome Inhibitor PA-341," *The Oncologist*, vol. 7 (2002) pp. 9-16.
Lightcap, Eric S., et al., "Proteasome Inhibition Measurements: Clinical Application," *Clinical Chemsitry*, vol. 46, No. 5 (2000) pp. 673-683.
Hochwald, Steven N., et al., "Antineoplastic Therapy in Colorectal Cancer through Proteasome Inhibition," *The American Surgeon*, vol. 69 (Jan. 2003) pp. 15-23.
Richardson, Paul G., et al., "A Phase 2 Study of Bortezomib in Relapsed, Refractory Myeloma," *The New England Journal of Medicine*, vol. 348, No. 26 (Jun. 26, 2003) pp. 2609-2617.
van de Vijver, Marc J., et al., "A Gene-Expression Signature as a Predictor of Survival in Breast Cancer," *The New England Journal of Medicine*, vol. 347, No. 25 (Dec. 19, 2002) pp. 1999-2009.
Barden, Catherine B., et al., "Classification of Follicular Thyroid Tumors by Molecular Signature: Results of Gene Profiling," *Clinical Cancer Research*, vol. 9 (May 2003) pp. 1792-1800.
Mulligan, George, et al., "Gene expression profiling and correlation with outcome in clinical trials of the proteasome inhibitor bortezomib," *Blood*, vol. 109, No. 8 (Apr. 15, 2007) pp. 3177-3188.
Toczyski, David P., et al., "The Epstein-Barr virus (EBV) small RNA EBER1 binds and relocalizes ribosomal protein L22 in EBV-infected human B lymphocytes," *Proceedings of the National Academy of Science USA*, vol. 91 (Apr. 1994) pp. 3463-3467.
Maglott, Donna, et al., "Entrez Gene: gene-centered information at NCBI," *Nucleic Acids Research*, vol. 33, Database issue (2005) pp. D54-D58.
Affymetrix, Inc., "Annotation Methodology," Affymetrix—Annotation Methodology Technical Note [online] Affymetrix, Santa Clara, CA, downloaded Jul. 23, 2008 (3 pages).
Affymetrix, Inc., "GeneChip Human Genome U133 Set," [online] 701092 Rev. 3 (Nov. 2004) downloaded Jul. 23, 2008 ( 2 pages).
Affymetrix, Inc., "Human Genome U133 Set—Support Materials," Affymetrix—Technical Support Documentation for Human Genome U133 Set [online] downloaded Jul. 24, 2008 (3 pages).
International Prelminary Examination Report (IPER) and Written Opinion of the International Searching Authority dated Dec. 11, 2007 in corresponding PCT Application PCT/US06/022515.
Office Action dated Jun. 23, 2008 in co-pending U.S. Appl. No. 10/728,055.
Supplementary Partial European Search Report dated Jun. 24, 2009 in European Patent Application No. 06784710.3 which corresponds to U.S. Appl. No. 11/449,195.
Glatt, Christine M., et al., "Molecular characterization of thyroid toxicity: anchoring gene expression profiles to biochemical and pathologic end points," *Environmental Health Perspectives*, vol. 113, No. 10 (Oct. 2005) pp. 1354-1361.
Wessels, Lodewyk F. A., et al., "A protocol for building and evaluating predictors of disease state based on microarray data," *Bioinformatics*, vol. 21, No. 19 (Apr. 7, 2005) pp. 3755-3762.

* cited by examiner

*Primary Examiner* — Sean Aeder

(74) *Attorney, Agent, or Firm* — Millennium Pharmaceuticals, Inc.

(57) ABSTRACT

The present invention is directed to the identification of predictive markers that can be used to determine whether patients with cancer are clinically responsive or non-responsive to a therapeutic regimen prior to treatment. In particular, the present invention is directed to the use of certain individual and/or combinations of predictive markers, wherein the expression of the predictive markers correlates with responsiveness or non-responsiveness to a therapeutic regimen. Thus, by examining the expression levels of individual predictive markers and/or predictive markers comprising a marker set, it is possible to determine whether a therapeutic agent, or combination of agents, will be most likely to reduce the growth rate of tumors in a clinical setting.

14 Claims, No Drawings

METHODS FOR THE IDENTIFICATION, ASSESSMENT, AND TREATMENT OF PATIENTS WITH CANCER THERAPY

CROSS REFERENCE TO RELATED APPLICATIONS

This application claims the benefit of U.S. Provisional Application No. 60/688,634, filed Jun. 8, 2005, the contents of which are incorporated herein by this reference in its entirety.

The contents of the Sequence Listing are submitted herewith on compact disc in duplicate. Each duplicate compact disc has a copy of the Sequence Listing file, created on Sep. 26, 2008 and named "sequence listing.txt," the contents of which are incorporated herein by this reference. This file is 5.91 MB (6,203,392 bytes) and was copied onto compact disc on Sep. 30, 2008.

BACKGROUND OF THE INVENTION

One of the continued problems with therapy in cancer patients is individual differences in response to therapies. With the narrow therapeutic index and the toxic potential of many available cancer therapies, such differential responses potentially contribute to patients undergoing unnecessary ineffective and even potentially harmful therapy regimens. If a designed therapy could be optimized to treat individual patients, such situations could be reduced or even eliminated. Furthermore, targeted designed therapy may provide more focused, successful patient therapy overall. Accordingly, there is a need to identify particular cancer patients which are particularly responsive to particular cancer therapies, either alone or in combination with other chemotherapies. It would therefore be beneficial to provide for the diagnosis, staging, prognosis, and monitoring of cancer patients, including, e.g., hematological cancer patients (e.g., multiple myeloma, leukemias, lymphoma, etc) as well as solid tumor cancer patients (e.g., lung, breast, prostate, ovary, colon, kidney, liver), who would benefit from particular cancer inhibition therapies; or to indicate a predisposition of such patients to non-responsiveness to therapy, thus resulting in appropriate preventative measures.

Proteasome inhibition represents an important strategy in cancer treatment. The proteasome is a multi-enzyme complex present in all cells which play a role in degradation of proteins involved in regulation of the cell cycle. For example, King et al., demonstrated that the ubiquitin-proteasome pathway plays an essential role in regulating cell cycle, neoplastic growth and metastasis. A number of key regulatory proteins, including p53, cyclins, and the cyclin-dependent kinases p21 and $p27^{KIP1}$, are temporally degraded during the cell cycle by the ubiquitin-proteasome pathway. The ordered degradation of these proteins is required for the cell to progress through the cell cycle and to undergo mitosis. See, e.g., *Science* 274: 1652-1659 (1996). Furthermore, the ubiquitin-proteasome pathway is required for transcriptional regulation. Palombella et al., teach that the activation of the transcription factor NF-kB is regulated by proteasome-mediated degradation of the inhibitor protein IkB. See International Patent Application Publication No. WO 95/25533. In turn, NF-kB plays a central role in the regulation of genes involved in the immune and inflammatory responses. For example, Read et al. demonstrated that the ubiquitin-proteasome pathway is required for expression of cell adhesion molecules, such as E-selectin, ICAM-1, and VCAM-1. See *Immunity* 2:493-506 (1995). Additional findings further support the role for proteasome inhibition in cancer therapy, as Zetter found that cell adhesion molecules are involved in tumor metastasis and angiogenesis in vivo, by directing the adhesion and extravastation of tumor cells to and from the vasculature to distant tissue sites within the body. See, e.g., *Seminars in Cancer Biology* 4:219-229 (1993). Moreover, Beg and Baltimore, found that NF-kB is an anti-apoptotic factor, and inhibition of NF-kB activation makes cells more sensitive to environmental stress and cytotoxic agents. See *Science* 274:782 (1996).

The first proteasome inhibitor described as having antitumor activity, bortezomib (N-pyrazinecarbonyl-L-phenylalanine-L-leucineboronic acid, PS-341) (VELCADE® for injection, Millennium Pharmaceuticals, Inc., Cambridge, Mass.; Johnson & Johnson Pharmaceutical Research and Development L.L.C.) has been approved for treatment of relapsed multiple myeloma. Presently clinical trials are underway in additional indications, including additional hematological cancers as well as solid tumors. This and other peptide boronic ester and acid proteasome inhibitors have been described by Adams et al. See, e.g., U.S. Pat. No. 5,780,454 (1998), U.S. Pat. No. 6,066,730 (2000), and U.S. Pat. No. 6,083,903 (2000). They describe the use of the disclosed boronic ester and boronic acid compounds to reduce the rate of muscle protein degradation, to reduce the activity of NF-kB in a cell, to reduce the rate of degradation of p53 protein in a cell, to inhibit cyclin degradation in a cell, to inhibit the growth of a cancer cell, and to inhibit NF-kB dependent cell adhesion.

Bortezomib specifically and selectively inhibits the proteasome by binding tightly (Ki=0.6 nM) to one of the enzyme's active sites. Bortezomib is selectively cytotoxic, and has a novel pattern of cytotoxicity in National Cancer Institute (NCI) in vitro and in vivo assays. Adams J, et al. *Cancer Res* 59:2615-22. (1999). In addition, bortezomib has cytotoxic activity in a variety of xenograft tumor models. Teicher B A, et al. *Clin Cancer Res.* 5:2638-45 (1999). Bortezomib inhibits nuclear factor-κB (NF-κB) activation, attenuates interleukin-6 (IL-6) mediated cell growth, and has a direct apoptotic effect, and possibly an anti-angiogenic effect. Additionally, bortezomib is directly cytotoxic to myeloma cells in culture, independent of their p53 status. See, e.g., Hideshima T, et al. *Cancer Res.* 61:3071-6 (2001). In addition to a direct cytotoxic effect of bortezomib on myeloma cells, bortezomib inhibits tumor necrosis factor alpha (TNFα stimulated intercellular adhesion molecule-1 (ICAM-1) expression by myeloma cells and ICAM-1 and vascular cell adhesion molecule-1 (VCAM-1) expression on bone marrow stromal cells (BMSCs), resulting in decreased adherence of myeloma cells and, consequently, in decreased cytokine secretion. Hideshima T, et al. *Oncogene.* 20:4519-27 (2001). By inhibiting interactions of myeloma cells with the surrounding bone marrow, bortezomib can inhibit tumor growth and survival, as well as angiogenesis and tumor cell migration. The antineoplastic effect of bortezomib may involve several distinct mechanisms, including inhibition of cell growth signaling pathways, dysregulation of the cell cycle, induction of apoptosis, and inhibition of cellular adhesion molecule expression. Notably, bortezomib induces apoptosis in cells that over express B-cell lymphoma 2 (Bcl-2), a genetic trait that confers unregulated growth and resistance to conventional chemotherapeutics. McConkey D J, et al. *The proteasome as a new drug target in metastatic prostate cancer.* 7th Annual Genitourinary Oncology Conference, Houston, Tex. Abstract (1999).

Glucocorticoidal steroids are capable of causing apoptotic death of many varieties of cells, and a selection of glucocorticoidal steroids have consequently be used in the treatment of various malignancies, including lymphoid malignancies, and combination therapies in solid tumors. For example, the optimal therapy for relapsed myeloma is not established, but high-dose dexamethasone is commonly used. See, e.g., Kumar A, et al. *Lancet Oncol;* 4:293-304 (2003); Alexanian R, et al. *Ann Intern Med.* 105:8-11 (1986); Friedenberg W R, et al. *Am J Hematol.* 36:171-75. (1991). Response rates with this treatment are similar to those with vincristine, doxorubicin, and dexamethasone (VAD), and the dexamethasone component is estimated to account for 85 percent of the effect of VAD. See, e.g., Alexanian R, et al. *Blood.* 80:887-90 (1992); Sonneveld P, et al. *Br J Haematol.* 115:895-902. (2001). High-dose chemotherapy followed by autologous stem cell transplantation improves patient survival, but in most cases the disease relapses. Attal Metal. *N Engl J Med.* 335:91-97 (1996); Child J A, et al. *N Engl J Med.* 348:1875-83 (2003).

In addition to use of dexamethasone, additional corticosteroids have demonstrated use in cancer treatments, including hydrocortisone in combination therapy for prostate cancer, predisolone in leukemia, prednisolone in lymphoma treatment, and triamcinolone has recently demonstrated some anti-cancer activity. See, e.g., Scholz M., et al., *J. Urol.* 173: 1947-52. (2005); Sano J., et al., *Res Vet Sci.* (May 10, 005); Zinzani P L. et al., *Semin Oncol.* 32(1 Suppl 1):S4-10. (2005); and Abrams, M T et al., *J Cancer Res Clin Oncol.* 131:347-54 (2005). It is believed gene transcription resulting from treatment with glucocorticoids results in apoptotic death and therapeutic effect. Analysis of sensitive and resistant cell lines have demonstrated differential gene expression patterns, suggesting expression differences account for varied response rates to glucocorticoid therapy. See, e.g., Thompson, E. B., et al., *Lipids.* 39:821-5 (2004), and references cited therein.

While advances in development of successful cancer therapies progress, individual patient responses continue to demonstrate subsets of patient response to any particular therapy. We have conducted gene expression analysis studies to assess patient populations undergoing glucocorticoid therapy or proteasome inhibition therapy. Analyses were carried out to identify predictive markers associated with particular patients who respond well to treatment (responders) with a glucocorticoid and/or proteasome inhibitor versus those patients who do not respond to treatment (non-responders) with a glucocorticoid and/or proteasome inhibitor.

DESCRIPTION OF THE INVENTION

The present invention is based, in part, on the identification of individual markers and marker sets that can be used to determine whether a tumor may be effectively treated by treatment with a proteasome inhibition therapy and/or a glucocorticoid therapy. For example, the compositions and methods provided herein can be used to determine whether a patient will be responsive or non-responsive to a proteasome inhibition therapeutic agent. Furthermore the compositions and methods provided herein can be used to determine whether a patient will be responsive or non-responsive to a glucocorticoid therapeutic agent. Based on these identifications, the present invention provides, without limitation: 1) methods and compositions for determining whether a proteasome inhibition therapy and/or a glucocorticoid therapy will or will not be effective in stopping or slowing tumor growth and patient treatment; 2) methods and compositions for monitoring the effectiveness of a proteasome inhibition therapy (a proteasome inhibitor agent or a combination of agents) and/or a glucocorticoid therapy used for the treatment of tumors; 3) methods and compositions for treatments of tumors comprising proteasome inhibition therapy and/or glucocorticoid therapy; and 4) methods and compositions for identifying specific therapeutic agents and combinations of therapeutic agents that are effective for the treatment of tumors in specific patients.

The markers of the present invention, whose expression correlates with the response to an agent, are identified in Table 1A, Table 1B, Table 2A, Table 2B, and Table 3. By examining the expression of one or more of the identified markers or marker sets in a tumor, it is possible to determine which therapeutic agent or combination of agents will be most likely to reduce the growth rate of the cancer cells. By examining the expression of one or more of the identified markers or marker sets in a cancer, it is also possible to determine which therapeutic agent or combination of agents will be the least likely to reduce the growth rate of cancer cells. By examining the expression of one or more of the identified markers or marker sets, it is therefore possible to eliminate ineffective or inappropriate therapeutic agents Importantly, these determinations can be made on a patient by patient basis or on an agent by agent basis. Thus, one can determine whether or not a particular therapeutic regimen is likely to benefit a particular patient or type of patient, and/or whether a particular regimen should be continued.

The present invention is directed to methods of identifying and/or selecting a cancer patient who is responsive to a therapeutic regimen. In particular, the methods are directed to identifying or selecting a cancer patient who is responsive to a therapeutic regimen comprising proteasome inhibition therapy and/or glucocorticoid therapy. Additionally provided are methods of identifying a patient who is non-responsive to such a therapeutic regimen. These methods typically include the determining the level of expression of one or more predictive markers in a patient's tumor (e.g., a patient's cancer cells), comparing the level of expression to a reference expression level, and identifying whether expression in the sample includes a pattern or profile of expression of a selected predictive marker or marker set which corresponds to response or non-response to proteasome inhibition therapy and/or glucocorticoid therapy.

Additionally provided methods include therapeutic methods which further include the step of beginning, continuing, or commencing, or stopping, discontinuing or halting a therapy accordingly where a patient's predictive marker profile indicates that the patient would respond or not respond to the proteasome inhibition and/or glucocorticoid therapeutic regimen. In another aspect, methods are provided for analysis of a patient not yet being treated with a proteasome inhibition therapy or glucocorticoid therapy and identification and prediction that the patient would not be a responder to the therapeutic agent and such patient should not be treated with the proteasome inhibition therapy and/or glucocorticoid therapy when the patient's marker profile indicates that the patient is a non-responder. Thus, the provided methods of the invention can eliminate ineffective or inappropriate use of proteasome inhibition therapy and/or glucocorticoid therapy regimens.

Additionally provided are classifiers which can be used to develop a diagnostic test or a readable array useful for identifying patients who will be responsive or non-responsive to proteasome inhibition therapy and/or glucocorticoid therapy. Probes or peptides identified in a classifier of the invention can be included in a diagnostic or prognostic test to select a therapy, e.g., proteasome inhibition therapy and/or glucocorticoid therapy or a test which is used to determine continuation of therapy, e.g., proteasome inhibition therapy and/or glucocorticoid therapy.

Additional methods include methods to determine the activity of an agent, the efficacy of an agent, or identify new therapeutic agents or combinations. Such methods include methods to identify an agent useful as a proteasome inhibitor and/or a glucocorticoid inhibitor, for treating a cancer, e.g. a hematological cancer (e.g., multiple myeloma, leukemias, lymphoma, etc) or cancer from a solid tumor (e.g., in lung, breast, prostate, ovary, colon, kidney or liver), based on its ability to affect the expression of markers in a marker set of the invention. For example, an inhibitor which decreases or increases the level of expression of a marker or markers provided as upregulated or down-regulated, respectively, in a set predictive for responsiveness to proteasome inhibition of the cancer would be a candidate inhibitor for the cancer. In another example, an inhibitor which decreases or increases the level of expression of a marker or markers provided as upregulated or downregulated, respectively, in a set predictive for responsiveness to glucocorticoid inhibition of the cancer would be a candidate inhibitor for the cancer.

The present invention is also directed to methods of treating a cancer patient, with a therapeutic regimen, in particular a proteasome inhibitor therapy (e.g., a proteasome inhibitor agent, alone, or in combination with an additional agent such as a chemotherapeutic agent) and/or glucocorticoid therapy regimen (a glucocorticoid agent, alone or in combination with an additional agent), which includes the step of selecting a patient whose predictive marker profile indicates that the patient will respond to the therapeutic regimen, and treating the patient with the proteasome inhibition therapy and/or glucocorticoid therapy.

Additional methods include selecting patients that are unlikely to experience response or increased time to progression upon treatment with a cancer therapy (e.g., proteasome inhibition therapy, glucocorticoid therapy). Furthermore provided are methods for selection of a patient having aggressive disease and more rapid time to progression.

Additional methods include a method to evaluate whether to treat or pay for the treatment of cancer, e.g. hematological cancer (e.g., multiple myeloma, leukemias, lymphoma, etc) or cancer from a solid tumor (e.g., in lung, breast, prostate, ovary, colon, kidney or liver), by reviewing a patient's predictive marker profile for responsiveness or non-responsiveness to proteasome inhibition and/or glucococorticoid therapy.

DEFINITIONS

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, preferred methods and materials are described herein. The content of all database accession records (e.g., representative public identifier ID from Affymetrix HG133 annotation files, Entrez, GenBank, RefSeq) cited throughout this application (including the Tables) are also hereby incorporated by reference. The contents of files disclosing the Affymetrix HG-133A Probe Sequences and HG-133B Probe Sequences, both FASTA files dated Jun. 9, 2003 (Affymetrix, Inc., Santa Clara, Calif.), also hereby are incorporated by reference. In the case of conflict, the present specification, including definitions, will control.

The articles "a" and "an" are used herein to refer to one or to more than one (i.e. at least one) of the grammatical object of the article. By way of example, "an element" means at least one element and can include more than one element.

A "marker" is a naturally-occurring polymer corresponding to at least one of the nucleic acids or proteins associated with Affymetrix probe set identifiers listed in any one of Table 1A, Table 1B, Table 2A, Table 2B, and Table 3. For example, markers include, without limitation, sequences recognized by the Affymetric probes and probeset identifiers, sense and anti-sense strands of genomic DNA (i.e. including any introns occurring therein), RNA generated by transcription of genomic DNA (i.e. prior to splicing), RNA generated by splicing of RNA transcribed from genomic DNA, and proteins generated by translation of spliced RNA (i.e. including proteins both before and after cleavage of normally cleaved regions such as transmembrane signal sequences). As used herein, a "marker" may also include a cDNA made by reverse transcription of an RNA generated by transcription of genomic DNA (including spliced RNA). A "marker set" is a group of markers, comprising two or more predictive markers of the invention. Markers of the present invention include the predictive markers identified in Table 1A, Table 1B, Table 2A, Table 2B, and Table 3; as identified by the particular probeset identifier, representative public identifier, title, gene symbol, and/or Entrez gene identifier, and include the representative nucleotide and/or protein sequence or fragment thereof which corresponds to the identifier.

A "predictive marker" as used herein, includes a marker which has been identified as having differential expression in tumor cells of a patient and furthermore that expression is characteristic of a patient who is responsive in either a positive or negative manner to treatment with a proteasome inhibitor regimen and/or glucocorticoid regimen. For example, a predictive marker includes a marker which is demonstrates higher expression in a non-responsive patient; alternatively a predictive marker includes a marker which demonstrates higher expression in a responsive patient. Similarly, a predictive marker is intended to include those markers which demonstrate lower expression in a non-responsive patient as well as those markers which demonstrate lower expression in a responsive patient. Thus, as used herein, predictive marker is intended to include each and every one of these possibilities, and further can include each single marker individually as a predictive marker; or alternatively can include one or more, or all of the characteristics collectively when reference is made to "predictive markers" or "predictive marker sets." A predictive marker set also can be known as a "classifier."

As used herein, a "naturally-occurring" refers to a molecule (e.g., RNA, DNA, protein, etc.) that occurs in nature (e.g. encodes a natural protein, a naturally produced protein, etc).

The term "probe" refers to any molecule which is capable of selectively binding to a specifically intended target molecule, for example a marker of the invention. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic monomers.

The "normal" level of expression of a marker is the level of expression of the marker in cells in a similar environment or response situation, in a patient not afflicted with cancer. A normal level of expression of a marker may also refer to the level of expression of a "reference sample", (e.g., sample from a healthy subjects not having the marker associated disease). A reference sample expression may be comprised of an expression level of one or more markers from a reference database. Alternatively, a "normal" level of expression of a marker is the level of expression of the marker in non-tumor cells in a similar environment or response situation from the same patient that the tumor is derived from.

"Differential expression" of a marker refers to expression of a marker that varies in level across patients. Furthermore, in this invention we refer to a marker as "differentially expressed" when its expression level is correlated with, or otherwise indicative of, response or non-response to treatment.

"Complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

As used herein, "informative" expression is intended to refer to the expression level of a differentially expressed predictive marker which corresponds to responsiveness or non-responsiveness. The expression level of a marker in a patient is "informative" if it is greater than a reference level by an amount greater than the standard error of the assay employed to assess expression. Alternatively, a marker that is differentially expressed will have typical ranges of expression level that are predictive of responsiveness or non-responsiveness. An informative expression level is a level that falls within the responsive or non-responsive range of expressions. Still further, a set of markers may together be "informative" if the combination of their expression levels either meets or is above or below a pre-determined score for a predictive marker set as determined by methods provided herein.

A given marker may be indicative of both responsive and non-responsive patients; for example, expression of a predictive marker provided herein above a given threshold (e.g., an informative expression level) may be indicative of a responsive patient, as described herein. Expression of that marker below a given threshold (e.g., below an informative level) may be indicative of a non-responsive patient A cancer or tumor is treated or diagnosed according to the present methods. "Cancer" or "tumor" is intended to include any neoplastic growth in a patient, including an inititial tumor and any metastases. The cancer can be of the liquid or solid tumor type. Liquid tumors include tumors of hematological origin, including, e.g., myelomas (e.g., multiple myeloma), leukemias (e.g., Waldenstrom's syndrome, chronic lymphocytic leukemia, other leukemias), and lymphomas (e.g., B-cell lymphomas, non-Hodgkins lymphoma). Solid tumors can originate in organs, and include cancers such as lung, breast, prostate, ovary, colon, kidney, and liver. As used herein, cancer cells, including tumor cells, refer to cells that divide at an abnormal (increased) rate. Cancer cells include, but are not limited to, carcinomas, such as squamous cell carcinoma, basal cell carcinoma, sweat gland carcinoma, sebaceous gland carcinoma, adenocarcinoma, papillary carcinoma, papillary adenocarcinoma, cystadenocarcinoma, medullary carcinoma, undifferentiated carcinoma, bronchogenic carcinoma, melanoma, renal cell carcinoma, hepatoma-liver cell carcinoma, bile duct carcinoma, cholangiocarcinoma, papillary carcinoma, transitional cell carcinoma, choriocarcinoma, semonoma, embryonal carcinoma, mammary carcinomas, gastrointestinal carcinoma, colonic carcinomas, bladder carcinoma, prostate carcinoma, and squamous cell carcinoma of the neck and head region; sarcomas, such as fibrosarcoma, myxosarcoma, liposarcoma, chondrosarcoma, osteogenic sarcoma, chordosarcoma, angiosarcoma, endotheliosarcoma, lymphangiosarcoma, synoviosarcoma and mesotheliosarcoma; hematologic cancers, such as myelomas, leukemias (e.g., acute myelogenous leukemia, chronic lymphocytic leukemia, granulocytic leukemia, monocytic leukemia, lymphocytic leukemia), and lymphomas (e.g., follicular lymphoma, mantle cell lymphoma, diffuse large Bcell lymphoma, malignant lymphoma, plasmocytoma, reticulum cell sarcoma, or Hodgkins disease); and tumors of the nervous system including glioma, meningoma, medulloblastoma, schwannoma or epidymoma.

A cancer is "responsive" to a therapeutic agent if its rate of growth is inhibited as a result of contact with the therapeutic agent, compared to its growth in the absence of contact with the therapeutic agent. Growth of a cancer can be measured in a variety of ways, for instance, the size of a tumor or the expression of tumor markers appropriate for that tumor type may be measured. For example, the response definitions used to identify markers associated with myeloma and its response to proteasome inhibition therapy and/or glucocorticoid therapy, the Southwestern Oncology Group (SWOG) criteria as described in Blade et al., *Br J Haematol*. 1998 September; 102(5):1115-23 were used (also see e.g., Table C). These criteria define the type of response measured in myeloma and also the characterization of time to disease progression which is another important measure of a tumor's sensitivity to a therapeutic agent. The quality of being responsive to a proteasome inhibition therapy and/or glucocorticoid therapy is a variable one, with different cancers exhibiting different levels of "responsiveness" to a given therapeutic agent, under different conditions. Still further, measures of responsiveness can be assessed using additional criteria beyond growth size of a tumor, including patient quality of life, degree of metastases, etc. In addition, clinical prognostic markers and variables can be assessed (e.g., M protein in myeloma, PSA levels in prostate cancer) in applicable situations.

A cancer is "non-responsive" to a therapeutic agent if its rate of growth is not inhibited, or inhibited to a very low degree, as a result of contact with the therapeutic agent when compared to its growth in the absence of contact with the therapeutic agent. As stated above, growth of a cancer can be measured in a variety of ways, for instance, the size of a tumor or the expression of tumor markers appropriate for that tumor type may be measured. For example, the response definitions used to identify markers associated with non-response of multiple myeloma to therapeutic agents, the Southwestern Oncology Group (SWOG) criteria as described in Blade et. al. were used in the experiments described herein. The quality of being non-responsive to a therapeutic agent is a highly variable one, with different cancers exhibiting different levels of "non-responsiveness" to a given therapeutic agent, under different conditions. Still further, measures of non-responsiveness can be assessed using additional criteria beyond growth size of a tumor, including patient quality of life, degree of metastases, etc. In addition, clinical prognostic markers and variables can be assessed (e.g., M protein in myeloma, PSA levels in prostate cancer) in applicable situations.

"Treatment" shall mean preventing or inhibiting further tumor growth, as well as causing shrinkage of a tumor. Treatment is also intended to include prevention of metastasis of tumor. A tumor is "inhibited" or "treated" if at least one symptom (as determined by responsiveness/non-responsiveness, time to progression, or indicators known in the art and described herein) of the cancer or tumor is alleviated, terminated, slowed, minimized, or prevented. Any amelioration of any symptom, physical or otherwise, of a tumor pursuant to treatment using a therapeutic regimen (e.g., proteasome inhibition regimen, glucocorticoid regimen) as further described herein, is within the scope of the invention.

As used herein, the term "agent" is defined broadly as anything that cancer cells, including tumor cells, may be exposed to in a therapeutic protocol. In the context of the present invention, such agents include, but are not limited to, proteasome inhibition agents, glucocorticoidal steroid agents, as well as chemotherapeutic agents as known in the art and described in further detail herein.

A "kit" is any article of manufacture (e.g. a package or container) comprising at least one reagent, e.g. a probe, for specifically detecting a marker or marker set of the invention. The article of manufacture may be promoted, distributed, or sold as a unit for performing the methods of the present invention. The reagents included in such a kit comprise probes/primers and/or antibodies for use in detecting responsive and non-predictive marker expression. In addition, the kits of the present invention may preferably contain instructions which describe a suitable detection assay. Such kits can be conveniently used, e.g., in clinical settings, to diagnose and evaluate patients exhibiting symptoms of cancer, in particular patients exhibiting the possible presence of an a cancer capable of treatment with proteasome inhibition therapy and/or glucocorticoid therapy, including, e.g., hematological cancers e.g., myelomas (e.g., multiple myeloma), lymphomas (e.g., non-hodgkins lymphoma), leukemias, and solid tumors (e.g., lung, breast, ovarian, etc.).

The present methods and compositions are designed for use in diagnostics and therapeutics for a patient suffering from cancer. The cancer can be of the liquid or solid tumor type. Liquid tumors include tumors of hematological origin, including, e.g., myelomas (e.g., multiple myeloma), leukemias (e.g., Waldenstrom's syndrome, chronic lymphocytic leukemia, other leukemias), and lymphomas (e.g., B-cell lymphomas, non-Hodgkins lymphoma). Solid tumors can originate in organs, and include cancers such as lung, breast, prostate, ovary, colon, kidney, and liver.

The invention provides methods for determining or assessing an appropriate cancer therapy regimen for treating a tumor in a patient. The cancer therapy regimens appropriate for use in or in conjunction with the provided methods comprise proteasome inhibition therapy and/or glucocorticoid therapy. For example, proteasome inhibitor therapy comprises treatment of a patient with a proteasome inhibitor (e.g., bortezomib, or any other proteasome inhibitor described in further detail herein), alone or in combination with one or more additional agents. In another example, glucocorticoid therapy comprises treatment of a patient with a glucocorticoid (e.g., dexamethasone, or any other glucocorticoid described in further detail herein), alone or in combination with one or more additional agents.

The provided methods comprise measuring the level of expression of at least one predictive marker in the patient's tumor and determining a cancer therapy regimen for treating the tumor based on the expression level of the predictive marker or markers, as relevant. An informative expression level of a predictive marker or markers in the patient sample is an indication that the patient is a responsive patient and would benefit from proteasome inhibition therapy and/or glucocorticoid therapy when the predictive marker or marker set provided herein indicate such responsiveness. Additionally, an informative expression level of a predictive marker or markers in a patient is an indication that the patient is a non-responsive patient and would not benefit from proteasome inhibition therapy and/or glucocorticoid therapy when the marker or markers provided herein indicate such non-responsiveness.

The invention further provides methods for determining whether a patient will be responsive to a cancer therapy regimen for treating a tumor. Such methods comprise measuring the level of expression of at least one predictive marker in the patient's tumor and determining a proteasome inhibition based regimen and/or glucocorticoid based regimen for treating the tumor based on the expression level of the predictive marker or marker set. An informative expression level of a predictive marker in the patient sample is an indication that the patient is a responsive patient and would benefit from proteasome inhibition and/or glucocorticoid therapy. An informative expression level of a predictive marker set in the patient is an indication that the patient is a responsive patient and would benefit from proteasome inhibition therapy and/or glucocorticoid therapy when the marker or markers provided herein indicate such responsiveness. Selected predictive markers for use in the methods comprise predictive markers which demonstrate increased expression in responsive patients and/or longer time to disease progression.

The invention provides methods for determining whether a patient has aggressive disease and will progress in disease faster than a patient not demonstrating aggressive disease. A patient indicative of having aggressive disease also may be non-responsive to a cancer therapy regimen for treating a tumor. Such methods comprise measuring the level of expression of at least one predictive marker in the patient's tumor and identifying the patient as having aggressive disease based on the expression level of the predictive marker or marker set. An informative expression level of a predictive marker in the patient sample is an indication that the patient has aggressive disease patient and is likely to progress and may not benefit from proteasome inhibition based regimen and/or glucocorticoid based regimen therapy. An informative expression level of a predictive marker set in the patient is an indication that the patient is a patient having aggressive disease and would not benefit from proteasome inhibition based regimen and/or glucocorticoid based regimen when the selected marker or marker set provided herein indicate such disease aggressiveness. Selected predictive markers for use in the methods comprise predictive markers which demonstrate increased expression in non-responsive patients and/or shorter time to disease progression in patients and are not specific to treatment with proteasome inhibition therapy or glucocorticoid therapy.

Still further, the invention provides methods for determining whether a patient will be non-responsive to a cancer therapy regimen for treating a tumor. Such methods comprise measuring the level of expression of at least one predictive marker in the patient's tumor and determining a proteasome inhibition based regimen and/or glucocorticoid based regimen for treating the tumor based on the expression level of the predictive marker or marker set. An informative expression level of a predictive marker in the patient sample is an indication that the patient is a non-responsive patient and would not benefit from proteasome inhibition based regimen and/or glucocorticoid based regimen therapy. An informative expression level of a predictive marker set in the patient is an indication that the patient is a non-responsive patient and would not benefit from proteasome inhibition based regimen and/or glucocorticoid based regimen when the selected marker or marker set provided herein indicate such non-responsiveness. Selected predictive markers for use in the methods comprise predictive markers which demonstrate increased expression in non-responsive patients and/or shorter time to disease progression.

The invention further provides methods for treating a tumor in a patient with a proteasome inhibition based regimen and/or glucocorticoid based regimen therapy. Such therapeutic methods comprise measuring the level of expression of at least one predictive marker in a patient's tumor; determining whether a proteasome inhibition based regimen and/or glucocorticoid based regimen for treating the tumor is appropriate based on the expression level of the predictive marker or markers, and treating a patient with a proteasome inhibition based therapy and/or glucocorticoid based therapy when the patient's expression level indicates a responsive patient. An informative expression level of predictive marker in the patient sample is an indication that the patient is a responsive patient and would benefit from proteasome inhibition based regimen and/or glucocorticoid based regimen therapy when the predictive marker or marker set provided herein indicate the patient is a responsive patient.

Methods of the invention use at least one of the predictive markers set forth in any one of Table 1A, Table 1B, Table 2A, Table 2B, and Table 3. Additionally, the methods provided can use two, three, four, five, six, or more markers to form a predictive marker set. For example, marker sets selected from the markers in Table 1A, Table 1B, Table 2A, Table 2B, and/or Table 3 can be generated using the methods provided herein and can comprise between two, and all of the markers set forth in Table 1A, Table 1B, Table 2A, Table 2B, or Table 3 and each and every combination in between (e.g., four selected markers, 16 selected markers, 74 selected markers, etc.). In some embodiments, the predictive marker set comprises at least 5, 10, 20, 40, 60, 100, 150, 200, or 300 or more markers. In other embodiments, the predictive marker set comprises no more than 5, 10, 20, 40, 60, 100, 150, 200, 300, 400, 500, 600 or 700 markers. In some embodiments, the predictive marker set includes a plurality of genes associated with cancer, e.g. a hematological cancer (e.g., multiple myeloma, leukemias, lymphoma, etc) or cancer from a solid tumor (e.g., in lung, breast, prostate, ovary, colon, kidney or liver). In some embodiments, the predictive marker set includes a plurality of markers listed in Table 1A, Table 1B, Table 2A, Table 2B, or Table 3. In some embodiments the predictive marker set includes at least about 1%, about 5%, about 10%, about 20%, about 30%, about 40%, about 50%, about 60%, about 70%, about 80%, about 90%, about 95%, about 96%, about 97%, about 98%, or about 99% of the markers listed in Table 1B, Table 2A, Table 2B, or Table 3. Selected predictive marker sets can be assembled from the predictive markers provided using methods provided herein and analogous methods known in the art. An exemplary predictive marker sets is provided in Table 4. In certain aspects, the markers comprise those set forth in Table 4.

Methods of the invention further provide the ability to construct marker sets from the individual predictive markers set forth in Table 1A, Table 1B, Table 2A, Table 2B, and Table 3 using the methods described in further detail herein. In a further aspect, more than one marker set can be used in combination for the diagnostic, prognostic and treatment methods provided.

The methods of the invention can be performed such that determination of the level of expression of a predictive marker is measured prior to tumor therapy in order to identify whether the patient will be responsive to a proteasome inhibition therapy and/or glucocorticoid therapy.

In addition, the methods of the invention can be performed concurrently with ongoing tumor therapy to determine if the patient is either responding to present proteasome inhibition therapy and/or glucocorticoid therapy or will respond to additional therapy comprising proteasome inhibition therapy and/or glucocorticoid therapy.

Still further, the methods of the invention can be performed after tumor therapy has been carried out in order to assess whether the patient will be responsive to future course of proteasome inhibition therapy and/or glucocorticoid therapy.

Whether the methods are performed during ongoing tumor therapy or after a course of tumor therapy, the tumor therapy can comprise proteasome inhibition therapy and/or glucocorticoid therapy, alone or alternative forms of cancer therapy. The methods provided are designed to determine if the patient will benefit from additional or future proteasome inhibition and/or glucocorticoid therapy, and can include such proteasome inhibition and/or glucocorticoid therapy alone or in combination with additional therapeutic agents.

In certain aspects, the level of expression of predictive marker in the patient's tumor is measured by isolating a sample of the tumor and performing analysis on the isolated sample, or a portion thereof. In another aspect, the level of expression of predictive marker in the patient's tumor is measured using in vivo imaging techniques.

In certain aspects, determining the level of expression of a predictive marker comprises detection of mRNA. Such detection can be carried out by any relevant method, including e.g., PCR, northern, nucleotide array detection, in vivo imaging using probes capable of detection of the appropriate nucleic acid. In other aspects, determining the level of expression of the predictive marker comprises detection of protein. Such detection can be carried out using any relevant method for protein detection, including e.g., ELISA, western blot, immunoassay, protein array detection, in vivo imaging using probes capable of detection of the appropriate peptide.

Determining the level of expression of a predictive marker is compared to a reference expression level. For example, a reference expression level can be a predetermined standard reference level of expression in order to evaluate if expression of a marker or marker set is informative and make an assessment for determining whether the patient is responsive or non-responsive. Additionally, determining the level of expression of a predictive marker can be compared to an internal reference marker level of expression which is measured at the same time as the predictive marker in order to make an assessment for determining whether the patient is responsive or non-responsive. For example, expression of a distinct marker or markers which is/are not predictive markers of the invention, but which is known to demonstrate a constant expression level can be assessed as an internal reference marker level, and the level of the predictive marker expression is determined as compared to the reference. In an alternative example, expression of the selected predictive marker or markers in a tissue sample which is a non-tumor sample can be assessed as an internal reference marker level. The level of expression of a marker or markers may be determined as having increased expression in certain aspects. The level of expression of a marker or markers may be determined as having decreased expression in other aspects. The level of expression may be determined as no informative change in expression as compared to a reference level. In still other aspects, the level of expression is determined against a pre-determined standard expression level as determined by the methods provided herein.

The invention also relates to various reagents and kits for diagnosing, staging, prognosing, monitoring and treating a cancer patient (e.g., a patient with a liquid tumor or a solid tumor), with proteasome inhibition therapy and/or glucocorticoid therapy. Provided are reagents for detection of markers and marker sets and for use in the methods of the invention comprising at least two isolated predictive markers set forth in Table 1A, Table 1B, Table 2A, Table 2B, and Table 3. Such reagents include nucleic acid probes, primers, antibodies, antibody derivatives, antibody fragments, and peptide probes for detection of the relevant predictive markers set forth in Table 1A, Table 1B, Table 2A, Table 2B, and Table 3.

Further provided are kits for use in the provided methods. The kits of the invention include reagents for assessing predictive markers (e.g., at least one predictive marker) and predictive marker sets (e.g., at least two, three, four or more markers selected from Table 1A, Table 1B, Table 2A, Table 2B, and Table 3), as well as instructions for use in accordance with the methods provided herein. In certain aspects, the kits provided contain nucleic acid probes for assessment of predictive markers. In still other aspects, the kits provided contain antibody, antibody derivative antibody fragment, or peptide reagents for assessment of predictive markers.

Identification of Responsive and Non-Responsive Markers

The present invention provides markers that are expressed in a tumor that is responsive to proteasome inhibition therapy and/or glucocorticoid therapy and whose expression correlates with responsiveness to that therapeutic agent. The present invention also provides markers that are expressed in a tumor that is non-responsive to proteasome inhibition therapy and/or glucocorticoid therapy and whose expression correlates with non-responsiveness to such therapy. Accordingly, one or more of the markers can be used to identify cancers that can be successfully treated by proteasome inhibition therapy and/or glucocorticoid therapy. One or more of the markers of the present invention can be used to identify patients that can be successfully treated using proteasome inhibition therapy and/or glucocorticoid therapy. In addition, the markers of the present invention can be used to identify a patient that has become or is at risk of becoming refractory to treatment with proteasome inhibition therapy and/or glucocorticoid therapy. The invention also features combinations of markers, referred to herein as "marker sets," that can predict whether a patient is likely to respond or not to respond to a proteasome inhibition therapy and/or glucocorticoid therapy regimen.

Table 1 sets forth predictive markers identified using statistical analysis applied to samples from 224 patients, which are specific identifiers of response or non-response to proteasome inhibition therapy (e.g., bortezomib). The markers in Table 1 are differentially expressed in samples from patients that are either responsive or non-responsive to treatment with the proteasome inhibitor bortezomib. Thus, one would appreciate that the markers identified can function in a predictive model to prospectively identify patients' response to proteasome inhibition therapy, including response to bortezomib or other proteasome inhibition therapies known in the art as well as those described in further detail herein. In particular, the markers in Table 1 are correlated with a positive response to therapy (referred to herein as "responsive, (R)"); or a long time until disease progression (TTP) as determined by a Cox proportional hazard analysis, as described in further detail herein. A patient with a positive response (either complete, partial or minimal; see Table C) to therapy is hereinafter referred to as a "responder". Predictors of long time to progression are useful as additional indicators of patients who are likely to progress in disease at a slower rate and may be more likely to be responsive to therapy than other patients. Additionally, the predictive markers in Table 1 are correlated with a negative or poor response to an agent (referred to herein as "non-responsive, (NR)"), or a short time to disease progression (TTP). A patient with a poor response (called a progressive or refractory disease; see Table C) to treatment is hereinafter referred to as a "non-responder". These identified predictive markers are useful as additional indicators of patients who are likely to progress in disease at a faster rate, and less likely to be responsive to therapy than other patients. A patient with no response to treatment is hereinafter referred to as "stable".

Table 1A provides predictive markers which are upregulated indicators of non-response and/or correlate with shorter time to progression. Marker nos. 1-547 in Table 1A are newly identified predictive markers, and predictive markers no. 548-657 have been previously identified as associated markers predictive of non-response and/or correlation with shorter time to progression. See, International Patent Publication No. WO04053066, published Jun. 24, 2004. Table 1B provides predictive markers which are upregulated indicators of response and/or correlate with longer time to progression. Marker nos. 658-876 in Table 1B are newly associated predictive markers, and predictive markers no. 877-911 have been previously identified as associated markers predictive of response and/or correlation with longer time to progression. See, International Patent Publication No. WO04053066, published Jun. 24, 2004.

Table 2 sets forth predictive markers identified using statistical analysis applied to samples from 224 patients, which are specific identifiers of response or non-response to glucocorticoid therapy (e.g., dexamethasone). The markers in Table 2 are differentially expressed in samples from patients that are either responsive or non-responsive to treatment with the glucocorticoidal steroid agent dexamethasone. Thus, one would appreciate that the markers identified can function in a predictive model to prospectively identify patients' response to glucocorticoid therapy, including response to dexamethasone or other glucocorticoid therapies known in the art as well as those described in further detail herein. As in Table 1, Table 2 sets forth predictive markers identified which are specific identifiers of response or long time to progression; or non-response or short time to progression upon therapy with glucocorticoid treatment (e.g., dexamethasone).

Table 2A provides predictive markers which are upregulated indicators of non-response and/or correlate with shorter time to progression. Table 2B provides predictive markers which are upregulated indicators of response and/or correlate with longer time to progression.

Table 3 sets forth predictive markers identified which do not distinguish between response to proteasome inhibition therapy and response to glucocorticoid therapy, rather are indicator predictive markers of response/longer time to progression or non-response/shorter time to progression with regard to either therapy, and are indicators of general disease aggressiveness. Marker nos. 1203-1423 in Table 3 are newly associated predictive markers, and predictive markers no. 1424-1474 have been previously identified as associated markers predictive of non-response/correlation with shorter time to progression and/or response/correlation with longer time to progression related to advanced stage patient's response to bortezomib treatment. See, International Patent Publication No. WO04053066, published Jun. 24, 2004.

In the methods of the present invention, the level of expression of one or more predictive markers selected from the group consisting of the markers identified in Table 1A, Table 1B, Table 2A, Table 2B, and Table 3, is determined. As used herein, the level or amount of expression refers to the absolute level of expression of an mRNA encoded by the marker or the absolute level of expression of the protein encoded by the marker (i.e., whether or not expression is or is not occurring in the cancer cells).

Generally, it is preferable to determine the expression of two or more of the identified responsive or non-predictive markers, or three or more of the identified responsive or non-predictive markers, or still further a larger a set of the identified responsive and/or non-predictive markers, selected from the predictive markers identified in Table 1A, Table 1B, Table 2A, Table 2B, and Table 3. For example, Table 4 sets forth marker sets identified using the methods described herein and can be used in the methods of the present invention. Still further, additional and/or alternative marker sets comprising the predictive markers identified herein can be generated using the methods and predictive markers provided. Thus, it is possible to assess the expression of a panel of responsive and non-predictive markers using the methods and compositions provided herein.

As an alternative to making determinations based on the absolute expression level of selected markers, determinations may be based on normalized expression levels. Expression levels are normalized by correcting the absolute expression level of a predictive marker by comparing its expression to the expression of a reference marker that is not a predictive marker, e.g., a housekeeping gene that is constitutively expressed. Suitable markers for normalization include housekeeping genes, such as the actin gene. Constitutively expressed genes are known in the art and can be identified and selected according to the relevant tissue and/or situation of the patient and the analysis methods. Such normalization allows one to compare the expression level in one sample, e.g., a tumor sample, to another sample, e.g., a non-tumor sample, or between samples from different sources.

Further, the expression level can be provided as a relative expression level. To determine a relative expression level of a marker or marker set, the level of expression of the predictive marker or marker set is determined for 10 or more individual samples, preferably 50 or more individual samples in order to establish a baseline, prior to the determination of the expression level for the sample in question. To establish a baseline measurement, mean expression level of each of the predictive markers or marker sets assayed in the larger number of samples is determined and this is used as a baseline expression level for the predictive markers or marker sets in question. The expression level of the marker or marker set determined for the test sample (absolute level of expression) is then divided by the mean expression value obtained for that marker or marker set. This provides a relative expression level and aids in identifying extreme cases of responsive or non-responsive-ness.

Determining Responsiveness or Non-Responsiveness to an Agent

The expression level (including protein level) of the identified predictive markers of responsive/non-responsive patients and may be used to: 1) determine if a patient can be treated by an agent or combination of agents; 2) determine if a patient is responding to treatment with an agent or combination of agents; 3) select an appropriate agent or combination of agents for treating a patient; 4) monitor the effectiveness of an ongoing treatment; 5) identify new cancer therapy treatments (either single agent proteasome inhibitor and/or glucocorticoid agents or complementary agents which can be used alternatively or in combination with proteasome inhibition and/or glucocorticoid agents); 6) identify aggressiveness of a cancer; and 7) select an appropriate agent or combination of agents in treating early and late recurrence of a cancer. In particular, the identified predictive markers may be utilized to determine appropriate therapy, to monitor clinical therapy and human trials of a drug being tested for efficacy, and to develop new agents and therapeutic combinations.

A cancer may be predisposed to respond to an agent if one or more of the corresponding predictive markers identified in Table 1B, Table 2B, and Table 3 (as indicated by (+) in Table 3) demonstrate increased expression. In certain aspects of the invention, the predisposition of a cancer to be responsive to an agent is determined by the methods of the present invention, wherein informative expression of the individual predictive markers of the marker sets identified in Table 4 is evaluated. Likewise, the predisposition of a patient to be responsive to an agent is determined by the methods of the present invention, wherein a marker set generated using to the methods described herein wherein the markers comprising the marker set include predictive markers set forth in Table 1B, Table 2B, and Table 3, and the expression of the marker set is evaluated.

A cancer may be predisposed to non-responsiveness to an agent if one or more of the corresponding non-predictive markers demonstrates informative expression levels. A cancer may be predisposed to non-responsiveness to an agent if one or more of the corresponding predictive markers identified in Table 1A, Table 2A, and Table 3 (as indicated by (−) in Table 3) demonstrate informative increased expression. In certain aspects of the invention, the predisposition of a cancer to be non-responsive to an agent is determined by the methods of the present invention, wherein informative expression of the individual predictive markers of the marker sets identified in Table 4 is evaluated. Likewise, the predisposition of a patient to be non-responsive to an agent is determined by the methods of the present invention, wherein a marker set is generated using the methods described herein wherein the markers comprising the marker set include predictive markers set forth in Table 1A, Table 2A, and/or Table 3, and the expression of the marker set is evaluated.

In one aspect, the predictive marker set for evaluation of a cancer predisposed to respond or predisposed to not respond to a therapy comprises markers selected from those set forth in any of Table 1A Table 1B, Table 2A Table 2B and Table 3. Still a further aspect contemplates markers set forth in either Table 1A and Table 1B alone or in combination with markers set for the in Table 2A and Table 2B and/or Table 3, or alternatively, those markers set forth in Table 2A and Table 2B alone or in combination with Table 1A and Table 1B and/or Table 3. In still another aspect the predictive marker or markers evaluated are selected from those set forth in Table 3. In certain aspects, the marker set is selected from those set forth in Table 4. According to the methods, proteasome inhibition therapy and/or glucocorticoid therapy would be continued where the expression profile indicates continued responsiveness, or decreased non-responsiveness using the evaluation methods described herein.

The present invention provides methods for determining whether a cancer therapy e.g., a proteasome inhibitor and/or glucocorticoid agent, can be used to reduce the growth rate of a tumor comprising evaluating expression of at least one predictive marker or a predictive marker set in a tumor sample; and identifying that proteasome inhibition therapy and/or glucocorticoid therapy is or is not appropriate to reduce the growth rate of the tumor based on the evaluation.

The invention provides a method for determining whether a proteasome inhibition therapeutic regimen (e.g., a proteasome inhibitor agent (e.g., bortezomib) alone or in combination with another chemotherapeutic agent) can be used to reduce the growth rate of a tumor comprising determining the expression profile of a predictive marker or predictive marker set; and identifying that a proteasome inhibition therapeutic agent is or is not appropriate to reduce the growth rate of the myeloma cells based on the expression profile.

Additionally provided are methods for determining whether a proteasome inhibitor therapy can be used to reduce the growth of a tumor, comprising obtaining a sample of tumor cells, evaluating the expression of one or more individual markers or a marker set, both in tumor cells exposed to the agent and in tumor cells that have not been exposed to the proteasome inhibition therapy; and identifying that an agent is or is not appropriate to treat the tumor based on the evaluation.

The invention provides a method for determining whether a glucocorticoid regimen (e.g., glucocorticoidal steroid agent (e.g., dexamethasone) alone or in combination with another chemotherapeutic agent) can be used to reduce the growth rate of a tumor comprising determining the expression profile of a predictive marker or predictive marker set; and identifying that a glucocorticoid therapeutic agent is or is not appropriate to reduce the growth rate of the tumor based on the expression profile.

Additionally provided are methods for determining whether a glucocorticoid therapy can be used to reduce the growth of a tumor, comprising obtaining a sample of tumor cells, evaluating the expression of one or more individual markers or a marker set, both in tumor cells exposed to the agent and in tumor cells that have not been exposed to the glucocorticoid therapy; and identifying that an agent is or is not appropriate to treat the tumor based on the evaluation.

In such methods, a proteasome inhibition therapy and/or glucocorticoid therapy regimen is determined appropriate to treat the tumor when the expression profile of the predictive marker or predictive marker set demonstrates increased responsiveness or decreased non-responsiveness according to the expression profile of the predictive markers in the presence of the agent.

The invention also provides a method for determining whether treatment with an proteasome inhibitor therapy should be initiated in in a patient selected from a multiple myeloma patient, a lymphoma patient, a leukemia patient, a lung cancer patient, a breast cancer patient, and an ovarian cancer patient, a prostate cancer patient, a colon cancer patient, a kidney cancer patient, and a liver cancer patient; comprising obtaining one or more samples, followed by determining the level of expression of one or more markers which correspond to markers identified in any of Table 1A, Table 1B, Table 2A, Table 2B, and Table 3 in the sample; and initiating proteasome inhibitor therapy when the expression profile of the predictive markers identified in any one of Table 1A, Table 1B, Table 2A, Table 2B, and Table 3 is indicative of a responsive patient to such treatment. Alternatively, the treatment is not initiated when the expression profile of the predictive markers identified in any one of Table 1A, Table 1B, Table 2A, Table 2B, and Table 3 is indicative of a non-responsive patient to treatment.

The invention also provides a method for determining whether treatment with proteasome inhibition therapy should be initiated in in a patient selected from a multiple myeloma patient, a lymphoma patient, a leukemia patient, a lung cancer patient, a breast cancer patient, and an ovarian cancer patient, a prostate cancer patient, a colon cancer patient, a kidney cancer patient, and a liver cancer patient; comprising obtaining one or more samples of tumor cells from a patient, followed by determining the expression profile in the sample of a predictive marker set comprising markers identified in Table 1A, Table 1B, Table 2A, Table 2B, and Table 3; and initiating the proteasome inhibitor treatment when the expression profile of the predictive markers identified in Table 1A, Table 1B, Table 2A, Table 2B, and Table 3 is indicative of a responsive patient. Alternatively, the treatment is not initiated when the expression profile of the predictive markers identified in Table 1A, Table 1B, Table 2A, Table 2B, and/or Table 3 is indicative of a non-responsive patient.

The invention also provides a method for determining whether treatment with an glucocorticoid therapy should be initiated in in a patient selected from a multiple myeloma patient, a lymphoma patient, a leukemia patient, a lung cancer patient, a breast cancer patient, and an ovarian cancer patient, a prostate cancer patient, a colon cancer patient, a kidney cancer patient, and a liver cancer patient; comprising obtaining one or more samples, followed by determining the level of expression of one or more markers which correspond to markers identified in any of Table 1A, Table 1B, Table 2A, Table 2B, and Table 3 in the sample; and initiating glucocorticoid therapy when the expression profile of the predictive markers identified in any one of Table 1A, Table 1B, Table 2A, Table 2B, and Table 3 is indicative of a responsive patient to such treatment. Alternatively, the treatment is not initiated when the expression profile of the predictive markers identified in any one of Table 1A, Table 1B, Table 2A, Table 2B, and Table 3 is indicative of a non-responsive patient to treatment.

The invention also provides a method for determining whether treatment with glucocorticoid therapy should be initiated in in a patient selected from a multiple myeloma patient, a lymphoma patient, a leukemia patient, a lung cancer patient, a breast cancer patient, and an ovarian cancer patient, a prostate cancer patient, a colon cancer patient, a kidney cancer patient, and a liver cancer patient; comprising obtaining one or more samples of tumor cells from a patient, followed by determining the expression profile in the sample of a predictive marker set comprising markers identified in Table 1A, Table 1B, Table 2A, Table 2B, and Table 3; and initiating the glucocorticoid treatment when the expression profile of the predictive markers identified in Table 1A, Table 1B, Table 2A, Table 2B, and Table 3 is indicative of a responsive patient. Alternatively, the treatment is not initiated when the expression profile of the predictive markers identified in Table 1A, Table 1B, Table 2A, Table 2B, and/or Table 3 is indicative of a non-responsive patient.

Monitoring the Effectiveness of an Anti-Cancer Agent

As discussed above, the identified responsive and non-predictive markers can be used as pharmacodynamic markers to assess whether the tumor has become refractory to an ongoing treatment (e.g., a proteasome inhibition therapy and/or glucocorticoid therapy). When the cancer is not responding to a treatment the expression profile of the tumor cells will change: the level or relative expression of one or more of the predictive markers (e.g., those predictive markers identified in Table 1A, Table 1B, Table 2A, Table 2B, Table 3) such that the expression profile represents a non-responsive patient.

In one such use, the invention provides methods for determining whether a cancer therapy comprising proteasome inhibition therapy and/or glucocorticoid therapy should be continued in a cancer patient, comprising determining the expression of at least one predictive marker or a marker set, wherein the markers are selected from those set forth in any of Table 1A, Table 1B, Table 2A, Table 2B, or Table 3, in a tumor sample of a patient exposed to a proteasome inhibition therapy and/or glucocorticoid therapy; and continuing treatment when the expression profile of the marker or marker set demonstrates responsiveness to the agent being used.

In another such use, the invention provides methods for determining whether a proteasome inhibition therapy and/or glucocorticoid therapy should be discontinued in a cancer patient, comprising determining the expression of at least one predictive marker or a predictive marker set, wherein the markers are selected from those set forth in any of Table 1A, Table 1B, Table 2A, Table 2B, or Table 3 in a tumor sample of a patient exposed to a proteasome inhibition therapy and/or glucocorticoid therapy; and discontinuing or altering treatment when the expression profile of the markers identified in any one of Table 1A, Table 1B, Table 2A, Table 2B, or Table 3 demonstrates non-responsiveness to the agent being used.

As used herein, a patient refers to any subject undergoing proteasome inhibition therapy and/or glucocorticoid therapy for cancer treatment. The subject may be a human patient undergoing proteasome inhibition (e.g., bortezomib or other related agent) and/or glucocorticoid (e.g., dexamethasone) therapy using a sole therapeutic agent. The subject may be a human patient undergoing proteasome inhibition (e.g., bortezomib or other related agent) and/or glucocorticoid (e.g., dexamethasone) therapy using a therapeutic agent in conjunction with another agent (e.g., a chemotherapy treatment). The present invention also includes comparing two or more samples obtained from a patient undergoing anti-cancer treatment including proteasome inhibition therapy and/or glucocorticoid therapy. In general, it is conceivable to obtain a first sample from the patient prior to beginning therapy and one or more samples during treatment. In such a use, a baseline of expression prior to therapy is determined, then changes in the baseline state of expression is monitored during the course of therapy. Alternatively, two or more successive samples obtained during treatment can be used without the need of a pre-treatment baseline sample. In such a use, the first sample obtained from the subject is used as a baseline for determining whether the expression of a particular marker or marker set is increasing or decreasing.

In general, when monitoring the effectiveness of a therapeutic treatment, two or more samples from a patient are examined. In another aspect, three or more successively obtained samples are used, including at least one pretreatment sample.

The invention provides methods for determining whether treatment with a proteasome inhibitor therapy regimen should be continued in a patient selected from a multiple myeloma patient, a lymphoma patient, a leukemia patient, a lung cancer patient, a breast cancer patient, and an ovarian cancer patient, a prostate cancer patient, a colon cancer patient, a kidney cancer patient, and a liver cancer patient; comprising obtaining two or more samples of tumor cells from a patient at different times during the course of a proteasome inhibition therapy regimen, followed by evaluating the expression of one or more markers which correspond to markers identified in any of Table 1A, Table 1B, Table 2A, Table 2B, and Table 3 in the two or more samples; and continuing the treatment when the expression profile of the predictive markers identified in any one of Table 1A, Table 1B, Table 2A, Table 2B, and Table 3 is indicative of a responsive patient during the course of the treatment. In such methods, a proteasome inhibition therapy and regimen is determined appropriate to treat the patient when the expression profile of the predictive marker or predictive marker set demonstrates increased responsiveness or decreased non-responsiveness according to the expression profile of the predictive markers in the presence of the agent.

Additionally provided are methods for determining whether treatment with a proteasome inhibitor therapy regimen should be continued in in a patient selected from a multiple myeloma patient, a lymphoma patient, a leukemia patient, a lung cancer patient, a breast cancer patient, and an ovarian cancer patient, a prostate cancer patient, a colon cancer patient, a kidney cancer patient, and a liver cancer patient; comprising obtaining two or more samples of tumor cells from a patient at different times during the course of anti-cancer therapy treatment, followed by evaluating the expression of a predictive marker set comprising markers identified in any of Table 1A, Table 1B, Table 2A, Table 2B, and Table 3 in the two or more samples; and continuing the treatment when the expression profile of the predictive marker set indicates increased responsiveness or decreased non-responsiveness according to the expression during the course of treatment. Alternatively, the treatment is discontinued when the expression profile of the marker set demonstrates decreased responsiveness and/or increased non-responsiveness during the course of treatment.

The invention provides methods for determining whether treatment with a glucocorticoid therapy regimen should be continued in a patient selected from a multiple myeloma patient, a lymphoma patient, a leukemia patient, a lung cancer patient, a breast cancer patient, and an ovarian cancer patient, a prostate cancer patient, a colon cancer patient, a kidney cancer patient, and a liver cancer patient; comprising obtaining two or more samples of tumor cells from a patient at different times during the course of a glucocorticoid therapy regimen, followed by evaluating the expression of one or more markers which correspond to markers identified in any of Table 1A, Table 1B, Table 2A, Table 2B, and Table 3 in the two or more samples; and continuing the treatment when the expression profile of the predictive markers identified in any one of Table 1A, Table 1B, Table 2A, Table 2B, and Table 3 is indicative of a responsive patient during the course of treatment. In such methods, a glucocorticoid therapy regimen is determined appropriate to treat the patient when the expression profile of the predictive marker or predictive marker set demonstrates increased responsiveness or decreased non-responsiveness according to the expression profile of the predictive markers in the presence of the agent.

Additionally provided are methods for determining whether treatment with a glucocorticoid therapy regimen should be continued in in a patient selected from a multiple myeloma patient, a lymphoma patient, a leukemia patient, a lung cancer patient, a breast cancer patient, and an ovarian cancer patient, a prostate cancer patient, a colon cancer patient, a kidney cancer patient, and a liver cancer patient; comprising obtaining two or more samples of tumor cells from a patient at different times during the course of a glucocorticoid therapy regimen, followed by evaluating the expression of a predictive marker set comprising markers identified in any of Table 1A, Table 1B, Table 2A, Table 2B, and Table 3 in the two or more samples; and continuing the treatment when the expression profile of the predictive marker set indicates increased responsiveness or decreased non-responsiveness according to the expression during the course of treatment. Alternatively, the treatment is discontinued when the expression profile of the marker set demonstrates decreased responsiveness and/or increased non-responsiveness during the course of treatment.

The invention certain aspects of the invention relate to methods of treatment and/or diagnosis of a patient with cancer utilizing samples. The source of the cancer cells used in the present methods will be based on how the method of the present invention is being used. For example, if the method is being used to determine whether a patient's cancer can be treated with an agent, or a combination of agents, then the preferred source of sample will be cancer cells obtained from a tumor from the patient, e.g., a tumor biopsy (including a solid or a liquid tumor), a blood sample, a plasma sample, a urine sample, a saliva sample, a lymph sample or other sample can be used. A sample obtained from a tumor can be enriched for tumor cells to increase the specificity of the analysis. A variety of methods known in the art can be used to enrich for tumor cells, including differential centrifugation, fluorescence cell sorting analysis (FACS), isolating cells based on growth independent of substrate attachment, binding to a selection agent, e.g. to an antibody to a tumor marker and furthermore attaching the antibody and thus the bound tumor cell to a solid support, etc. Alternatively, a cancer cell line similar to the type of cancer being treated can be assayed. For example, if multiple myeloma is being treated, then a myeloma cell line can be used. If the method is being used to predict or monitor the effectiveness of a therapeutic protocol, then a tissue or blood sample from a patient being treated is a preferred source. If the method is being used to determine the activity of an agent, the efficacy of an agent, or identify new therapeutic agents or combinations, any cancer cells, e.g., cells of a cancer cell line, cells isolated from a tumor of an animal model, can be used.

A skilled artisan can readily select and obtain the appropriate cancer cells that are used in the present method. For cancer cell lines, sources such as The National Cancer Institute, for the NCI-60 cells, are preferred. For cancer cells obtained from a patient, standard biopsy methods, such as a needle biopsy, can be employed.

Myeloma samples were used to identify the markers of the present invention. Further, the expression level of markers can be evaluated in other tissue types including disorders of related hematological cell types, including, e.g., Waldenstroms macroglobulinemia, Myelodysplastic syndrome and other hematological cancers including lymphomas, leukemias, as well as tumors of various solid tissues. It will thus be appreciated that cells from other hematologic malignancies including, e.g., B-cell Lymphomas, Non-Hodgkins Lymphoma, Waldenstrom's syndrome, or other leukemias will be useful in the methods of the present invention. Still further, the predictive markers predicting disease aggressiveness as well as responsiveness and non-responsiveness to proteasome inhibition therapeutic agents in solid tumors (e.g., lung, breast, prostate, ovary, colon, kidney, and liver), can also be useful in the methods of the present invention.

Preferably, the samples used will be from similar tumors or from non-cancerous cells of the same tissue origin as the tumor in question. The choice of the cell source is dependent on the use of the relative expression level data. For example, using tumors of similar types for obtaining a mean expression score allows for the identification of extreme cases of responsive or non-responsive-ness. Using expression found in normal tissues as a mean expression score aids in validating whether the responsive/non-predictive marker or marker set assayed is tumor specific (versus normal cells). Such a later use is particularly important in identifying whether a responsive or non-predictive marker or marker set can serve as a target marker or marker set. In addition, as more data is accumulated, the mean expression value can be revised, providing improved relative expression values based on accumulated data.

Detection Assays

Various methods are available to examine the expression of the markers, including gene array/chip technology, RT-PCR, in-situ hybridization, immunohistochemistry, immunoblotting, FISH (flouresence in-situ hybridization), FACS analyses, northern blot, southern blot or cytogenetic analyses. A skilled artisan can select from these or other appropriate and available methods based on the nature of the marker(s), tissue sample and disease in question. Different methods or combinations of methods could be appropriate in different cases or, for instance in different solid or hematological tumor types.

In certain aspects of the invention, the expression of predictive marker or markers identified in Table 1A, Table 1B, Table 2A, Table 2B, and Table 3 is detected by measuring mRNA which corresponds to the predictive marker or marker set. In yet another aspects of the invention, the expression of markers which correspond to markers or marker sets identified in Table 1A, Table 1B, Table 2A, Table 2B, and Table 3, is detected by measuring protein which corresponds to the marker or marker set.

An exemplary method for detecting the presence or absence of a nucleic acid or polypeptide corresponding to a marker of the invention in a biological sample involves obtaining a biological sample (e.g. a tumor sample) from a test subject and contacting the biological sample with a compound or an agent capable of detecting the polypeptide or nucleic acid (e.g., mRNA, genomic DNA, or cDNA). The detection methods of the invention can thus be used to detect mRNA, protein, cDNA, or genomic DNA, for example, in a biological sample in vitro as well as in vivo. For example, in vitro techniques for detection of mRNA include Northern hybridizations in situ hybridizations, and TaqMan assays (Applied Biosystems) under GLP approved laboratory conditions. In vitro techniques for detection of a polypeptide corresponding to a marker of the invention include enzyme linked immunosorbent assays (ELISAs), Western blots, immunoprecipitations and immunofluorescence. In vitro techniques for detection of genomic DNA include Southern hybridizations. Furthermore, in vivo techniques for detection of a polypeptide corresponding to a marker of the invention include introducing into a subject a labeled antibody directed against the polypeptide. For example, the antibody can be labeled with a radioactive marker whose presence and location in a subject can be detected by standard imaging techniques.

A general principle of such diagnostic and prognostic assays involves preparing a sample or reaction mixture that may contain a marker, and a probe, under appropriate conditions and for a time sufficient to allow the marker and probe to interact and bind, thus forming a complex that can be removed and/or detected in the reaction mixture. These assays can be conducted in a variety of ways.

For example, one method to conduct such an assay would involve anchoring the marker or probe onto a solid phase support, also referred to as a substrate, and detecting target marker/probe complexes anchored on the solid phase at the end of the reaction. In one example of such a method, a sample from a subject, which is to be assayed for presence and/or concentration of marker, can be anchored onto a carrier or solid phase support. In another example, the reverse situation is possible, in which the probe can be anchored to a solid phase and a sample from a subject can be allowed to react as an unanchored component of the assay. One example of such an example includes use of an array or chip which contains a predictive marker or marker set anchored for expression analysis of the sample.

There are many established methods for anchoring assay components to a solid phase. These include, without limitation, marker or probe molecules which are immobilized through conjugation of biotin and streptavidin. Such biotinylated assay components can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain aspects, the surfaces with immobilized assay components can be prepared in advance and stored. Other suitable carriers or solid phase supports for such assays include any material capable of binding the class of molecule to which the marker or probe belongs. Well-known supports or carriers include, but are not limited to, glass, polystyrene, nylon, polypropylene, nylon, polyethylene, dextran, amylases, natural and modified celluloses, polyacrylamides, gabbros, and magnetite.

In order to conduct assays with the above mentioned approaches, the non-immobilized component is added to the solid phase upon which the second component is anchored. After the reaction is complete, uncomplexed components may be removed (e.g., by washing) under conditions such that any complexes formed will remain immobilized upon the solid phase. The detection of marker/probe complexes anchored to the solid phase can be accomplished in a number of methods outlined herein. In one example, when the probe is the unanchored assay component, can be labeled for the purpose of detection and readout of the assay, either directly or indirectly, with detectable labels discussed herein and which are well-known to one skilled in the art.

It is also possible to directly detect marker/probe complex formation without further manipulation or labeling of either component (marker or probe), for example by utilizing the technique of fluorescence energy transfer (see, for example, Lakowicz et al., U.S. Pat. No. 5,631,169; Stavrianopoulos, et al., U.S. Pat. No. 4,868,103). A fluorophore label on the first, 'donor' molecule is selected such that, upon excitation with incident light of appropriate wavelength, its emitted fluorescent energy will be absorbed by a fluorescent label on a second 'acceptor' molecule, which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another example, determination of the ability of a probe to recognize a marker can be accomplished without labeling either assay component (probe or marker) by utilizing a technology such as real-time Biomolecular Interaction Analysis (BIA) (see, e.g., Sjolander, S, and Urbaniczky, C., 1991, *Anal. Chem.* 63:2338-2345 and Szabo et al., 1995, *Curr. Opin. Struct. Biol.* 5:699-705). As used herein, "BIA" or "surface plasmon resonance" is a technology for studying biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Alternatively, in another example, analogous diagnostic and prognostic assays can be conducted with marker and probe as solutes in a liquid phase. In such an assay, the complexed marker and probe are separated from uncomplexed components by any of a number of standard techniques, including but not limited to: differential centrifugation, chromatography, electrophoresis and immunoprecipitation. In differential centrifugation, marker/probe complexes may be separated from uncomplexed assay components through a series of centrifugal steps, due to the different sedimentation equilibria of complexes based on their different sizes and densities (see, for example, Rivas, G., and Minton, A. P., 1993, *Trends Biochem Sci.* 18(8):284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the marker/probe complex as compared to the uncomplexed components may be exploited to differentiate the complex from uncomplexed components, for example through the utilization of ion-exchange chromatography resins. Such resins and chromatographic techniques are well known to one skilled in the art (see, e.g., Heegaard, N. H., 1998, *J. Mol. Recognit. Winter* 11(1-6):141-8; Hage, D. S., and Tweed, S. A. *J Chromatogr B Biomed Sci Appl* 1997 Oct. 10; 699(1-2):499-525). Gel electrophoresis may also be employed to separate complexed assay components from unbound components (see, e.g., Ausubel et al., ed., *Current Protocols in Molecular Biology*, John Wiley & Sons, New York, 1987-1999). In this technique, protein or nucleic acid complexes are separated based on size or charge, for example. In order to maintain the binding interaction during the electrophoretic process, non-denaturing gel matrix materials and conditions in the absence of reducing agent are typically preferred. Appropriate conditions to the particular assay and components thereof will be well known to one skilled in the art.

The level of mRNA corresponding to the marker can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from tumor cells (see, e.g., Ausubel et al., ed., *Current Protocols in Molecular Biology*, John Wiley & Sons, New York 1987-1999). Additionally, large numbers of tissue samples can readily be processed using techniques well known to those of skill in the art, such as, for example, the single-step RNA isolation process of Chomczynski (1989, U.S. Pat. No. 4,843,155).

One diagnostic method for the detection of mRNA levels involves contacting the isolated mRNA with a nucleic acid molecule (probe) that can hybridize to the mRNA encoded by the gene being detected. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to a mRNA or genomic DNA encoding a marker of the present invention. Other suitable probes for use in the diagnostic assays of the invention are described herein. Hybridization of an mRNA with the probe indicates that the marker in question is being expressed.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in an Affymetrix gene chip array. A skilled artisan can readily adapt known mRNA detection methods for use in detecting the level of mRNA encoded by the markers of the present invention.

An alternative method for determining the level of mRNA corresponding to a marker of the present invention in a sample involves the process of nucleic acid amplification, e.g., by rtPCR (the experimental description set forth in Mullis, 1987, U.S. Pat. No. 4,683,202), ligase chain reaction (Barany, 1991, *Proc. Natl. Acad. Sci. USA,* 88:189-193), self sustained sequence replication (Guatelli et al., 1990, *Proc. Natl. Acad. Sci. USA* 87:1874-1878), transcriptional amplification system (Kwoh et al., 1989, *Proc. Natl. Acad. Sci. USA* 86:1173-1177), Q-Beta Replicase (Lizardi et al., 1988, *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, mRNA does not need to be isolated from the cancer cells prior to detection. In such methods, a cell or tissue sample is prepared/processed using known histological methods. The sample is then immobilized on a support, typically a glass slide, and then contacted with a probe that can hybridize to mRNA that encodes the marker.

As an alternative to making determinations based on the absolute expression level of the marker, determinations may be based on the normalized expression level of the marker. Expression levels are normalized by correcting the absolute expression level of a marker by comparing its expression to the expression of a reference gene that is not a marker, e.g., a housekeeping gene that is constitutively expressed. Suitable genes for normalization include housekeeping genes such as the actin gene, or epithelial cell-specific genes. This normalization allows the comparison of the expression level in one sample, e.g., a patient sample, to another sample, e.g., a non-cancer sample, or between samples from different sources.

Alternatively, the expression level can be provided as a relative expression level. To determine a relative expression level of a marker, the level of expression of the marker is determined for 10 or more samples of normal versus cancer cell isolates, preferably 50 or more samples, prior to the determination of the expression level for the sample in question. The mean expression level of each of the markers and marker sets assayed in the larger number of samples is determined and this is used as a baseline expression level for the marker. The expression level of the marker determined for the test sample (absolute level of expression) is then divided by the mean expression value obtained for that marker. This provides a relative expression level.

In another aspect of the present invention, a polypeptide corresponding to a marker is detected. A preferred agent for detecting a polypeptide of the invention is an antibody capable of binding to a polypeptide corresponding to a marker of the invention, preferably an antibody with a detectable label. Antibodies can be polyclonal, or more preferably, monoclonal. An intact antibody, or a fragment thereof (e.g., Fab or $F(ab')_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

A variety of formats can be employed to determine whether a sample contains a protein that binds to a given antibody. Examples of such formats include, but are not limited to, enzyme immunoassay (EIA), radioimmunoassay (RIA), Western blot analysis and enzyme linked immunoabsorbant assay (ELISA). A skilled artisan can readily adapt known protein/antibody detection methods for use in determining whether a sample comprising cancer cells express a marker of the present invention.

In one format, antibodies, or antibody fragments, can be used in methods such as Western blots or immunofluorescence techniques to detect the expressed proteins. In such uses, it is generally preferable to immobilize either the antibody or proteins on a solid support. Suitable solid phase supports or carriers include any support capable of binding an antigen or an antibody. Well-known supports or carriers include glass, polystyrene, polypropylene, polyethylene, dextran, nylon, amylases, natural and modified celluloses, polyacrylamides, gabbros, and magnetite.

One skilled in the art will know many other suitable carriers for binding antibody or antigen, and will be able to adapt such support for use with the present invention. For example, protein isolated from tumor cells can be run on a polyacrylamide gel electrophoresis and immobilized onto a solid phase support such as nitrocellulose. The support can then be washed with suitable buffers followed by treatment with the detectably labeled antibody. The solid phase support can then be washed with the buffer a second time to remove unbound antibody. The amount of bound label on the solid support can then be detected by conventional means.

Another method for determining the level of a polypeptide corresponding to a marker is mass spectrometry. For example, intact proteins or peptides, e.g., tryptic peptides can be analyzed from a sample, e.g., a tumor sample, blood, plasma, urine, etc, containing one or more polypeptide markers. The method can further include treating the sample to lower the amounts of abundant proteins, e.g. serum albumin, to increase the sensitivity of the method. For example, liquid chromatography can be used to fractionate the sample so portions of the sample can be analyzed separately by mass spectrometry. The steps can be performed in separate systems or in a combined liquid chromatography/mass spectrometry system (LC/MS, see for example, Liao, et al. *Arthritis Rheum.* 50:3792-3803 (2004)). The mass spectrometry system also can be in tandem (MS/MS) mode. The charge state distribution of the protein or peptide mixture can be acquired over one or multiple scans and analyzed by statistical methods, e.g.

using the retention time and mass-to-charge ratio (m/z) in the LC/MS system, to identify proteins expressed at statistically significant levels differentially in samples from patients responsive or non-responsive to proteasome inhibition and/or glucocorticoid therapy. Examples of mass spectrometers which can be used are an ion trap system (ThermoFinnigan, San Jose, Calif.) or a quadrupole time-of-flight mass spectrometer (Applied Biosystems, Foster City, Calif.). The method can further include the step of peptide mass fingerprinting, e.g. in a matrix-assisted laser desorption ionization with time-of-flight (MALDI-TOF) mass spectrometry method. The method can further include the step of sequencing one or more of the tryptic peptides. Results of this method can be used to identify proteins from primary sequence databases, e.g. maintained by the National Center for Biotechnology Information, Bethesda, Md., or the Swiss Institute for Bioinformatics, Geneva, Switzerland, and based on mass spectrometry tryptic peptide m/z base peaks.

Electronic Apparatus Readable Arrays

Electronic apparatus, including readable arrays comprising at least one predictive marker of the present invention is also contemplated for use in conjunction with the methods of the invention. As used herein, "electronic apparatus readable media" refers to any suitable medium for storing, holding or containing data or information that can be read and accessed directly by an electronic apparatus. As used herein, the term "electronic apparatus" is intended to include any suitable computing or processing apparatus or other device configured or adapted for storing data or information. Examples of electronic apparatus suitable for use with the present invention and monitoring of the recorded information include stand-alone computing apparatus; networks, including a local area network (LAN), a wide area network (WAN) Internet, Intranet, and Extranet; electronic appliances such as a personal digital assistants (PDAs), cellular phone, pager and the like; and local and distributed processing systems. As used herein, "recorded" refers to a process for storing or encoding information on the electronic apparatus readable medium. Those skilled in the art can readily adopt any of the presently known methods for recording information on known media to generate manufactures comprising the markers of the present invention.

For example, microarray systems are well known and used in the art for assessment of samples, whether by assessment gene expression (e.g., RNA detection, protein detection), or metabolite production, for example. Microarrays for use according to the invention include one or more probes of predictive marker(s) of the invention characteristic of response and/or non-response to a therapeutic regimen as described herein. In one embodiment, the microarray comprises one or more probes corresponding to one or more of markers selected from the group consisting of markers which demonstrate increased expression in responsive patients, and genes which demonstrate non-response in patients. A number of different microarray configurations and methods for their production are known to those of skill in the art and are disclosed, for example, in U.S. Pat. Nos. 5,242,974; 5,384,261; 5,405,783; 5,412,087; 5,424,186; 5,429,807; 5,436,327; 5,445,934; 5,556,752; 5,405,783; 5,412,087; 5,424,186; 5,429,807; 5,436,327; 5,472,672; 5,527,681; 5,529,756; 5,545,531; 5,554,501; 5,561,071; 5,571,639; 5,593,839; 5,624,711; 5,700,637; 5,744,305; 5,770,456; 5,770,722; 5,837,832; 5,856,101; 5,874,219; 5,885,837; 5,919,523; 5,981,185; 6,022,963; 6,077,674; 6,156,501; 6,261,776; 6,346,413; 6,440,677; 6,451,536; 6,576,424; 6,610,482; 5,143,854; 5,288,644; 5,324,633; 5,432,049; 5,470,710; 5,492,806; 5,503,980; 5,510,270; 5,525,464; 5,547,839; 5,580,732; 5,661,028; 5,848,659; and 5,874,219; Shena, et al., Tibtech 16:301, 1998; Duggan, et al., Nat. Genet. 21:10, 1999; Bowtell, et al., Nat. Genet. 21:25, 1999; Lipshutz, et al., 21 Nature Genet. 20-24, 1999; Blanchard, et al., 11 Biosensors and Bioelectronics, 687-90, 1996; Maskos, et al., 21 Nucleic Acids Res. 4663-69, 1993; Hughes, et al., Nat. Biotechol. 19:342, 2001; each of which are herein incorporated by reference. A tissue microarray can be used for protein identification (see Hans et al *Blood* 103:275-282 (2004)). A phage-epitope microarray can be used to identify one or more proteins in a sample based on whether the protein or proteins induce auto-antibodies in the patient (Bradford et al. *Urol. Oncol.* 24:237-242 (2006)).

A microarray thus comprises one or more probes corresponding to one or more predictive markers identified in Table 1A, Table 1B, Table 2A, Table 2B, and Table 3. The microarray may comprise probes corresponding to, for example, at least 10, at least 20, at least 50, at least 100, or at least 1000 predictive markers of the invention characteristic of patient response to proteasome inhibition therapy and/or glucocorticoid therapy. The microarray may comprise probes corresponding to one or more predictive markers as set forth herein. Still further, the microarray may comprise complete marker sets as set forth herein and which may be selected and compiled according to the methods set forth herein. The microarray can be used to assay expression of one or more predictive markers or predictive marker sets in the array. In one example, the array can be used to assay more than one predictive marker or marker set expression in a sample to ascertain an expression profile of markers in the array. In this manner, up to about 44,000 markers can be simultaneously assayed for expression. This allows a profile to be developed showing a battery of markers specifically expressed in one or more samples. Still further, this allows a profile to be developed to assess responsiveness to one or more therapies (e.g., glucocorticoid therapy or proteasome inhibition therapy).

The array is also useful for ascertaining differential expression patterns of one or more markers in normal and abnormal (e.g., sample, e.g., tumor) cells. This provides a battery of predictive markers that could serve as a tool for ease of identification of responsive and non-responsive patients. Further, the array is useful for ascertaining expression of reference markers for reference expression levels. In another example, the array can be used to monitor the time course of expression of one or more predictive markers in the array.

In addition to such qualitative determination, the invention allows the quantitation of marker expression. Thus, predictive markers can be grouped on the basis of marker sets or responsive and non-responsive indications by the level of expression in the sample. This is useful, for example, in ascertaining the responsive or non-responsive indication of the sample by virtue of scoring the expression levels according to the methods provided herein.

The array is also useful for ascertaining the effect of the expression of a marker on the expression of other predictive markers in the same cell or in different cells. This provides, for example, a selection of alternate molecular targets for therapeutic intervention if the proteasome inhibition regimen and/or glucocorticoid therapy regimen is non-responsive.

Reagents and Kits

The invention also encompasses kits for detecting the presence of a polypeptide or nucleic acid corresponding to a marker of the invention in a sample (e.g. a tumor sample). Such kits can be used to determine if a subject is predisposed to response or non-response to an anti-cancer therapy regimen. In another aspect, the invention provides a test kit for monitoring the efficacy of a compound or therapeutic in a sample. For example, the kit may comprise a labeled probe capable of detecting a polypeptide or an mRNA encoding a polypeptide corresponding to a marker of the invention in a biological sample and means for determining the amount of the polypeptide or mRNA in the sample (e.g., an antibody which binds the polypeptide or an oligonucleotide probe which binds to DNA or mRNA encoding the polypeptide). Kits may further include instructions for use of the provided kits and interpreting the results obtained using the kit; additional reagents for preparation of probes for use in the methods provided; and detectable label, alone or conjugated to the provided probe(s).

For antibody-based kits, the kit can comprise, for example: (1) a first antibody (e.g., attached to a solid support) which binds to a polypeptide corresponding to a marker of the invention; and, optionally, (2) a second, different antibody which binds to either the polypeptide or the first antibody and is conjugated to a detectable label.

For oligonucleotide-based kits, the kit can comprise, for example: (1) an oligonucleotide, e.g., a detectably labeled oligonucleotide, which hybridizes to a nucleic acid sequence encoding a polypeptide corresponding to a marker of the invention; (2) a pair of primers useful for amplifying a nucleic acid molecule corresponding to a marker of the invention; or (3) a marker set comprising oligonucleotides which hybridize to at least two nucleic acid sequences encoding polypeptide predictive markers of the invention. The kit can also comprise, e.g., a buffering agent, a preservative, or a protein stabilizing agent. The kit can further comprise components necessary for detecting the detectable label (e.g., an enzyme or a substrate). For marker sets, the kit can comprise a marker set array or chip for use in detecting the predictive markers. The kit can also contain a reference sample or a series of reference samples which can be assayed and compared to the test sample. Each component of the kit can be enclosed within an individual container and all of the various containers can be within a single package, along with instructions for interpreting the results of the assays performed using the kit.

Therapeutic Agents

The markers and marker sets of the present invention are predictive of patients who are responsive or non-responsive (sensitive or resistant) proteasome inhibition therapy and/or glucocorticoid therapy regimens, generally.

Therapeutic agents for use in the methods of the invention include a class of therapeutic agents known as proteosome inhibitors. "Proteasome inhibitor" shall mean any substance which directly or indirectly inhibits the 20S or 26S proteasome or the activity thereof. Preferably, such inhibition is specific, i.e., the proteasome inhibitor inhibits proteasome activity at a concentration that is lower than the concentration of the inhibitor concentration required to produce another, unrelated biological effect. Preferably, the concentration of the proteasome inhibitor required for proteasome inhibition is at least 2-fold lower, more preferably at least 5-fold lower, even more preferably at least 10-fold lower, and most preferably at least 20-fold lower than the concentration required to produce an unrelated biological effect. Proteasome inhibitor compounds of this invention are those compounds which are useful for inhibiting tumor growth, (e.g., multiple myeloma tumor growth, other hematological or solid tumors as described in further detail herein) in patients. Proteasome inhibitor also is intended to include pharmaceutically acceptable salts of the compounds.

Proteasome inhibition therapy, generally comprises at least an agent which inhibits proteasome activity in a cell, and can comprise additional therapeutic agents. In certain applications of the invention, the agent used in methods of the invention is a proteasome inhibitor. One example of a proteosome inhibitor has been approved for treatment of multiple myeloma patients who have received at least two prior therapies and have demonstrated disease progression on the last therapy and is presently being tested in clinical trials for additional indications is bortezomib. Proteasome inhibition therapy regimens can also include additional therapeutic agents such as chemotherapeutic agents. Some examples of traditional chemotherapeutic agents are set forth in Table A. Alternatively or in combination with these chemotherapeutic agents, newer classes of chemotherapeutic agents can also be used in proteasome inhibition therapy.

The examples described herein entail use of the proteasome inhibitor N-pyrazinecarbonyl-L-phenylalanine-L-leucineboronic acid, bortezomib ((VELCADE™); formerly known as MLN341 or PS-341). The language "proteasome inhibitor" is intended to include bortezomib, compounds which are structurally similar to bortezomib and/or analogs of bortezomib. "Proteasome inhibitor" can also include "mimics". "Mimics" is intended to include compounds which may not be structurally similar to bortezomib but mimic the therapeutic activity of bortezomib or structurally similar compounds in vivo.

Proteasome inhibitors for use in the practice of the invention include additional peptide boronic acids such as those disclosed in Adams et al., U.S. Pat. No. 5,780,454 (1998), U.S. Pat. No. 6,066,730 (2000), U.S. Pat. No. 6,083,903 (2000), U.S. Pat. No. 6,548,668 (2003), and Siman et al. WO 91/13904, each of which is hereby incorporated by reference in its entirety, including all compounds and formulae disclosed therein. Preferably, a boronic acid compound for use in the present invention is selected from the group consisting of: N-(4-morpholine)carbonyl-beta.-(1-naphthyl)-L-alanine-L-leucine boronic acid; N-(8-quinoline)sulfonyl-.beta.-(1-naphthyl)-L-alanine-L-alanine-L-leucine boronic acid; N-(2-pyrazine)carbonyl-L-phenylalanine-L-leucine boronic acid, and N-(4-morpholine)carbonyl-[O-(2-pyridylmethyl)]-L-tyrosine-L-leucine boronic acid.

Additionally, proteasome inhibitors include peptide aldehyde proteasome inhibitors such as those disclosed in Stein et al. U.S. Pat. No. 5,693,617 (1997), and International patent publications WO 95/24914 published Sep. 21, 1995 and Siman et al. WO 91/13904 published Sep. 19, 1991; Iqbal et al. J. Med. Chem. 38:2276-2277 (1995), as well as Bouget et al. Bioorg Med Chem 17:4881-4889 (2003) each of which is hereby incorporated by reference in its entirety, including all compounds and formulae disclosed therein.

Further, proteasome inhibitors include lactacystin and lactacycstin analogs which have been disclosed in Fentany et al, U.S. Pat. No. 5,756,764 (1998), and U.S. Pat. No. 6,147,223 (2000), Schreiber et al U.S. Pat. No. 6,645,999 (2003), and Fenteany et al. Proc. Natl. Acad. Sci. USA (1994) 91:3358, each of which is hereby incorporated by reference in its entirety, including all compounds and formulae disclosed therein.

Additionally, synthetic peptide vinyl sulfone proteasome inhibitors and epoxyketone proteasome inhibitors have been disclosed and are useful in the methods of the invention. See, e.g., Bogyo et al., Proc. Natl. Acad. Sci. 94:6629 (1997); Spaltenstein et al. Tetrahedron Lett. 37:1343 (1996); Meng L, Proc. Natl. Acad Sci 96: 10403 (1999); and Meng L H, Cancer Res 59: 2798 (1999), each of which is hereby incorporated by reference in its entirety.

Still further, naturally occurring compounds have been recently shown to have proteasome inhibition activity can be used in the present methods. For example, TMC-95A, a cyclic peptide, or Gliotoxin, both fungal metabolites or polyphenols compounds found in green tea have been identified as proteasome inhibitors. See, e.g., Koguchi Y, Antibiot (Tokyo) 53:105. (2000); Kroll M, Chem Biol 6:689 (1999); and Nam S, J. Biol Chem 276: 13322 (2001), each of which is hereby incorporated by reference in its entirety.

Additional therapeutic agents for use in the methods of the invention comprise a known class of therapeutic agents comprising glucocorticoid steroids. Glucocorticoid therapy, generally comprises at least one glucocorticoid agent (e.g., dexamethasone). In certain applications of the invention, the agent used in methods of the invention is a glucocorticoid agent. One example of a glucocorticoid utilized in the treatment of multiple myeloma patients as well as other cancer therapies is dexamethasone. Additional glucocorticoids utilized in treatment of hematological and combination therapy in solid tumors include hydrocortisone, predisolone, prednisone, and triamcinolone. Glucocorticoid therapy regimens can be used alone, or can be used in conjunction with additional chemotherapeutic agents. Chemotherapeutic agents are known in the art and described in further detail herein. Examples of chemotherapeutic agents are set forth in Table A. As with proteasome inhibition therapy, new classes of cancer therapies may be combined with glucocorticoid therapy regimens as they are developed. Finally, the methods of the invention include combination of proteasome inhibition therapy with glucocorticoid therapy, either alone, or in conjunction with further agents.

In one aspect, one or more of the markers listed in any one of Table 1A, Table 1B, Table 2A, Table 2B, and/or Table 3, can be used to identify candidate agents for use in a treatment regimen which will produce a response in a patient. For example, the method can identify an agent or a combination of agents useful as a proteasome inhibitor. In another example, the method can identify an agent or combination of glucocorticoids. In another example, the method can identify a set of patients likely to be non-responsive to current therapies, and therefore good candidates for inclusion in a clinical trial of a drug aimed at meeting the unmet need of non-responsive patients. For example, a marker or marker set associated with non-response to bortezomib can identify a patient or a test system comprising the capacity to express the marker or marker set. The method can identify a candidate agent which achieves a response in such a patient or test system. In the method, an assay composition comprising a cell, e.g. a tumor cell, capable of expressing a marker or a plurality of markers listed in any one of Table 1A, Table 1B, Table 2A, Table 2B, and/or Table 3 is contacted with the test agent, e.g. for an amount of time for the test agent to affect the level of marker, detecting the level of the marker and comparing the level to the level in a reference cell, e.g., a cell contacted with a known proteasome inhibitor (e.g., bortezomib) or glucocorticoid (e.g., dexamethasone) or a normal cell, and identifying the agent as a candidate proteasome inhibitor or glucocorticoid if the test agent produces an informative expression level of the marker or markers typical of a responsive patient. Conversely, the test agent may not be identified as a candidate agent if it is used in the method and produces an informative expression level typical of a non-responsive patient. The assay composition can comprise a tumor cell isolated from a patient with cancer, e.g. a hematological cancer (e.g., multiple myeloma, leukemias, lymphoma, etc) or cancer from a solid tumor (e.g., in lung, breast, prostate, ovary, colon, kidney or liver). Alternatively, the assay composition can comprise a tumor cell line. The composition comprising the cell can be an in vivo tumor model, e.g. an immunocompromised mouse or a rat with an ectopic, e.g. subcutaneous or ascites, tumor, e.g. a human tumor. The assay composition can be a human subject.

Further to the above, the language, proteasome inhibition therapy regimen and/or glucocorticoid therapy regimen can include additional agents in addition to proteasome inhibition agents, including chemotherapeutic agents. A "chemotherapeutic agent" is intended to include chemical reagents which inhibit the growth of proliferating cells or tissues wherein the growth of such cells or tissues is undesirable. Chemotherapeutic agents such as anti-metabolic agents, e.g., Ara AC, 5-FU and methotrexate, antimitotic agents, e.g., taxane, vinblastine and vincristine, alkylating agents, e.g., melphanlan, BCNU and nitrogen mustard, Topoisomerase II inhibitors, e.g., VW-26, topotecan and Bleomycin, strand-breaking agents, e.g., doxorubicin and DHAD, cross-linking agents, e.g., cisplatin and CBDCA, radiation and ultraviolet light. In a preferred embodiment, the agent is a proteasome inhibitor (e.g., bortezomib or other related compounds). are well known in the art (see e.g., Gilman A. G., et al., *The Pharmacological Basis of Therapeutics,* 8th Ed., Sec 12:1202-1263 (1990)), and are typically used to treat neoplastic diseases. The chemotherapeutic agents generally employed in chemotherapy treatments are listed below in Table A.

The agents tested in the present methods can be a single agent or a combination of agents. For example, the present methods can be used to determine whether a single chemotherapeutic agent, such as methotrexate, can be used to treat a cancer or whether a combination of two or more agents can be used in combination with a proteasome inhibitor (e.g., bortezomib) and/or a glucocorticoid agent (e.g., dexamethasone). Preferred combinations will include agents that have different mechanisms of action, e.g., the use of an anti-mitotic agent in combination with an alkylating agent and a proteasome inhibitor.

The agents disclosed herein may be administered by any route, including intradermally, subcutaneously, orally, intraarterially or intravenously. Preferably, administration will be by the intravenous route. Preferably parenteral administration may be provided in a bolus or by infusion.

The concentration of a disclosed compound in a pharmaceutically acceptable mixture will vary depending on several factors, including the dosage of the compound to be administered, the pharmacokinetic characteristics of the compound(s) employed, and the route of administration. The agent may be administered in a single dose or in repeat doses. Treatments may be administered daily or more frequently depending upon a number of factors, including the overall health of a patient, and the formulation and route of administration of the selected compound(s).

TABLE A

| Chemotherapeutic Agents | | |
|---|---|---|
| CLASS | TYPE OF AGENT | NONPROPRIETARY NAMES (OTHER NAMES) |
| Alkylating | Nitrogen Mustards | Mechlorethamine ($HN_2$)<br>Cyclophosphamide<br>Ifosfamide |

TABLE A-continued

| Chemotherapeutic Agents | | |
|---|---|---|
| CLASS | TYPE OF AGENT | NONPROPRIETARY NAMES (OTHER NAMES) |
| | | Melphalan (L-sarcolysin) |
| | | Chlorambucil |
| | Ethylenimines | Hexamethylmelamine |
| | And Methylmelamines | Thiotepa |
| | Alkyl Sulfonates | Busulfan |
| Alkylating | Nitrosoureas | Carmustine (BCNU) |
| | | Lomustine (CCNU) |
| | | Semustine (methyl-CCNU) |
| | | Streptozocin (streptozotocin) |
| Alkylating | Triazenes | Decarbazine (DTIC; dimethyltriazenoimidazolecarboxamide) |
| | Alkylator | cis-diamminedichloroplatinum II (CDDP) |
| Antimetabolites | Folic Acid Analogs | Methotrexate (amethopterin) |
| | Pyrimidine | Fluorouracil ('5-fluorouracil; 5-FU) |
| | Analogs | Floxuridine (fluorode-oxyuridine; FUdR) |
| | | Cytarabine (cytosine arabinoside) |
| | Purine Analogs and | Mercaptopuine (6-mercaptopurine; 6-MP) |
| | Related | Thioguanine (6-thioguanine; TG) |
| | Inhibitors | Pentostatin (2'-deoxycoformycin) |
| | Vinca Alkaloids | Vinblastin (VLB) |
| | | Vincristine |
| | Topoisomerase | Etoposide |
| | Inhibitors | Teniposide |
| | | Camptothecin |
| | | Topotecan |
| | | 9-amino-campotothecin CPT-11 |
| Natural | Antibiotics | Dactinomycin (actinomycin D) |
| Products | | Adriamycin |
| | | Daunorubicin (daunomycin; rubindomycin) |
| | | Doxorubicin |
| | | Bleomycin |
| | | Plicamycin (mithramycin) |
| | | Mitomycin (mitomycin C) |
| | | TAXOL |
| | | Taxotere |
| Natural | Enzymes | L-Asparaginase |
| Products | Biological Response | Interfon alfa |
| | Modifiers | Interleukin 2 |
| | Platinum Coordination | cis-diamminedichloroplatinum II (CDDP) |
| | Complexes | Carboplatin |
| | Anthracendione | Mitoxantrone |
| | Substituted Urea | Hydroxyurea |
| Miscellaneous | Methyl Hydraxzine | Procarbazine |
| Agents | Derivative | (N-methylhydrazine, (MIH) |
| | Adrenocortical | Mitotane (o,p'-DDD) |
| | Suppressant | Aminoglutethimide |
| Hormones and | Progestins | Hydroxyprogesterone caproate |
| Antagonists | | Medroxyprogesterone acetate |
| | | Megestrol acetate |
| | Estrogens | Diethylstilbestrol |
| | | Ethinyl estradiol |
| | Antiestrogen | Tamoxifen |
| | Androgens | Testosterone propionate |
| | | Fluoxymesterone |
| | Antiandrogen | Flutamide |
| | Gonadotropin-releasing | Leuprolide |
| | Hormone analog | |

Isolated Nucleic Acid Molecules, Vectors and Host Cells

One aspect of the invention pertains to isolated nucleic acid molecules that correspond to a predictive marker of the invention, including nucleic acids which encode a polypeptide corresponding to a predictive marker of the invention or a portion of such a polypeptide. Isolated nucleic acids of the invention also include nucleic acid molecules sufficient for use as hybridization probes to identify nucleic acid molecules that correspond to a predictive marker of the invention, including nucleic acids which encode a polypeptide corresponding to a predictive marker of the invention, and fragments of such nucleic acid molecules, e.g., those suitable for use as PCR primers for the amplification or mutation of nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

A nucleic acid molecule of the present invention, e.g., a nucleic acid encoding a protein corresponding to a marker listed in any one of Table 1A, Table 1B, Table 2A, Table 2B, and/or Table 3, can be isolated and manipulated (e.g., amplified, cloned, synthesized, etc.) using standard molecular biology techniques and the sequence information in the database records described herein. (e.g., described in Sambrook et al., ed., *Molecular Cloning: A Laboratory Manual, 2nd ed*., Cold Spring Harbor Laboratory Press, Cold Spring Harbor, N.Y., 1989).

Moreover, a nucleic acid molecule of the invention can comprise only a portion of a nucleic acid sequence, wherein the full length nucleic acid sequence comprises a predictive marker of the invention or which encodes a polypeptide corresponding to a marker of the invention. Such nucleic acids can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a nucleic acid of the invention.

Probes based on the sequence of a nucleic acid molecule of the invention can be used to detect transcripts or genomic sequences corresponding to one or more predictive markers of the invention. The probe comprises a label group attached thereto, e.g., a radioisotope, a fluorescent compound, an enzyme, or an enzyme co-factor. Such probes can be used as part of a diagnostic test kit for identifying cells or tissues which express the protein, such as by measuring levels of a nucleic acid molecule encoding the protein in a sample of cells from a subject, e.g., detecting mRNA levels or determining whether a gene encoding the protein has been mutated or deleted.

In addition to the nucleotide sequences described in the database records described herein, it will be appreciated by those skilled in the art that DNA sequence polymorphisms that lead to changes in the amino acid sequence can exist within a population (e.g., the human population). Such genetic polymorphisms can exist among individuals within a population due to naturally occurring allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

As used herein, the terms "gene" and "recombinant gene" refer to nucleic acid molecules comprising an open reading frame encoding a polypeptide corresponding to a marker of the invention, including, e.g., sequences which differ, due to degeneracy of the genetic code, from the nucleotide sequence of nucleic acids encoding a protein which corresponds to a marker of the invention, and thus encode the same protein.

As used herein, the phrase "allelic variant" refers to a nucleotide sequence which occurs at a given locus or to a polypeptide encoded by the nucleotide sequence. Such naturally occurring allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of naturally occurring allelic variation and that do not alter the functional activity are intended to be within the scope of the invention.

The present invention encompasses antisense nucleic acid molecules, i.e., molecules which are complementary to a sense nucleic acid of the invention, e.g., complementary to the coding strand of a double-stranded cDNA molecule corresponding to a marker of the invention or complementary to an mRNA sequence corresponding to a marker of the invention. Accordingly, an antisense nucleic acid of the invention can hydrogen bond to (i.e. anneal with) a sense nucleic acid of the invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a polypeptide of the invention. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The nucleic acid molecules of the invention can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids (see Hyrup et al., 1996, *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) *Proc. Natl. Acad. Sci. USA* 93:14670-675.

PNAs can be used in therapeutic and diagnostic applications. For example, PNAs can be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup, 1996, supra; Perry-O'Keefe et al., 1996, *Proc. Natl. Acad. Sci. USA* 93:14670-675).

In another aspect, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNASE H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup, 1996, supra). The synthesis of PNA-DNA chimeras can be performed as described in Hyrup (1996), supra, and Finn et al. (1996) *Nucleic Acids Res.* 24(17):3357-63. For example, a DNA chain can be synthesized on a solid support using standard phosphoramidite coupling chemistry and modified nucleoside analogs. Compounds such as 5'-(4-methoxytrityl) amino-5'-deoxy-thymidine phosphoramidite can be used as a link between the PNA and the 5' end of DNA (Mag et al., 1989, *Nucleic Acids Res.* 17:5973-88). PNA monomers are then coupled in a step-wise manner to produce a chimeric molecule with a 5' PNA segment and a 3' DNA segment (Finn et al., 1996, *Nucleic Acids Res.* 24(17):3357-63). Alternatively, chimeric molecules can be synthesized with a 5' DNA segment and a 3' PNA segment (Peterser et al., 1975, *Bioorganic Med. Chem. Lett.* 5:1119-11124).

The oligonucleotide can include other appended groups such as peptides (e.g., for targeting host cell receptors in vivo), or agents facilitating transport across the cell membrane (see, e.g., Letsinger et al., 1989, *Proc. Natl. Acad. Sci. USA* 86:6553-6556; Lemaitre et al., 1987, *Proc. Natl. Acad. Sci. USA* 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al., 1988, *Bio/Techniques* 6:958-976) or intercalating agents (see, e.g., Zon, 1988, *Pharm. Res.* 5:539-549). To this end, the oligonucleotide can be conjugated to another molecule, e.g., a peptide, hybridization triggered cross-linking agent, transport agent, hybridization-triggered cleavage agent, etc.

The invention also includes molecular beacon nucleic acids having at least one region which is complementary to a marker of the invention, such that the molecular beacon is useful for quantitating the presence of the predictive marker of the invention in a sample. A "molecular beacon" nucleic acid is a nucleic acid comprising a pair of complementary regions and having a fluorophore and a fluorescent quencher associated therewith. The fluorophore and quencher are associated with different portions of the nucleic acid in such an orientation that when the complementary regions are annealed with one another, fluorescence of the fluorophore is quenched by the quencher. When the complementary regions of the nucleic acid are not annealed with one another, fluorescence of the fluorophore is quenched to a lesser degree. Molecular beacon nucleic acids are described, for example, in U.S. Pat. No. 5,876,930.

Vectors, including expression vectors, containing a nucleic acid encoding a polypeptide corresponding to a predictive marker of the invention can be used for production of nucleic acid and proteins corresponding to predictive markers of the invention; as well as for production of compositions relating to the predictive markers. Useful vectors further comprise promoter and/or regulatory sequences for effective expression of the nucleic acid and/or protein corresponding to the predictive marker of interest. In certain instances, promoters can include constitutive promoter/regulatory sequences, inducible promoter/regulatory sequences, tissue specific promoter/regulatory sequences, or the naturally occurring endogenous promoter/regulatory sequences corresponding to the predictive marker of interest, as required. Various expression vectors are well known in the art and can be adapted to suit the particular system for expression. For example, recombinant expression vectors of the invention can be designed for expression of a polypeptide corresponding to a marker of the invention in prokaryotic (e.g., *E. coli*) or eukaryotic cells (e.g., insect cells {using baculovirus expression vectors}, yeast cells or mammalian cells). Suitable host cells are known in the art and include those discussed in Goeddel, supra. Alternatively, the recombinant expression vector can be transcribed and translated in vitro, for example using T7 promoter regulatory sequences and T7 polymerase. Vectors and host cells can be produced using routine methodology known in the art. Furthermore, use of vectors and host cells can be utilized for production of nucleic acids, polypeptides and fragments thereof corresponding to markers of the invention.

Isolated Proteins and Antibodies

One aspect of the invention pertains to isolated proteins which correspond to predictive markers of the invention, and biologically active portions thereof, as well as polypeptide fragments suitable for use as immunogens to raise antibodies directed against a polypeptide corresponding to a predictive marker of the invention. Polypeptides for use in the invention can be isolated, purified, or produced using the gene identification information provided herein in combination with routine molecular biology, protein purification and recombinant DNA techniques well known in the art.

Preferred polypeptides have the amino acid sequence listed in the one of the GenBank and Entrez database records described herein. Other useful proteins are substantially identical (e.g., at least about 70%, preferably 80%, 90%, 95%, or 99%) to one of these sequences and retain the functional activity of the protein of the corresponding naturally-occurring protein yet differ in amino acid sequence due to natural allelic variation or mutagenesis.

The determination of percent identity between two sequences can be accomplished using a mathematical algorithm determining the number of identical positions shared between two sequences. Determination can be carried out using any known method in the art for comparison of identity and similarity. Examples of methods used can include for example, a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J. Mol. Biol.* 215:403-410. BLAST nucleotide searches can be performed with the NBLAST program, score=100, wordlength=12 to obtain nucleotide sequences homologous to a nucleic acid molecules of the invention. BLAST protein searches can be performed with the XBLAST program, score=50, wordlength=3 to obtain amino acid sequences homologous to a protein molecules of the invention. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used (accessible at the website maintained by National Center for Biotechnology Information, Bethesda, Md., USA. Another example of a mathematical algorithm utilized for the comparison of sequences is the algorithm of Myers and Miller, (1988) *CABIOS* 4:11-17. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2. The percent identity between two sequences can be determined using techniques similar to those described above, with or without allowing gaps. In calculating percent identity, only exact matches are counted.

The invention also provides chimeric or fusion proteins corresponding to a marker of the invention. As used herein, a "chimeric protein" or "fusion protein" comprises all or part (preferably a biologically active part) of a polypeptide corresponding to a marker of the invention operably linked to a heterologous polypeptide (i.e., a polypeptide other than the polypeptide corresponding to the marker). Within the fusion protein, the term "operably linked" is intended to indicate that the polypeptide of the invention and the heterologous polypeptide are fused in-frame to each other. The heterologous polypeptide can be fused to the amino-terminus or the carboxyl-terminus of the polypeptide of the invention. Useful fusion proteins can include GST, c-myc, FLAG, HA, and any other well known heterologous tag for use in fusion protein production. Such fusion proteins can facilitate the purification of a recombinant polypeptide of the invention.

In addition, fusion proteins can include a signal sequence from another protein such as gp67, melittin, human placental alkaline phosphatase, and phoA. In yet another aspect, the fusion protein is an immunoglobulin fusion protein in which all or part of a polypeptide corresponding to a predictive marker of the invention is fused to sequences derived from a member of the immunoglobulin protein family. The immunoglobulin fusion proteins of the invention can be used as immunogens to produce antibodies directed against a polypeptide of the invention in a subject, to purify ligands and in screening assays to identify molecules which inhibit the interaction of receptors with ligands.

An isolated polypeptide corresponding to a predictive marker of the invention, or a fragment thereof, can be used as an immunogen to generate antibodies using standard techniques for polyclonal and monoclonal antibody preparation. For example, an immunogen typically is used to prepare antibodies by immunizing a suitable (i.e. immunocompetent) subject such as a rabbit, goat, mouse, or other mammal or vertebrate. An appropriate immunogenic preparation can contain, for example, recombinantly-expressed or chemically-synthesized polypeptide. The preparation can further include an adjuvant, such as Freund's complete or incomplete adjuvant, or a similar immunostimulatory agent.

Accordingly, another aspect of the invention pertains to antibodies directed against a polypeptide of the invention. The terms "antibody" and "antibody substance" as used interchangeably herein refer to immunoglobulin molecules and immunologically active portions of immunoglobulin molecules, i.e., molecules that contain an antigen binding site which specifically binds an antigen, such as a polypeptide of the invention, e.g., an epitope of a polypeptide of the invention. A molecule which specifically binds to a given polypeptide of the invention is a molecule which binds the polypeptide, but does not substantially bind other molecules in a sample, e.g., a biological sample, which naturally contains the polypeptide. Examples of immunologically active portions of immunoglobulin molecules include F(ab) and $F(ab')_2$ fragments which can be generated by treating the antibody with an enzyme such as pepsin. The invention provides polyclonal and monoclonal antibodies. Synthetic and genetically engineered variants (See U.S. Pat. No. 6,331,415) of any of the foregoing are also contemplated by the present invention. Polyclonal and monoclonal antibodies can be produced by a variety of techniques, including conventional murine monoclonal antibody methodology e.g., the standard somatic cell hybridization technique of Kohler and Milstein, *Nature* 256: 495 (1975) the human B cell hybridoma technique (see Kozbor et al., 1983, *Immunol. Today* 4:72), the EBV-hybridoma technique (see Cole et al., pp. 77-96 In *Monoclonal Antibodies and Cancer Therapy*, Alan R. Liss, Inc., 1985) or trioma techniques. See generally, Harlow, E. and Lane, D. (1988) *Antibodies: A Laboratory Manual*, Cold Spring Harbor Laboratory Press, Cold Spring Harbor, N.Y.; and *Current Protocols in Immunology*, Coligan et al. ed., John Wiley & Sons, New York, 1994. Preferably, for diagnostic applications, the antibodies are monoclonal antibodies. Additionally, for use in in vivo applications the antibodies of the present invention are preferably human or humanized antibodies. Hybridoma cells producing a monoclonal antibody of the invention are detected by screening the hybridoma culture supernatants for antibodies that bind the polypeptide of interest, e.g., using a standard ELISA assay.

If desired, the antibody molecules can be harvested or isolated from the subject (e.g., from the blood or serum of the subject) and further purified by well-known techniques, such as protein A chromatography to obtain the IgG fraction. Alternatively, antibodies specific for a protein or polypeptide of the invention can be selected or (e.g., partially purified) or purified by, e.g., affinity chromatography to obtain substantially purified and purified antibody. By a substantially purified antibody composition is meant, in this context, that the antibody sample contains at most only 30% (by dry weight) of contaminating antibodies directed against epitopes other than those of the desired protein or polypeptide of the invention, and preferably at most 20%, yet more preferably at most 10%, and most preferably at most 5% (by dry weight) of the sample is contaminating antibodies. A purified antibody composition means that at least 99% of the antibodies in the composition are directed against the desired protein or polypeptide of the invention.

Additionally, recombinant antibodies, such as chimeric and humanized monoclonal antibodies, comprising both human and non-human portions, which can be made using standard recombinant DNA techniques, are within the scope of the invention. A chimeric antibody is a molecule in which different portions are derived from different animal species, such as those having a variable region derived from a murine mAb and a human immunoglobulin constant region. (See, e.g., Cabilly et al., U.S. Pat. No. 4,816,567; and Boss et al., U.S. Pat. No. 4,816,397, which are incorporated herein by reference in their entirety.) Humanized antibodies are antibody molecules from non-human species having one or more complementarily determining regions (CDRs) from the non-human species and a framework region from a human immunoglobulin molecule. (See, e.g., Queen, U.S. Pat. No. 5,585,089, which is incorporated herein by reference in its entirety.)

Such chimeric and humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Cancer Res.* 47:999-1005; Wood et al. (1985) *Nature* 314:446-449; and Shaw et al. (1988) *J. Natl. Cancer Inst.* 80:1553-1559); Morrison (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

Methods for making human antibodies are known in the art. One method for making human antibodies employs the use of transgenic animals, such as a transgenic mouse. These transgenic animals contain a substantial portion of the human antibody producing genome inserted into their own genome and the animal's own endogenous antibody production is rendered deficient in the production of antibodies. Methods for making such transgenic animals are known in the art. Such transgenic animals can be made using XENOMOUSE™ technology or by using a "minilocus" approach. Methods for making XENOMICE™ are described in U.S. Pat. Nos. 6,162,963, 6,150,584, 6,114,598 and 6,075,181, which are incorporated herein by reference. Methods for making transgenic animals using the "minilocus" approach are described in U.S. Pat. Nos. 5,545,807, 5,545,806 and 5,625,825; also see International Publication No. WO93/12227, which are each incorporated herein by reference.

Antibody fragments may be derived from any of the antibodies described above. For example, antigen-binding fragments, as well as full-length monomeric, dimeric or trimeric polypeptides derived from the above-described antibodies are themselves useful. Useful antibody homologs of this type include (i) a Fab fragment, a monovalent fragment consisting of the VL, VH, CL and CH1 domains; (ii) a $F(ab')_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., *Nature* 341:544-546 (1989)), which consists of a VH domain; (vii) a single domain functional heavy chain antibody, which consists of a VHH domain (known as a nanobody) see e.g., Cortez-Retamozo, et al., *Cancer Res.* 64: 2853-2857 (2004), and references cited therein; and (vii) an isolated complementarity determining region (CDR), e.g., one or more isolated CDRs together with sufficient framework to provide an antigen binding fragment. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see e.g., Bird et al. *Science* 242:423-426 (1988); and Huston et al. *Proc. Natl. Acad. Sci. USA* 85:5879-5883 (1988). Such single chain antibodies are also intended to be encompassed within the term "antigen-binding fragment" of an antibody. These antibody fragments are obtained using conventional techniques known to those with skill in the art, and the fragments are screened for utility in the same manner as are intact antibodies. Antibody fragments, such as Fv, $F(ab')_2$ and Fab may be prepared by cleavage of the intact protein, e.g. by protease or chemical cleavage.

An antibody directed against a polypeptide corresponding to a predictive marker of the invention (e.g., a monoclonal antibody) can be used to detect the predictive marker (e.g., in a cellular sample) in order to evaluate the level and pattern of expression of the predictive marker. The antibodies can also be used diagnostically to monitor protein levels in tissues or body fluids (e.g. in an tumor sample) as part of a clinical testing procedure, e.g., to, for example, determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Accordingly, in one aspect, the invention provides substantially purified antibodies or fragments thereof, and non-human antibodies or fragments thereof, which antibodies or fragments specifically bind to a polypeptide comprising an amino acid sequence encoded by a predictive marker identified herein. The substantially purified antibodies of the invention, or fragments thereof, can be human, non-human, chimeric and/or humanized antibodies.

In another aspect, the invention provides non-human antibodies or fragments thereof, which antibodies or fragments specifically bind to a polypeptide comprising an amino acid sequence which is encoded by a nucleic acid molecule of a predictive marker of the invention. Such non-human antibodies can be goat, mouse, sheep, horse, chicken, rabbit, or rat antibodies. Alternatively, the non-human antibodies of the invention can be chimeric and/or humanized antibodies. In addition, the non-human antibodies of the invention can be polyclonal antibodies or monoclonal antibodies.

In still a further aspect, the invention provides monoclonal antibodies or fragments thereof, which antibodies or fragments specifically bind to a polypeptide comprising an amino acid sequence selected from the group consisting of the amino acid sequences of the present invention, an amino acid sequence encoded by the cDNA of the present invention, a fragment of at least 15 amino acid residues of an amino acid sequence of the present invention, an amino acid sequence which is at least 95% identical to an amino acid sequence of the present invention (wherein the percent identity is determined using the ALIGN program of the GCG software package with a PAM120 weight residue table, a gap length penalty of 12, and a gap penalty of 4) and an amino acid sequence which is encoded by a nucleic acid molecule which hybridizes to a nucleic acid molecule consisting of the nucleic acid molecules of the present invention, or a complement thereof, under conditions of hybridization of 6×SSC at 45° C. and washing in 0.2×SSC, 0.1% SDS at 65° C. The monoclonal antibodies can be human, humanized, chimeric and/or non-human antibodies.

The substantially purified antibodies or fragments thereof may specifically bind to a signal peptide, a secreted sequence, an extracellular domain, a transmembrane or a cytoplasmic domain or cytoplasmic membrane of a polypeptide of the invention. The substantially purified antibodies or fragments thereof, the non-human antibodies or fragments thereof, and/or the monoclonal antibodies or fragments thereof, of the invention specifically bind to a secreted sequence or an extracellular domain of the amino acid sequences of the present invention.

The invention also provides a kit containing an antibody of the invention conjugated to a detectable substance, and instructions for use. Still another aspect of the invention is a diagnostic composition comprising an antibody of the invention and a pharmaceutically acceptable carrier. In certain aspects, the diagnostic composition contains an antibody of the invention, a detectable moiety, and a pharmaceutically acceptable carrier.

Sensitivity Assays

A sample of cancerous cells is obtained from a patient. An expression level is measured in the sample for a marker corresponding to at least one of the predictive markers set forth in Table 1A, Table 1B, Table 2A, Table 2B, and/or Table 3. Preferably a marker set is utilized comprising markers identifed in Table 1A, Table 1B, Table 2A, Table 2B, and/or Table 3, and put together in a marker set using the methods described herein. For example, marker sets can comprise the marker sets identified in Table 4, or any marker set prepared by similar methods. Such analysis is used to obtain an expression profile of the tumor in the patient. Evaluation of the expression profile is then used to determine whether the patient is a responsive patient and would benefit from proteasome inhibition therapy (e.g., treatment with a proteasome inhibitor (e.g., bortezomib) alone, or in combination with additional agents) and/or glucocorticoid therapy (e.g., treatment with a glucocorticoid (e.g., dexamethasone) alone, or in combination with additional agents). Evaluation can include use of one marker set prepared using any of the methods provided or other similar scoring methods known in the art (e.g., weighted voting, CTF). Still further, evaluation can comprise use of more than one prepared marker set. A proteasome inhibition therapy and/or glucocorticoid therapy will be identified as appropriate to treat the cancer when the outcome of the evaluation demonstrates decreased non-responsiveness or increased responsiveness in the presence of the agent.

In one aspect, the invention features a method of evaluating a patient, e.g., a patient with cancer, e.g. a hematological cancer (e.g., multiple myeloma, leukemias, lymphoma, etc) or cancer from a solid tumor (e.g., in lung, breast, prostate, ovary, colon, kidney, or liver) for responsiveness or non-responsiveness to treatment with a proteasome inhibition and/or a glucocorticoid therapy regimen. The method includes providing an evaluation of the expression of the markers in a predictive marker set of markers in the patient, wherein the predictive marker set has the following properties: it includes a plurality of genes, each of which is differentially expressed as between patients responsive or non-responsive to treatment with a proteasome inhibition and/or a glucocorticoid therapy regimen and non-afflicted subjects and it contains a sufficient number of differentially expressed markers such that differential expression (e.g., as compared to a level in a non-afflicted reference sample) of each of the markers in the predictive marker set in a subject is predictive of responsiveness or nonresponsiveness with no more than about 15%, about 10%, about 5%, about 2.5%, or about 1% false positives (wherein false positive means predicting that a patient as responsive or non-responsive when the subject is not); and providing a comparison of the expression of each of the markers in the set from the patient with a reference value, thereby evaluating the patient.

Examining the expression of one or more of the identified markers or marker sets in a tumor sample taken from a patient during the course of proteasome inhibition therapy and/or glucocorticoid treatment, it is also possible to determine whether the therapeutic agent is continuing to work or whether the cancer has become non-responsive (refractory) to the treatment protocol. For example, a patient receiving a treatment of bortezomib would have tumor cells removed and monitored for the expression of a marker or marker set. If the expression profile of one or more marker sets identified in Table 1A, Table 1B, Table 2A, Table 2B, and/or Table 3 demonstrates increased responsiveness in the presence of the agent, the treatment with proteasome inhibitor would continue. However, if the expression profile of one or more marker sets identified in Table 1A, Table 1B, Table 2A, Table 2B, and/or Table 3 demonstrates increased non-responsiveness in the presence of the agent, then the cancer may have become resistant to proteasome inhibition therapy and/or glucocorticoid therapy, and another treatment protocol should be initiated to treat the patient.

Importantly, these determinations can be made on a patient by patient basis or on an agent by agent (or combinations of agents). Thus, one can determine whether or not a particular proteasome inhibition therapy and/or glucocorticoid therapy is likely to benefit a particular patient or group/class of patients, or whether a particular treatment should be continued.

Use of Information

In one method, information, e.g., about the patient's marker expression levels (e.g., the result of evaluating a predictive marker or predictive marker set described herein), or about whether a patient will be responsive or non-responsive to a proteasome inhibition therapy and/or glucocorticoid therapy, is provided (e.g., communicated, e.g., electronically communicated) to a third party, e.g., a hospital, clinic, a government entity, reimbursing party or insurance company (e.g., a life insurance company). For example, choice of medical procedure, payment for a medical procedure, payment by a reimbursing party, or cost for a service or insurance can be function of the information. E.g., the third party receives the information, makes a determination based at least in part on the information, and optionally communicates the information or makes a choice of procedure, payment, level of payment, coverage, etc. based on the information. In the method, informative expression level of a predictive marker or a predictive marker set selected from or derived from Table 1A, Table 1B, Table 2A, Table 2B, and Table 3 is determined.

In one embodiment, a premium for insurance (e.g., life or medical) is evaluated as a function of information about one or more marker expression levels, e.g., a predictive marker or predictive marker set, e.g., a level of expression associated with responsiveness or non-responsiveness to a proteasome inhibition therapy and/or glucocorticoid therapy (e.g., the informative expression level). For example, premiums can be increased (e.g., by a certain percentage) if the markers of a patient or a patient's predictive marker set described herein are differentially expressed between an insured candidate (or a candidate seeking insurance coverage) and a reference value (e.g., a non-afflicted person). As another example, premiums can be decreased if levels of a predictive marker or predictive marker set are sustained (as described herein) after treatment with a proteasome inhibitor or a glucocorticoid. Premiums can also be scaled depending on marker expression levels, e.g., the result of evaluating a predictive marker or predictive marker set described herein. For example, premiums can be assessed to distribute risk, e.g., as a function of marker expression levels, e.g., the result of evaluating a predictive marker or predictive marker set described herein. In another example, premiums are assessed as a function of actuarial data that is obtained from patients that are enhanced or non-enhanced responders.

Information about marker expression levels, e.g., the result of evaluating a predictive marker or predictive marker set described herein (e.g., the informative expression level), can be used, e.g., in an underwriting process for life insurance. The information can be incorporated into a profile about a subject. Other information in the profile can include, for example, date of birth, gender, marital status, banking information, credit information, children, and so forth. An insurance policy can be recommended as a function of the information on marker expression levels, e.g., the result of evaluating a predictive marker or predictive marker set described herein, along with one or more other items of information in the profile. An insurance premium or risk assessment can also be evaluated as function of the predictive marker or predictive marker set information. In one implementation, points are assigned on the basis of being responsive or non-responsive to a proteasome inhibition therapy and/or glucocorticoid therapy.

In one embodiment, information about marker expression levels, e.g., the result of evaluating a predictive marker or predictive marker set described herein, is analyzed by a function that determines whether to authorize the transfer of funds to pay for a service or treatment provided to a subject (or make another decision referred to herein). For example, the results of analyzing a expression of a predictive marker or predictive marker set described herein may indicate that a subject is responsive or non-responsive to a proteasome inhibition therapy and/or glucocorticoid therapy, suggesting that a treatment course is needed, thereby triggering an outcome that indicates or causes authorization to pay for a service or treatment provided to a subject. In one example, informative expression level of a predictive marker or a predictive marker set selected from or derived from Table 1A, Table 1B, Table 2A, Table 2B, and Table 3 is determined and payment is authorized if the informative expression level identifies a responsive patient. For example, an entity, e.g., a hospital, care giver, government entity, or an insurance company or other entity which pays for, or reimburses medical expenses, can use the outcome of a method described herein to determine whether a party, e.g., a party other than the subject patient, will pay for services (e.g., a particular therapy) or treatment provided to the patient. For example, a first entity, e.g., an insurance company, can use the outcome of a method described herein to determine whether to provide financial payment to, or on behalf of, a patient, e.g., whether to reimburse a third party, e.g., a vendor of goods or services, a hospital, physician, or other care-giver, for a service or treatment provided to a patient. For example, a first entity, e.g., an insurance company, can use the outcome of a method described herein to determine whether to continue, discontinue, enroll an individual in an insurance plan or program, e.g., a health insurance or life insurance plan or program.

In one aspect, the disclosure features a method of providing data. The method includes providing data described herein, e.g., generated by a method described herein, to provide a record, e.g., a record described herein, for determining if a payment will be provided. In some embodiments, the data is provided by computer, compact disc, telephone, facsimile, email, or letter. In some embodiments, the data is provided by a first party to a second party. In some embodiments, the first party is selected from the subject, a healthcare provider, a treating physician, a health maintenance organization (HMO), a hospital, a governmental entity, or an entity which sells or supplies the drug. In some embodiments, the second party is a third party payor, an insurance company, employer, employer sponsored health plan, HMO, or governmental entity. In some embodiments, the first party is selected from the subject, a healthcare provider, a treating physician, an HMO, a hospital, an insurance company, or an entity which sells or supplies the drug and the second party is a governmental entity. In some embodiments, the first party is selected from the subject, a healthcare provider, a treating physician, an HMO, a hospital, an insurance company, or an entity which sells or supplies the drug and the second party is an insurance company.

In another aspect, the disclosure features a record (e.g., computer readable record) which includes a list and value of expression for the predictive marker or predictive marker set for a patient. In some embodiments, the record includes more than one value for each marker.

EXEMPLIFICATION

Based on positive findings in multiple myeloma in Phase 1 clinical trials (Orlowski, J Clin Oncol. 2002 Nov. 15; 20(22): 4420-7., Aghajanian, Clin Cancer Res. 2002 August; 8(8): 2505-11) Phase 2 myeloma studies were conducted in order to better to allow a more precise estimate of anti-tumor activity of bortezomib in a more homogeneous population of patients. The safety and efficacy of bortezomib in subjects with multiple myeloma was investigated in two phase 2 clinical studies, M34100-024 (subjects with first relapse) and M34100-025 (subjects with second or greater relapse and refractory to their last prior therapy). In Study M34100-025, the CR+PR rate to bortezomib alone was 27% (53 of 193 patients), and the overall response rate (CR+PR+MR) to bortezomib alone was 35% (67 of 193 patients). See Richardson P G, et al. *N Engl J Med.,* 348:2609-17 (2003). In Study M34100-024 CR+PR rates of were 30% and 38% were seen among patients with relapsed multiple myeloma treated with bortezomib 1.0 mg/m$^2$ and 1.3 mg/m$^2$, respectively. See Jagannath, *Br J Haematol.* 127:165-72 (2004). Patient samples and response criteria from patients participating in these studies, as well as the following additional studies described below were sought for use in pharmacogenomic analyses to identify markers associated with patient response to treatments.

An Open-Label Study Comparison of Bortezomib Versus High Dose Dexamethasone in Patients with Relapsed and Refractory Myeloma A multicenter, open-label, randomized study was conducted, comprising 627 enrolled patients with relapsed or refractory multiple myeloma (Protocol M34101-039). See Richardson et. al., *N. Engl. J. Med,* 352:2487-2498 (2005). Patients were treated with either bortezomib (315 patients) or high-dose dexamethasone (312 patients).

Treatment Dosage and Administration

Drug Supply and Storage

Bortezomib for injection (VELCADE™ Millennium Pharmaceuticals, Inc., Cambridge, Mass.), a sterile lyophilized powder for reconstitution, was supplied in vials containing 2.5 mg bortezomib and 25 mg mannitol USP. Each vial was reconstituted with 2.5 mL of normal (0.9%) saline, Sodium Chloride Injection USP, such that the reconstituted solution contained bortezomib at a concentration of 1 mg/mL. The reconstituted solution was clear and colorless with a final pH between 5 and 6.

Dexamethasome tablets (DECADRON® Merck & Co., Inc.).

TABLE B

| Drug Information | | |
|---|---|---|
| Chemical Name | N-Pyrazinecarbonyl-L-phenylalanine-L-leucineboronic acid | |
| Research Name | MLN341 or PS-341 | |
| Generic Name | bortezomib | dexamethasone |
| Proprietary Name | VELCADE ™ | Decadron ® |
| CAS Registry No. | 179324-69-7 | 312-93-6 |
| U.S. Pat. No. | 5,780,454 | |
| Classification | Proteasome Inhibitor | Steroid |
| Molecular Formula | $C_{19}H_{25}BN_4O_4$ | $C_{22}H_{29}FO_5$ |
| Molecular Weight | 384.25 | 392.47 |
| Structure | Boronic acid derivative of a leucine phenylalanine dipeptide | Synthetic adrenocorticosteroid |

Patients were assigned to receive bortezomib or high-dose dexamethasone by random allocation at a 1:1 ratio. Randomization was to be stratified, based on the number of lines of prior therapy (one prior line versus more than one prior line of therapy), time of progression relative to treatment (progression while on their most recent therapy or within 6 months of stopping their most recent therapy, or relapse >6 months after receiving their most recent therapy), and screening $\beta_2$-microglobulin levels (>2.5 mg/L versus ≦2.5 mg/L).

Patients assigned to the bortezomib group received treatment for a maximum of 273 days. Patients in this treatment group received up to eight 3-week treatment cycles followed by up to three 5-week treatment cycles of bortezomib. Within each 3-week treatment cycle, the patient received bortezomib 1.3 mg/m$^2$/dose alone as a bolus intravenous (IV) injection twice weekly for two weeks (on Days 1, 4, 8, and 11) of a 21-day cycle. Within each 5-week treatment cycle, the patient received bortezomib 1.3 mg/m$^2$/dose alone as a bolus IV injection once weekly (on Days 1, 8, 15, and 22) of a 35-day cycle.

Patients assigned to the high-dose dexamethasone group received treatment for a maximum of 280 days. Patients in this treatment group received up to four 5-week treatment cycles, followed by up to five 4-week treatment cycles. Within each 5-week treatment cycle, the patient received dexamethasone 40 mg/day PO, once daily on Days 1 to 4, 9 to 12, and 17 to 20 of a 35-day cycle. Within each 4-week treatment cycle, the patient received dexamethasone 40 mg/day PO once daily on Days 1 to 4 of a 28 day cycle. The protocol provided for patients in the dexamethasone group who experienced confirmed progressive disease (PD) to receive bortezomib on a companion study (An International, Non-Comparative, Open-Label Study of PS-341 Administered to Patients with Multiple Myeloma Who Received High-dose Dexamethasone or Experienced Progressive Disease after Receiving at Least Four Previous Therapies, (Protocol M34101-040). An additional 240 patients who did not participate in this study, enrolled in the companion study and according to the protocol would have received at least four prior therapies. Pharmacogenomic samples were also sought for these 240 patients.

During the study, disease response was assessed according to the European Group for Blood and Marrow Transplant (EBMT) criteria as presented in Table C.

Table C. Disease Response Criteria

TABLE C

| Disease Response Criteria[1] | |
|---|---|
| Response | Criteria for response |
| Complete response (CR)[2] | Requires all of the following:<br>Disappearance of the original monoclonal protein from the blood and urine on at least two determinations for a minimum of six weeks by immunofixation studies.<br><5% plasma cells in the bone marrow[3].<br>No increase in the size or number of lytic bone lesions (development of a compression fracture does not exclude response).<br>Disappearance of soft tissue plasmacytomas for at least six weeks. |
| Partial response (PR) | PR includes patients in whom some, but not all, criteria for CR are fulfilled providing the remaining criteria satisfy the requirements for PR.<br>Requires all of the following:<br>≧50% reduction in the level of serum monoclonal protein for at least two determinations six weeks apart.<br>If present, reduction in 24-hour urinary light chain excretion by either ≧90% or to <200 mg for at least two determinations six weeks apart.<br>≧50% reduction in the size of soft tissue plasmacytomas (by clinical or radiographic examination) for at least six weeks.<br>No increase in size or number of lytic bone lesions (development of compression fracture does not exclude response). |
| Minimal response (MR) | MR includes patients in whom some, but not all, criteria for PR are fulfilled providing the remaining criteria satisfy the requirements for MR. Requires all of the following:<br>≧25% to ≦50% reduction in the level of serum monoclonal protein for at least two determinations six weeks apart.<br>If present, a 50 to 89% reduction in 24-hour light chain excretion, which still exceeds 200 mg/24 h, for at least two determinations six weeks apart.<br>25-49% reduction in the size of plasmacytomas (by clinical or radiographic examination (e.g., 2D MRI, CT scan).<br>No increase in size or number of lytic bone lesions (development of compression fracture does not exclude response). |

TABLE C-continued

| Disease Response Criteria[1] | |
|---|---|
| Response | Criteria for response |
| No change (NC) | Not meeting the criteria for MR or PD. |
| Progressive disease (PD) (for patients not in CR) | Requires one or more of the following:<br>>25% increase in the level of serum monoclonal paraprotein, which must also be an absolute increase of at least 5 g/L and confirmed on a repeat investigation one to three weeks later[4,5].<br>>25% increase in 24-hour urinary light chain excretion, which must also be an absolute increase of at least 200 mg/24 h and confirmed on a repeat investigation one to three weeks later[4,5].<br>>25% increase in plasma cells in a bone marrow aspirate or on trephine biopsy, which must also be an absolute increase of at least 10%.<br>Definite increase in the size of existing lytic bone lesions or soft tissue plasmacytomas.<br>Development of new bone lesions or soft tissue plasmacytomas (not including compression fracture).<br>Development of hypercalcemia (corrected serum calcium >11.5 mg/dL or 2.8 mmol/L not attributable to any other cause)[4]. |
| Relapse from CR | Requires at least one of the following:<br>Reappearance of serum or urine monoclonal paraprotein on immunofixation or routine electrophoresis to an absolute value of >5 g/L for serum and >200 mg/24 hours for urine, and excluding oligoclonal immune reconstitution. Reappearance of monoclonal paraprotein must be confirmed by at least one follow-up.<br>≧5% plasma cells in the bone marrow aspirate or biopsy.<br>Development of new lytic bone lesions or soft tissue plasmacytomas or definite increase in the size of residual bone lesions (not including compression fracture).<br>Development of hypercalcemia (corrected serum calcium >11.5 mg/dL or 2.8 mmol/L not attributable to any other cause). |

[1]Based on the EBMT criteria. See, Blade J, et al. Br J Haematol; 102(5): 1115-23 (1998).
[2]For proper evaluation of CR, bone marrow should be ≧20% cellular and serum calcium should be within normal limits.
[3]A bone marrow collection and evaluation is required to document CR. Repeat collection and evaluation of bone marrow is not required to confirm CR for patients with secretory myeloma who have a sustained absence of monoclonal protein on immunofixation for a minimum of 6 weeks; however, repeat collection and evaluation of bone marrow is required at the Response Confirmation visit for patients with non-secretory myeloma.
[4]The need for urgent therapy may require repeating these tests earlier or eliminating a repeat examination.
[5]For determination of PD, increase in paraprotein is relative to the nadir.

Patients were evaluable for response if they had received at least one dose of study drug and had measurable disease at baseline (627 total patients: 315 in the bortezomib group and 312 in the dexamethasone group). The evaluation of confirmed response to treatment with bortezomib or dexamethasone according to the European Group for Blood and Marrow Transplant (EBMT) criteria is provided in Table D. Response and date of disease progression was determined by computer algorithm that integrated data from a central laboratory and case report forms from each clinical site, according to the Blade criteria (Table C). The response rate (complete plus partial response (CR+PR)) in the bortezomib group was 38 percent; and in the dexamethasone group was 18 percent (P<0.0001). Complete response was achieved in 20 patients (6 percent) who received bortezomib, and in 2 patients (<1 percent) who received dexamethasone (P<0.001), with complete response plus near-complete response in 13 and 2 percent (P<0.0001) in patients receiving bortezomib and dexamethasone, respectively. These data have been submitted for publication. See Richardson P G, et al. [submitted NEJM].

TABLE D

Summary of Best Confirmed Response to Treatment[1,2] (Population, N = 627)

| Best Confirmed Response | bortezomib n (%) (n = 315) | dexamethasone n (%) (n = 312) | Difference (95% CI)[a] | p-value[b] |
|---|---|---|---|---|
| Overall Response Rate (CR + PR) | 121 (38) | 56 (18) | 0.20 (0.14, 0.27) | <0.0001 |
| Complete Response | 20 (6) | 2 (<1) | 0.06 (0.03, 0.09) | 0.0001 |
| Partial Response | 101 (32) | 54 (17) | 0.15 (0.08, 0.21) | <0.0001 |
| Near CR: IF+ | 21 (7) | 3 (<1) | 0.06 (0.03, 0.09) | |
| SWOG Remission | 46 (15) | 17 (5) | 0.09 (0.05, 0.14) | |
| Minor Response | 25 (8) | 52 (17) | −0.09 (−0.14, −0.04) | |
| CR + PR + MR | 146 (46) | 108 (35) | 0.12 (0.04, 0.19) | |
| No Change | 137 (43) | 149 (48) | −0.04 (−0.12, 0.04) | |

TABLE D-continued

Summary of Best Confirmed Response to Treatment[1,2] (Population, N = 627)

| Best Confirmed Response | bortezomib n (%) (n = 315) | dexamethasone n (%) (n = 312) | Difference (95% CI)[a] | p-value[b] |
|---|---|---|---|---|
| Progressive Disease | 22 (7) | 41 (13) | −0.06 (−0.11, −0.01) | |
| Not Evaluable | 10 (3) | 14 (4) | −0.01 (−0.04, 0.02) | |

[1]Response based on computer algorithm using the protocol-specified EBMT criteria.

[2]Percents calculated for the statistical output in section 14 are 'rounded' to the nearest integer including percents ≧0.5% but <1% rounding to 1%; these are reported in the in-text tables as <1%.

[a]Asymptotic confidence interval for the difference in response rates.

[b]P-value from the Cochran-Mantel-Haenszel chi-square test adjusted for the actual randomization stratification factors.

Disease progression was determined by Blade criteria as described in Table C and above. The median time to disease progression in the bortezomib group was 6.2 month (189 days); and the in the dexamethasone group was 3.5 months (106 days) (hazard ratio 0.55, P<0.0001). The date of progression was determined by computer algorithm. P-value from log-rank test adjusted by actual randomization factors. See, Richardson et al., New Engl J Med., submitted.

Median time to response was 43 days for patients in both groups. Median duration of response was 8 months in the bortezomib group and 5.6 months in the dexamethasone group.

Patients given bortezomib had a superior overall survival. One-year survival was 80% on bortezomib and 66% on dexamethasone (P<0.0030). This represents a 41% decrease in risk of death in the bortezomib group during the first year after enrollment. The hazard ratio for overall survival was 0.57 (P<0.0013), favoring bortezomib. The analysis of overall survival includes data from 147 patients (44 percent) in the dexamethasone group who had disease progression and subsequently crossed over to receive bortezomib in a companion study.

Quality of Life assessment can be analyzed to determine if response to therapy was accompanied by measurable improvement in quality of life. Analysis is performed on summary scores as well as individual items, with specific analytical methods outlined in a formal statistical analysis plan developed prior to database lock.

Pharmacogenomic Samples Collected

Pharmacogenomic tumor samples (bone marrow aspirate) were collected from patients for evaluation of the expression of global mRNA levels.

Statistical Procedures

Summary tabulations were presented that displayed the number of observations, mean, standard deviation, median, minimum, and maximum for continuous variables, and the number and percent per category for categorical data. The categories for summarization were the two assigned treatment groups.

A formal statistical analysis plan was developed and finalized prior to database lock. The primary efficacy analyses were performed on the intent-to-treat (ITT) population. The primary efficacy analysis was performed on the rates of responders, where a responder was defined as a CR, PR, or MR using the criteria prospectively established in Table C. Two-sided 90% confidence limits on proportions of responders in each dose group were established, corresponding to a 95% one-sided lower limit.

For those patients who participated in the pharmacogenomic portion of the study, correlation between RNA expression levels and response to therapy were evaluated descriptively. In addition, duration of response, time to disease progression, quality of life, and overall patient survival may be analyzed using RNA expression as a factor.

TABLE E

Summary of Pharmacogenomic Patient Response

| Study | CR | PR | MR | NC | PD | IE | TOTAL with evaluable response |
|---|---|---|---|---|---|---|---|
| all | 10 | 69 | 25 | 59 | 61 | 22 | 224 |
| 024 | 1 | 1 | 0 | 1 | 4 | 0 | 7 |
| 025 | 2 | 10 | 3 | 10 | 14 | 5 | 39 |
| 040 | 1 | 20 | 6 | 13 | 8 | 2 | 48 |
| 039 341 | 5 | 25 | 5 | 19 | 13 | 9 | 67 |
| 039 Dex | 1 | 13 | 11 | 16 | 22 | 6 | 62 |

A total of 224 patient samples were assessed for pharmacogenomic analyses. These patient samples were collected from the clinical trials of bortezomib for the treatment of multiple myeloma See Table E. The overall response rate to bortezomib in this set of patients was 46.4% (CR+PR rate of 35%). The overall response rate to dexamethasone was 39.7% (CR+PR rate of 22.2%). All pharmacogenomic analyses relied on the European Group for Blood and Marrow Transplant (EBMT) criteria of response category.

Identification of Responsive and Non-Predictive Markers

Biopsies from 224 multiple myeloma patients resulted in generation of high quality gene expression data which was used to identify predictive markers. Candidate markers that are correlated with the outcome of multiple myeloma patients to proteasome inhibition (e.g., bortezomib) therapy or glucocorticoid (e.g., dexamethasone) therapy were selected by using a combination of marker ranking algorithms. Supervised learning and feature selection algorithms were then used to identify the markers of the present invention.

A data set comprising 224 discovery samples, time to progression data and short-term response categorization was used to identify genes associated with patient outcome to one of two treatments (bortezomib or dexamethasone). The data set consisted of discovery samples matched with the patient's outcome as measured by best response and time to disease progression. For best response, each patient was classified as responder ($N_R$), stable disease ($N_S$), or progression ($N_P$). For marker identification, the three response classes were further grouped into responders vs. non-responders (stable and progression) ($N_{P+S}$), responders vs. progression, or progression vs. others (stable and responders) ($N_{R+S}$). The analyses further separated the patients based on the treatment they received. For bortezomib analyses $N_R$=79, $N_S$=43, and $N_P$=41. Thus, the responder vs. non-responder analysis utilizes 79 vs. 84 samples. The responder vs. progression analysis utilizes 79 vs. 41 and the progression vs. other analysis utilizes 41 vs. 122 samples. For the dexamethasone analysis $N_R$=25, $N_S$=16, and $N_P$=21. Accordingly, the responder vs. non-responder analysis utilizes 25 vs. 37 samples. The responder vs. progression analysis utilizes 25 vs. 21 and the progression vs. other analysis utilizes 21 vs. 41 samples.

44,928 gene transcripts (Affymetrix probe sets) were profiled for each sample on the two Affymetrix U133 microarrays (A and B) according to manufacturer's directions. Total RNA was isolated from homogenized patient tumor tissue by Triazol™ (Life Technologies, Inc.) and stored at 80° C., following the manufacturer's recommendations. Detailed methods for labeling the samples and subsequent hybridization to the arrays are available from Affymetrix (Santa Clara, Calif.). Briefly, 1.5 μg of total RNA was converted to double-stranded cDNA (Superscript; Life Technologies, Inc.) priming the first-strand synthesis with a T7-(dT)24 primer containing a T7 polymerase promoter (Affymetrix Inc.). All of the double-stranded cDNA was subsequently used as a template to generate biotinylated cRNA using the incorporated T7 promoter sequence in an in vitro transcription system (Megascript kit; Ambion and Bio-11-CTP and Bio-16-UTP; Enzo). Reference oligonucleotides and spikes were added to 6-10 μg of cRNA, which was then hybridized to U133 A and B oligonucleotide arrays for 16 h at 45° C. with constant rotation. The arrays were then washed and stained on an Affymetrix fluidics station using the EUKGE-WS1 protocol and scanned on an Affymetrix GeneArray scanner.

Normalization and Logarithmic Transformation.

Expression values for all markers on each microarray were normalized to a trimmed mean of 150. Expression values were determined using MASS gene expression analysis data processing software (Affymetrix, Santa Clara, Calif.). These values will be referred to as the "normalized expression" in the remainder of this section. In a further processing step, the number 1 was added to each normalized expression value. The logarithm base 2 was taken of the resulting number, and this value will be referred to as the "log expression" in the remainder of this section.

Variance Components Analysis.

There were up to six replicate hybridizations for each patient: three replicate hybridizations for each of two T7 RNA labelings. To summarize replicates into a single estimate of intensity for each patient, a mixed effects linear model was used. For each probe set, a model was fit which included terms the patient sample specific random effect representing the deviation from the overall mean intensity, and the replicate hybridization random effect. These random effects are referred to as the variance components of the model. Model fitting includes assessing the variance due to these two random effects, resulting in estimates of patient sample variance and replicate variance.

Summarizing Expression Across Replicates.

The final summary expression value, for each sample on each probe set, was obtained by estimating the best linear unbiased predictor (BLUP). The BLUP can be viewed as a weighted average of each subject's replicates with weights inversely proportional to the linear combination of the variance components. The weights influence how much each subject's estimate of intensity deviates away from the overall mean. Details on mixed effects models and calculating BLUP estimates can be found in most texts which discuss linear mixed effects models and variance components. See, for example, "Variance Components" by Searle, Casella, and McCulloch. Wiley Series in Probability and Mathematical Statistics, 1992 John Wiley & Sons.

Removal of Genes with Low Inter-Patient Variance.

The probe sets were reduced in number to include only those having more than 75% of their variance due to patient sample variance. Of 44,928 probe sets, 7,017 passed this filter and were carried on to further analysis.

Optional Reverse Log Transformation.

The BLUP expression value was used for differential expression analysis with the t-test. For computing the digital differential expression scores, the final summary value, x, was transformed back to the original scale by exponentiating, thus reversing the log transformation:

$$y=2^x-1$$

Single Marker Selection.

Single gene transcripts that appear associated with patient response categories or with patient time to progression can be identified using the feature ranking and filtering methodology described below. Single marker identification of predictive markers using the methodology described herein are set forth in Table 1 (Table 1A and Table 1B), Table 2 (Table 2A and Table 2B), and Table 3.

Model Selection.

A set of one or more gene transcripts that together classify samples into sensitive and resistant groups (or responsive and non-responsive) or predict TTP, in the context if a particular classifier algorithm, is referred to as a "model." The gene transcripts are referred to as "features." Determining which combination of gene transcript(s) best classifies samples into sensitive and resistant groups is referred to as "model selection." The following section describes the process of how the models of the present invention were identified. An exemplary model is set forth in Table 4. The methods provided herein along with the single marker identification or predictive markers can be used to identify additional models comprising markers of the invention.

Feature Ranking and Filtering

The first step in predictive model selection is to filter the 7,017 features down to a smaller number which show a correspondence with the sample classifications. Filtering involves first ranking the features by a scoring method, and then taking only the highest ranking features for further analysis. The filtering algorithms used in the present invention were: (1) t-test, and (2) Pooled Fold Change ("PFC). In certain aspects, the t-test was used to identify genes showing a small but consistent change in levels, and PFC was used to identify genes that were "off" in one class, but "on" in a fraction of the other class. For time to progression data, Cox proportional hazards modeling was used to determine a p-value for the association of a feature with time to progression.

The t-test is a standard statistical method to test for significant difference of means between two sets of points presumed to have normal distribution. It is closely related to the more ad hoc measure of differential expression SNR (signal to noise ratio), which is the difference of the class means divided by the sum of the class standard deviations, and has been used to analyze expression data before; for example, see the definition of P(g,c), a measure of correlation between expression of gene g and class vector c, in Golub et al., "Molecular Classification of Cancer: Class discovery and class prediction by marker expression monitoring," Science, 286:531-537 (1999), the contents of which are incorporated herein by reference.

The Pooled Fold Change ("PFC") method is a measure of differential expression between two groups of samples, arbitrarily designated "control" and "tester." PFC finds genes with higher expression in the tester than in the control samples. For the two-class comparisons described in this invention, each class was used in turn as the tester. To qualify as having higher expression, tester samples must be above the $k^{th}$ percentile of the control sample. The fold-change values of tester samples are subjected to a nonlinear transformation that rises to a user-specified asymptote, in order to distinguish moderate levels of fold-change, but not make distinctions between very large fold-changes. The squashed fold-change values of the over-expressed tester samples are averaged to get the POOF score. In particular, PFC for a given tester sample, s, and gene, g, is computed as the average across tester samples of the compressed tester:control ratio R(s,g): $R(s,g)=C(x_{gs}/(k+x_g^Q))$, where C(x) is the compression function $C(z)=A(1-e^{-z/A})$ for $z \geqq T$, and $C(z)=0$ for $z<T$, where T is a threshold value no less than 1.0. A is an upper asymptote on the fold-change value, k is a constant reflecting the additive noise in the data, i.e., the fixed component of the variance in repeated measurements. $x_{gs}$ is the expression value of gene g in sample s, $x_g^Q$ is the Qth percentile of the control samples' expression value.

A minimum fraction f of the tester samples must have R(s,g) greater than 0; if this does not hold true, then the value of R(s,g) is set to 0.

We used the following parameters in our application of this algorithm:

| | Parameter | | | | |
|---|---|---|---|---|---|
| | Q | f | T | A | k |
| Value in run 1 | 0.9 | 0.3 | 1.2 | 5 | 0.25 |

Markers using the 7,017 probe sets were analyzed for differential expression across the 224 patient samples using the t-test and PFC methods described above. Probe sets found to be significant by t-test with a p-value less than 0.01, or having a PFC score other than 0, are reported in Table 1A, Table 1B, Table 2A, Table 2B and Table 3. These probe sets can be used in building marker sets as exemplified below.

A Cox proportional hazard analysis was performed to determine predictors of time until disease progression (TTP) in patients with relapsed and refractory multiple myeloma after treatment. This methodology is designed to analyze time to event data where some of the data may be censored (see E. T. Lee, Statistical Methods for Survival Data Analysis, $2^{nd}$ ed. 1992, John Wiley& Sons, Inc.). The median time to disease progression in the bortezomib group was 6.2 month (189 days); and the in the dexamethasone group was 3.5 months (106 days) (hazard ratio 0.55, P<0.0001). The date of progression was determined by computer algorithm. The statistical package SAS was used to perform the analysis; what parameters used to assess, etc.

We estimated Cox proportional hazard models for each of the 7017 transcripts passing the variance filter. That is, 7,017 models were estimated where each model contained 1 transcript. From each model, we obtained estimates of relative risk, 95% confidence intervals and p-values for the association of each transcript to TTP. From the 7017 models, we found 294 transcripts which had p-values of less than 0.01 in analyzing the 162 patients treated with bortezomib. We found 187 transcripts which had p-values of less than 0.01 in analyzing the 63 patients treated with dexamethasone. That is, these transcripts were significantly associated with TTP. These probe sets are listed in Table 1A, Table 1B, Table 2A, Table 2B and Table 3.

The rank reported in Tables 1A, 1B, 2A, 2B and 3 is determined by independently ranking the different scores of the markers. Ranks are generated for TTP, for PD vs R, for PD vs NC+R, for NR vs R. For the response comparisons, both T-test and digital scores are ranked. Thus there can be up to 7 different #1 ranks for proteasome inhibitor-specific predictive markers of treatment outcome.

Summary of the Data Provided in the Tables

The following terms are used throughout the Tables:

"No." or "Number" corresponds to an identification number for the predictive markers.

"Probeset ID" corresponds to the Affymetrix (Santa Clara, Calif.) identifier from the Human Genome U133A, B set oligonucleotide arrays which were used;

"Rep Public ID" refers to a Representative Public identifier for the gene corresponding to the probe set, and was taken from HG-U133A and HG-U133B annotation files, dated Apr. 12, 2005 which was available and downloaded from the GeneChip support area of the Affymetrix web site (accessible in the Human Genome U133 Set-Support Materials in the Support section of the website maintained by Affymetrix, Inc., Santa Clara, Calif.);

"SEQ ID NO" is the identification number in the sequence listing of the sequence corresponding to the sequence in the GenBank record identified by the Representative Public Identifier.

"Title" corresponds to a common description, where available, and was also taken from the Affymetrix annotation files;

"Gene symbol" corresponds to a symbol the gene is commonly known by, and was also taken from the Affymetrix annotation files;

"Entrez Gene ID" corresponds to the NCBI Unigene unique gene identifier;

"TTP Marker" represents indication of predictive marker which is significantly upregulated in samples with a correlation to longer time to progression (+), or are significantly upregulated in samples with a correlation to shorter time to progression (−);

"Response Marker" represents indication of predictive marker which is significantly upregulated in samples which are responsive to therapy (+), or are significantly upregulated in samples which are non-responsive to therapy (−);

"Type of Specificity" indicates the significance of TTP and/or response indicator as significant indicator of the predictive marker;

"Rank" corresponds to the process of determining which individual markers may be used in combination to group or classify a sample, for example, as responsive or non-responsive. Rank is indicated as the lowest rank score identified among all the methods for each of the predictive markers. In Table 3 where predictive markers are indicative of responsive or non-responsive for proteasome inhibition or glucocorticoid therapy, the rank indicates the lowest rank across various methods for bortezomib or dexamethasone treated samples. Three different feature selection methods were utilized for determining the best classifier, and rank determination: (1) t-test, (2) Pooled Fold Change ("PFC"), and (3) the Wilcoxon Rank-Sum Test.

Predictive markers of the invention are provided in Tables 1A, 1B, 2A, 2B, and 3. Table 1 sets forth predictive markers identified which are specific identifiers of response or non-response to proteasome inhibition therapy (e.g., bortezomib). Table 1A provides predictive markers which are upregulated indicators of non-response and/or correlate with shorter time to progression. Marker nos. 1-547 in Table 1A are newly associated predictive markers, and predictive markers no. 548-657 have been previously identified as associated markers predictive of non-response and/or correlation with shorter time to progression. See, International Patent Publication No. WO04053066, published Jun. 24, 2004. Table 1B provides predictive markers which are upregulated indicators of response and/or correlate with longer time to progression. Marker nos. 658-876 in Table 1B are newly associated predictive markers, and predictive markers no. 877-911 have been previously identified as associated markers predictive of response and/or correlation with longer time to progression. See, International Patent Publication No. WO04053066, published Jun. 24, 2004. Table 2 sets forth predictive markers identified which are specific identifiers of response or non-response to glucocorticoid therapy (e.g., dexamethasone). Table 2A provides predictive markers which are upregulated indicators of non-response and/or correlate with shorter time to progression. Marker nos. 912-1062 in Table 2A are newly associated predictive markers, and predictive markers no. 1063-1070 have been previously identified as associated markers predictive of non-response and/or correlation with shorter time to progression related to advanced stage patient's non-response to bortezomib treatment. See, International Patent Publication No. WO04053066, published Jun. 24, 2004. Table 2B provides predictive markers which are upregulated indicators of response and/or correlate with longer time to progression. Marker nos. 1071-1185 in Table 2B are newly associated predictive markers, and predictive markers no. 1186-1202 have been previously identified as associated markers predictive of response and/or correlation with longer time to progression related to advanced stage patient's response to bortezomib treatment. See, International Patent Publication No. WO04053066, published Jun. 24, 2004. Table 3 sets forth predictive markers identified which are not specific to proteasome inhibition therapy or glucocorticoid therapy, rather are indicator predictive markers of response/longer time to progression (+) or non-response/shorter time to progression (−) with regard to either therapy, and are indicators of general disease aggressiveness. Marker nos. 1203-1423 in Table 3 are newly associated predictive markers, and predictive markers no. 1424-1474 have been previously identified as associated markers predictive of non-response/correlation with shorter time to progression and/or response/correlation with longer time to progression related to advanced stage patient's response to bortezomib treatment. See, International Patent Publication No. WO04053066, published Jun. 24, 2004.

Table 1. Proteasome Inhibitor Predictive Marker Identification

TABLE 1A

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 1 | 220960_x_at | HG-U133A | NM_000983 | 1 | ribosomal protein L22 | RPL22 | 6146 | | – | resp | 1 |
| 2 | 213941_x_at | HG-U133A | AI970731 | 2 | ribosomal protein S7 | RPS7 | 6201 | | – | resp | 3 |
| 3 | 208752_x_at | HG-U133A | AI888672 | 3 | nucleosome assembly protein 1-like 1 | NAP1L1 | 4673 | | – | resp | 7 |
| 4 | 200017_at | HG-U133A | NM_002954 | 4 | ribosomal protein S27a | RPS27A | 6233 | | – | resp | 8 |
| 5 | 218589_at | HG-U133A | NM_005767 | 5 | purinergic receptor P2Y, G-protein coupled, 5 | P2RY5 | 10161 | | – | resp | 8 |
| 6 | 200971_s_at | HG-U133A | NM_014445 | 6 | stress-associated endoplasmic reticulum protein 1 | SERP1 | 27230 | | – | resp | 9 |
| 7 | 201094_at | HG-U133A | NM_001032 | 7 | ribosomal protein S29 | RPS29 | 6235 | | – | resp | 10 |
| 8 | 201256_at | HG-U133A | NM_004718 | 8 | cytochrome c oxidase subunit VIIa polypeptide 2 like | COX7A2L | 9167 | | – | resp | 11 |
| 9 | 233252_s_at | HG-U133B | AK024960 | 9 | spermatid perinuclear RNA binding protein | STRBP | 55342 | | – | resp | 13 |
| 10 | 208517_x_at | HG-U133A | NM_001207 | 10 | basic transcription factor 3 | BTF3 | 689 | | – | resp | 15 |
| 11 | 211939_x_at | HG-U133A | X74070 | 11 | basic transcription factor 3 | BTF3 | 689 | | – | resp | 16 |
| 12 | 201592_at | HG-U133A | NM_003756 | 12 | eukaryotic translation initiation factor 3, subunit 3 gamma, 40 kDa | EIF3S3 | 8667 | | – | resp | 19 |
| 13 | 200018_at | HG-U133A | NM_001017 | 13 | ribosomal protein S13 | RPS13 | 6207 | | – | resp | 20 |
| 14 | 224468_s_at | HG-U133B | BC006151 | 14 | multidrug resistance-related protein | MGC13170 | 84798 | | – | resp | 21 |
| 15 | 200074_s_at | HG-U133B | U16738 | 15 | ribosomal protein L14 | RPL14 | 9045 | | – | resp | 22 |
| 16 | 201516_at | HG-U133A | NM_003132 | 16 | spermidine synthase | SRM | 6723 | | – | resp | 22 |
| 17 | 213687_s_at | HG-U133A | BE968801 | 17 | ribosomal protein L35a | RPL35A | 6165 | | – | resp | 22 |
| 18 | 200781_s_at | HG-U133A | NM_001019 | 18 | ribosomal protein S15a /// ADP-ribosylation factor-like 6 interacting protein | RPS15A /// ARL6IP | 23204 /// 6210 | | – | resp | 23 |
| 19 | 225794_s_at | HG-U133B | AV751709 | 19 | hypothetical gene supported by AL449243 | LOC91689 | 91689 | | – | resp | 24 |
| 20 | 200036_s_at | HG-U133B | NM_007104 | 20 | ribosomal protein L10a | RPL10A | 4736 | | – | resp | 25 |
| 21 | 217491_x_at | HG-U133A | AF042165 | 21 | cytochrome c oxidase subunit VIIc | COX7C | 1350 | | – | resp | 25 |
| 22 | 204118_at | HG-U133A | NM_001778 | 22 | CD48 antigen (B-cell membrane protein) | CD48 | 962 | | – | resp | 26 |
| 23 | 221775_x_at | HG-U133A | BG152979 | 23 | ribosomal protein L22 | RPL22 | 6146 | | – | resp | 26 |
| 24 | 200091_s_at | HG-U133A | AA888388 | 24 | ribosomal protein S25 | RPS25 | 6230 | | – | resp | 27 |
| 25 | 200088_x_at | HG-U133B | AK026491 | 25 | ribosomal protein L12 | RPL12 | 6136 | | – | resp | 28 |
| 26 | 208768_x_at | HG-U133A | D17652 | 26 | ribosomal protein L22 | RPL22 | 6146 | | – | resp | 28 |
| 27 | 200010_at | HG-U133A | NM_000975 | 27 | ribosomal protein L11 | RPL11 | 6135 | | – | resp | 29 |
| 28 | 213846_at | HG-U133A | AA382702 | 28 | cytochrome c oxidase subunit VIIc | COX7C | 1350 | | – | resp | 30 |
| 29 | 225795_at | HG-U133B | AV751709 | 19 | hypothetical gene supported by AL449243 | LOC91689 | 91689 | | – | resp | 30 |
| 30 | 200036_s_at | HG-U133A | NM_007104 | 20 | ribosomal protein L10a | RPL10A | 4736 | | – | resp | 31 |
| 31 | 200034_s_at | HG-U133B | NM_000970 | 29 | ribosomal protein L6 | RPL6 | 6128 | | – | resp | 32 |
| 32 | 211938_at | HG-U133A | BF247371 | 30 | eukaryotic translation initiation factor 4B | EIF4B | 1975 | | – | resp | 32 |
| 33 | 227141_at | HG-U133B | AW205739 | 31 | hypothetical protein BC009514 | LOC127253 | 127253 | | – | resp | 34 |
| 34 | 225230_at | HG-U133B | AI735261 | 32 | hypothetical protein MGC54289 | MGC54289 | 128338 | | – | resp | 35 |
| 35 | 208697_s_at | HG-U133A | BC000734 | 33 | eukaryotic translation initiation factor 3, subunit 6 48 kDa | EIF3S6 | 3646 | | – | resp | 36 |
| 36 | 200005_at | HG-U133A | NM_003753 | 34 | eukaryotic translation initiation factor 3, subunit 7 zeta, 66/67 kDa | EIF3S7 | 8664 | | – | resp | 44 |
| 37 | 209058_at | HG-U133A | AB002282 | 35 | endothelial differentiation-related factor 1 | EDF1 | 8721 | | – | resp | 47 |
| 38 | 201134_x_at | HG-U133A | NM_001867 | 36 | cytochrome c oxidase subunit VIIc | COX7C | 1350 | | – | resp | 48 |
| 39 | 225951_s_at | HG-U133B | AV756026 | 37 | LOC440309 | | 440309 | | – | resp | 49 |
| 40 | 216342_x_at | HG-U133A | AL121916 | 38 | | | | | – | resp | 50 |

TABLE 1A-continued

| Predictive Markers Upregulated Indicators of Non-Response and/or Short Time to Progression | | | | | | | | | | | |
|---|---|---|---|---|---|---|---|---|---|---|---|
| No. | ProbeSet ID | chip | Rep Public ID | SEQ ID NO: | Title | Gene Symbol | Entrez Gene ID | TTP marker | Response marker | Type of specificity | Rank |
| 41 | 221475_s_at | HG-U133A | NM_002948 | 39 | ribosomal protein L15 | RPL15 | 6138 | | – | resp | 50 |
| 42 | 200029_at | HG-U133B | NM_000981 | 40 | ribosomal protein L19 | RPL19 | 6143 | | – | resp | 55 |
| 43 | 201773_at | HG-U133A | NM_015339 | 41 | activity-dependent neuroprotector | ADNP | 23394 | | – | resp | 56 |
| 44 | 200858_s_at | HG-U133A | NM_001012 | 42 | ribosomal protein S8 | RPS8 | 6202 | | – | resp | 57 |
| 45 | 200005_at | HG-U133B | NM_003753 | 34 | eukaryotic translation initiation factor 3, subunit 7 zeta, 66/67 kDa | EIF3S7 | 8664 | | – | resp | 58 |
| 46 | 200981_x_at | HG-U133A | NM_016592 | 43 | GNAS complex locus | GNAS | 2778 | | – | resp | 59 |
| 47 | 203484_at | HG-U133A | NM_014302 | 44 | Sec61 gamma subunit | SEC61G | 23480 | | – | resp | 60 |
| 48 | 200074_s_at | HG-U133A | U16738 | 15 | ribosomal protein L14 | RPL14 | 9045 | | – | resp | 61 |
| 49 | 224196_x_at | HG-U133B | AF161492 | 45 | CGI-30 protein | CGI-30 | 51611 | | – | resp | 61 |
| 50 | 228622_s_at | HG-U133B | AW071239 | 46 | DnaJ (Hsp40) homolog, subfamily C, member 4 | DNAJC4 | 3338 | | – | resp | 61 |
| 51 | 208635_x_at | HG-U133A | BF976260 | 47 | nascent-polypeptide-associated complex alpha polypeptide | NACA | 4666 | | – | resp | 62 |
| 52 | 200705_s_at | HG-U133A | NM_001959 | 48 | eukaryotic translation elongation factor 1 beta 2 | EEF1B2 | 1933 | | – | resp | 66 |
| 53 | 200010_at | HG-U133B | NM_000975 | 27 | ribosomal protein L11 | RPL11 | 6135 | | – | resp | 67 |
| 54 | 200013_at | HG-U133A | NM_000986 | 49 | ribosomal protein L24 | RPL24 | 6152 | | – | resp | 69 |
| 55 | 200099_s_at | HG-U133B | AL356115 | 50 | ribosomal protein S3A | RPS3A | 6189 | | – | resp | 71 |
| 56 | 200025_s_at | HG-U133B | NM_000988 | 51 | ribosomal protein L27 | RPL27 | 6155 | | – | resp | 74 |
| 57 | 200091_s_at | HG-U133B | AA888388 | 24 | ribosomal protein S25 | RPS25 | 6230 | | – | resp | 75 |
| 58 | 202231_at | HG-U133A | NM_006360 | 52 | dendritic cell protein | GA17 | 10480 | | – | resp | 76 |
| 59 | 217408_at | HG-U133A | AL050361 | 53 | mitochondrial ribosomal protein S18B | MRPS18B | 28973 | | – | resp | 76 |
| 60 | 200626_s_at | HG-U133A | NM_018834 | 54 | matrin 3 | MATR3 | 9782 | | – | resp | 78 |
| 61 | 213762_x_at | HG-U133A | AI452524 | 55 | RNA binding motif protein, X-linked | RBMX | 27316 | | – | resp | 80 |
| 62 | 200081_s_at | HG-U133B | BE741754 | 56 | ribosomal protein S6 | RPS6 | 6194 | | – | resp | 81 |
| 63 | 213890_x_at | HG-U133A | AI200589 | 57 | ribosomal protein S16 | RPS16 | 6217 | | – | resp | 81 |
| 64 | 200099_s_at | HG-U133A | AL356115 | 50 | ribosomal protein S3A | RPS3A | 6189 | | – | resp | 83 |
| 65 | 200002_at | HG-U133B | NM_007209 | 58 | ribosomal protein L35 | RPL35 | 11224 | | – | resp | 87 |
| 66 | 200062_s_at | HG-U133A | L05095 | 59 | ribosomal protein L30 | RPL30 | 6156 | | – | resp | 87 |
| 67 | 200013_at | HG-U133B | NM_000986 | 49 | ribosomal protein L24 | RPL24 | 6152 | | – | resp | 88 |
| 68 | 200018_at | HG-U133B | NM_001017 | 13 | ribosomal protein S13 | RPS13 | 6207 | | – | resp | 91 |
| 69 | 201622_at | HG-U133A | NM_014390 | 60 | staphylococcal nuclease domain containing 1 | SND1 | 27044 | | – | resp | 92 |
| 70 | 200029_at | HG-U133A | NM_000981 | 40 | ribosomal protein L19 | RPL19 | 6143 | | – | resp | 93 |
| 71 | 223015_at | HG-U133B | AF212241 | 61 | eukaryotic translation initiation factor (eIF) 2A | eIF2A | 83939 | | – | resp | 94 |
| 72 | 200624_s_at | HG-U133A | AA577695 | 62 | matrin 3 | MATR3 | 9782 | | – | resp | 96 |
| 73 | 212600_s_at | HG-U133A | AV727381 | 63 | ubiquinol-cytochrome c reductase core protein II | UQCRC2 | 7385 | | – | resp | 97 |
| 74 | 200034_s_at | HG-U133A | NM_000970 | 29 | ribosomal protein L6 | RPL6 | 6128 | | – | resp | 99 |
| 75 | 212042_x_at | HG-U133A | BG389744 | 64 | ribosomal protein L7 | RPL7 | 6129 | | – | resp | 99 |
| 76 | 208319_s_at | HG-U133A | NM_006743 | 65 | RNA binding motif (RNP1, RRM) protein 3 | RBM3 | 5935 | | – | resp | 100 |
| 77 | 226296_s_at | HG-U133B | AK021626 | 66 | mitochondrial ribosomal protein S15 | MRPS15 | 64960 | | – | resp | 101 |
| 78 | 223245_at | HG-U133B | AK024285 | 67 | spermatid perinuclear RNA binding protein | STRBP | 55342 | | – | resp | 102 |
| 79 | 200735_x_at | HG-U133A | NM_005594 | 68 | nascent-polypeptide-associated complex alpha polypeptide | NACA | 4666 | | – | resp | 103 |
| 80 | 201600_at | HG-U133A | NM_007273 | 69 | repressor of estrogen receptor activity | REA | 11331 | | – | resp | 109 |
| 81 | 203857_s_at | HG-U133A | NM_006810 | 70 | for protein disulfide isomerase-related | PDIR | 10954 | | – | resp | 109 |
| 82 | 212826_s_at | HG-U133A | AI961224 | 71 | solute carrier family 25 (mitochondrial carrier; adenine nucleotide translocator), member 6 | SLC25A6 | 293 | | – | resp | 111 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 83 | 203621_at | HG-U133A | NM_002492 | 72 | NADH dehydrogenase (ubiquinone) 1 beta subcomplex, 5, 16 kDa | NDUFB5 | 4711 | | – | resp | 112 |
| 84 | 200963_x_at | HG-U133A | NM_000993 | 73 | ribosomal protein L31 | RPL31 | 6160 | | – | resp | 113 |
| 85 | 200909_s_at | HG-U133A | NM_001004 | 74 | ribosomal protein, large P2 | RPLP2 | 6181 | | – | resp | 114 |
| 86 | 217768_at | HG-U133A | NM_016039 | 75 | chromosome 14 open reading frame 166 | C14orf166 | 51637 | | – | resp | 115 |
| 87 | 200936_at | HG-U133A | NM_000973 | 76 | ribosomal protein L8 | RPL8 | 6132 | | – | resp | 117 |
| 88 | 214800_x_at | HG-U133A | R83000 | 77 | basic transcription factor 3 | BTF3 | 689 | | – | resp | 119 |
| 89 | 224935_at | HG-U133B | BG165815 | 78 | Eukaryotic translation initiation factor 2, subunit 3 gamma, 52 kDa | EIF2S3 | 1968 | | – | resp | 123 |
| 90 | 200823_x_at | HG-U133A | NM_000992 | 79 | ribosomal protein L29 | RPL29 | 6159 | | – | resp | 125 |
| 91 | 216520_s_at | HG-U133A | AF072098 | 80 | tumor protein, translationally-controlled 1 | TPT1 | 7178 | | – | resp | 126 |
| 92 | 207040_s_at | HG-U133A | NM_003932 | 81 | suppression of tumorigenicity 13 (colon carcinoma) (Hsp70 interacting protein) | ST13 | 6767 | | – | resp | 127 |
| 93 | 222993_at | HG-U133B | AF325707 | 82 | mitochondrial ribosomal protein L37 | MRPL37 | 51253 | | – | resp | 127 |
| 94 | 200016_x_at | HG-U133B | NM_002136 | 83 | heterogeneous nuclear ribonucleoprotein A1 | HNRPA1 | 3178 | | – | resp | 128 |
| 95 | 202233_s_at | HG-U133A | NM_006004 | 84 | ubiquinol-cytochrome c reductase hinge protein | UQCRH | 7388 | | – | resp | 128 |
| 96 | 217673_x_at | HG-U133A | AA650558 | 85 | GNAS complex locus | GNAS | 2778 | | – | resp | 130 |
| 97 | 202515_at | HG-U133A | BG251175 | 86 | discs, large homolog 1 (*Drosophila*) | DLG1 | 1739 | | – | resp | 131 |
| 98 | 212967_x_at | HG-U133A | AW148801 | 87 | nucleosome assembly protein 1-like 1 | NAP1L1 | 4673 | | – | resp | 131 |
| 99 | 218213_s_at | HG-U133A | NM_014206 | 88 | chromosome 11 open reading frame 10 | C11orf10 | 746 | | – | resp | 133 |
| 100 | 228095_at | HG-U133B | AA608749 | 89 | | | | | – | resp | 133 |
| 101 | 200062_s_at | HG-U133B | L05095 | 59 | ribosomal protein L30 | RPL30 | 6156 | | – | resp | 134 |
| 102 | 212273_x_at | HG-U133A | AI591100 | 90 | GNAS complex locus | GNAS | 2778 | | – | resp | 135 |
| 103 | 200055_at | HG-U133B | NM_006284 | 91 | TAF10 RNA polymerase II, TATA box binding protein (TBP)-associated factor, 30 kDa | TAF10 | 6881 | | – | resp | 136 |
| 104 | 222832_s_at | HG-U133B | AA746206 | 92 | chromosome 2 open reading frame 33 | C2orf33 | 56947 | | – | resp | 136 |
| 105 | 218147_s_at | HG-U133A | NM_018446 | 93 | glycosyltransferase 8 domain containing 1 | GLT8D1 | 55830 | | – | resp | 137 |
| 106 | 217927_at | HG-U133A | NM_014041 | 94 | signal peptidase complex subunit 1 homolog (*S. cerevisiae*) | SPCS1 | 28972 | | – | resp | 139 |
| 107 | 200651_at | HG-U133A | NM_006098 | 95 | guanine nucleotide binding protein (G protein), beta polypeptide 2-like 1 | GNB2L1 | 10399 | | – | resp | 140 |
| 108 | 201894_s_at | HG-U133A | NM_001920 | 96 | signal sequence receptor, alpha (translocon-associated protein alpha) | SSR1 | 6745 | | – | resp | 140 |
| 109 | 201812_s_at | HG-U133A | NM_019059 | 97 | translocase of outer mitochondrial membrane 7 homolog (yeast) /// hypothetical protein LOC201725 | TOMM7 /// LOC201725 | 201725 /// 54543 | | – | resp | 141 |
| 110 | 208717_at | HG-U133A | BC001669 | 98 | oxidase (cytochrome c) assembly 1-like | OXA1L | 5018 | | – | resp | 144 |
| 111 | 212995_x_at | HG-U133A | BG255188 | 99 | hypothetical protein FLJ14346 | FLJ14346 | 80097 | | – | resp | 145 |
| 112 | 203113_s_at | HG-U133A | NM_001960 | 100 | eukaryotic translation elongation factor 1 delta (guanine nucleotide exchange protein) | EEF1D | 1936 | | – | resp | 147 |
| 113 | 213041_s_at | HG-U133A | BE798517 | 101 | ATP synthase, H+ transporting, mitochondrial F1 complex, delta subunit | ATP5D | 513 | | – | resp | 147 |
| 114 | 204944_at | HG-U133A | NM_002841 | 102 | protein tyrosine phosphatase, receptor type, G | PTPRG | 5793 | | – | resp | 149 |
| 115 | 224615_x_at | HG-U133B | AL110115 | 103 | histocompatibility (minor) 13 | HM13 | 81502 | | – | resp | 149 |
| 116 | 225547_at | HG-U133B | BG169443 | 104 | U87HG mRNA, complete sequence | | | | – | resp | 150 |
| 117 | 223671_x_at | HG-U133B | AF248965 | 105 | CGI-30 protein | CGI-30 | 51611 | | – | resp | 151 |
| 118 | 214042_s_at | HG-U133A | AW071997 | 106 | ribosomal protein L22 | RPL22 | 6146 | | – | resp | 152 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 119 | 200094_s_at | HG-U133B | AI004246 | 107 | eukaryotic translation elongation factor 2 | EEF2 | 1938 | | – | resp | 153 |
| 120 | 200017_at | HG-U133B | NM_002954 | 4 | ribosomal protein S27a | RPS27A | 6233 | | – | resp | 154 |
| 121 | 200012_x_at | HG-U133B | NM_000982 | 108 | ribosomal protein L21 | RPL21 | 6144 | | – | resp | 156 |
| 122 | 200016_x_at | HG-U133A | NM_002136 | 83 | heterogeneous nuclear ribonucleoprotein A1 | HNRPA1 | 3178 | | – | resp | 157 |
| 123 | 224523_s_at | HG-U133B | BC006475 | 109 | hypothetical protein MGC4308 | MGC4308 | 84319 | | – | resp | 157 |
| 124 | 204102_s_at | HG-U133A | NM_001961 | 110 | eukaryotic translation elongation factor 2 | EEF2 | 1938 | | – | resp | 161 |
| 125 | 200025_s_at | HG-U133A | NM_000988 | 51 | ribosomal protein L27 | RPL27 | 6155 | | – | resp | 162 |
| 126 | 221263_s_at | HG-U133A | NM_031287 | 111 | splicing factor 3b, subunit 5, 10 kDa | SF3B5 | 83443 | | – | resp | 163 |
| 127 | 210027_s_at | HG-U133A | M80261 | 112 | APEX nuclease (multifunctional DNA repair enzyme) 1 | APEX1 | 328 | | – | resp | 164 |
| 128 | 220994_s_at | HG-U133A | NM_014178 | 113 | syntaxin binding protein 6 (amisyn) | STXBP6 | 29091 | | – | resp | 166 |
| 129 | 209397_at | HG-U133A | BC000147 | 114 | malic enzyme 2, NAD(+)-dependent, mitochondrial | ME2 | 4200 | | – | resp | 167 |
| 130 | 223847_s_at | HG-U133B | AF267855 | 115 | endoplasmic reticulum-golgi intermediate compartment 32 kDa protein | KIAA1181 | 57222 | | – | resp | 168 |
| 131 | 223246_s_at | HG-U133B | BC002693 | 116 | spermatid perinuclear RNA binding protein | STRBP | 55342 | | – | resp | 169 |
| 132 | 224439_x_at | HG-U133B | BC005966 | 117 | ring finger protein 7 | RNF7 | 9616 | | – | resp | 169 |
| 133 | 211666_x_at | HG-U133A | L22453 | 118 | ribosomal protein L3 | RPL3 | 6122 | | – | resp | 171 |
| 134 | 218101_s_at | HG-U133A | NM_004549 | 119 | NADH dehydrogenase (ubiquinone) 1, subcomplex unknown, 2, 14.5 kDa | NDUFC2 | 4718 | | – | resp | 172 |
| 135 | 207628_s_at | HG-U133A | NM_017528 | 120 | Williams Beuren syndrome chromosome region 22 | WBSCR22 | 114049 | | – | resp | 173 |
| 136 | 200093_s_at | HG-U133B | N32864 | 121 | histidine triad nucleotide binding protein 1 | HINT1 | 3094 | | – | resp | 174 |
| 137 | 201106_at | HG-U133A | NM_002085 | 122 | glutathione peroxidase 4 (phospholipid hydroperoxidase) | GPX4 | 2879 | | – | resp | 174 |
| 138 | 201593_s_at | HG-U133A | AV716798 | 123 | likely ortholog of mouse immediate early response, erythropoietin 4 | LEREPO4 | 55854 | | – | resp | 175 |
| 139 | 211971_s_at | HG-U133A | AI653608 | 124 | leucine-rich PPR-motif containing | LRPPRC | 10128 | | – | resp | 178 |
| 140 | 214173_x_at | HG-U133A | AW514900 | 125 | chromosome 19 open reading frame 2 | C19orf2 | 8725 | | – | resp | 178 |
| 141 | 208887_at | HG-U133A | BC000733 | 126 | eukaryotic translation initiation factor 3, subunit 4 delta, 44 kDa | EIF3S4 | 8666 | | – | resp | 180 |
| 142 | 216570_x_at | HG-U133A | AL096829 | 127 | | | | | – | resp | 181 |
| 143 | 212085_at | HG-U133A | AA916851 | 128 | solute carrier family 25 (mitochondrial carrier; adenine nucleotide translocator), member 6 | SLC25A6 | 293 | | – | resp | 182 |
| 144 | 218927_s_at | HG-U133A | NM_018641 | 129 | carbohydrate (chondroitin 4) sulfotransferase 12 | CHST12 | 55501 | | – | resp | 183 |
| 145 | 235721_at | HG-U133B | N62126 | 130 | deltex 3 homolog (*Drosophila*) | DTX3 | 196403 | | – | resp | 184 |
| 146 | 218146_at | HG-U133A | NM_018446 | 93 | glycosyltransferase 8 domain containing 1 | GLT8D1 | 55830 | | – | resp | 185 |
| 147 | 200094_s_at | HG-U133A | AI004246 | 107 | eukaryotic translation elongation factor 2 | EEF2 | 1938 | | – | resp | 186 |
| 148 | 211662_s_at | HG-U133A | L08666 | 131 | voltage-dependent anion channel 2 | VDAC2 | 7417 | | – | resp | 186 |
| 149 | 218774_at | HG-U133A | NM_014026 | 132 | decapping enzyme, scavenger | DCPS | 28960 | | – | resp | 188 |
| 150 | 227558_at | HG-U133B | AI570531 | 133 | chromobox homolog 4 (Pc class homolog, *Drosophila*) | CBX4 | 8535 | | – | resp | 190 |
| 151 | 209059_s_at | HG-U133A | AB002282 | 35 | endothelial differentiation-related factor 1 | EDF1 | 8721 | | – | resp | 191 |
| 152 | 201784_s_at | HG-U133A | NM_014267 | 134 | small acidic protein | SMAP | 10944 | | – | resp | 192 |
| 153 | 218495_at | HG-U133A | NM_004182 | 135 | ubiquitously-expressed transcript | UXT | 8409 | | – | resp | 193 |
| 154 | 218684_at | HG-U133A | NM_018103 | 136 | leucine rich repeat containing 5 | LRRC5 | 55144 | | – | resp | 194 |
| 155 | 200967_at | HG-U133A | NM_000942 | 137 | peptidylprolyl isomerase B (cyclophilin B) | PPIB | 5479 | | – | resp | 196 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 156 | 219293_s_at | HG-U133A | NM_013341 | 138 | GTP-binding protein PTD004 | PTD004 | 29789 | | – | resp | 200 |
| 157 | 213864_s_at | HG-U133A | AI985751 | 139 | nucleosome assembly protein 1-like 1 | NAP1L1 | 4673 | | – | resp | 202 |
| 158 | 217926_at | HG-U133A | NM_014047 | 140 | HSPC023 protein | HSPC023 | 28974 | | – | resp | 205 |
| 159 | 208746_x_at | HG-U133A | AF070655 | 141 | ATP synthase, H+ transporting, mitochondrial F0 complex, subunit g | ATP5L | 10632 | | – | resp | 207 |
| 160 | 229742_at | HG-U133B | AA420989 | 142 | hypothetical LOC145853 | LOC145853 | 145853 | | – | resp | 207 |
| 161 | 207585_s_at | HG-U133A | NM_001001 | 143 | ribosomal protein L36a-like | RPL36AL | 6166 | | – | resp | 208 |
| 162 | 214271_x_at | HG-U133A | AA281332 | 144 | ribosomal protein L12 | RPL12 | 6136 | | – | resp | 210 |
| 163 | 213080_x_at | HG-U133A | BF214492 | 145 | ribosomal protein L5 | RPL5 | 6125 | | – | resp | 213 |
| 164 | 222229_x_at | HG-U133A | AL121871 | 146 | ribosomal protein L26 /// similar to 60S ribosomal protein L26 LOC441073 | RPL26 /// LOC400055 /// 6154 | 400055 /// 441073 /// | | – | resp | 213 |
| 165 | 224932_at | HG-U133B | AI814909 | 147 | chromosome 22 open reading frame 16 | C22orf16 | 400916 | | – | resp | 214 |
| 166 | 200055_at | HG-U133A | NM_006284 | 91 | TAF10 RNA polymerase II, TATA box binding protein (TBP)-associated factor, 30 kDa | TAF10 | 6881 | | – | resp | 215 |
| 167 | 225220_at | HG-U133B | BF340290 | 148 | CDNA clone IMAGE: 4184613, partial cds | | | | – | resp | 218 |
| 168 | 221476_s_at | HG-U133A | AF279903 | 149 | ribosomal protein L15 | RPL15 | 6138 | | – | resp | 219 |
| 169 | 223165_s_at | HG-U133B | BC004469 | 150 | inositol hexaphosphate kinase 2 | IHPK2 | 51447 | | – | resp | 221 |
| 170 | 229803_s_at | HG-U133B | AI347000 | 151 | Nudix (nucleoside diphosphate linked moiety X)-type motif 3 | NUDT3 | 11165 | | – | resp | 223 |
| 171 | 200048_s_at | HG-U133B | NM_006694 | 152 | jumping translocation breakpoint | JTB | 10899 | | – | resp | 228 |
| 172 | 209330_s_at | HG-U133A | D55674 | 153 | heterogeneous nuclear ribonucleoprotein D (AU-rich element RNA binding protein 1, 37 kDa) | HNRPD | 3184 | | – | resp | 230 |
| 173 | 213860_x_at | HG-U133A | AW268585 | 154 | casein kinase 1, alpha 1 | CSNK1A1 | 1452 | | – | resp | 231 |
| 174 | 200006_at | HG-U133A | NM_007262 | 155 | Parkinson disease (autosomal recessive, early onset) 7 | PARK7 | 11315 | | – | resp | 232 |
| 175 | 213086_s_at | HG-U133A | BF341845 | 156 | casein kinase 1, alpha 1 | CSNK1A1 | 1452 | | – | resp | 232 |
| 176 | 226131_s_at | HG-U133B | AA583817 | 157 | ribosomal protein S16 | RPS16 | 6217 | | – | resp | 235 |
| 177 | 200038_s_at | HG-U133A | NM_000985 | 158 | ribosomal protein L17 | RPL17 | 6139 | | – | resp | 237 |
| 178 | 208620_at | HG-U133A | U24223 | 159 | poly(rC) binding protein 1 | PCBP1 | 5093 | | – | resp | 238 |
| 179 | 200811_at | HG-U133A | NM_001280 | 160 | cold inducible RNA binding protein | CIRBP | 1153 | | – | resp | 239 |
| 180 | 208669_s_at | HG-U133A | AF109873 | 161 | CREBBP/EP300 inhibitor 1 | CRI1 | 23741 | | – | resp | 240 |
| 181 | 215227_x_at | HG-U133A | BG035989 | 162 | acid phosphatase 1, soluble | ACP1 | 52 | | – | resp | 244 |
| 182 | 202961_s_at | HG-U133A | NM_004889 | 163 | ATP synthase, H+ transporting, mitochondrial F0 complex, subunit f, isoform 2 | ATP5J2 | 9551 | | – | resp | 247 |
| 183 | 200048_s_at | HG-U133A | NM_006694 | 152 | jumping translocation breakpoint | JTB | 10899 | | – | resp | 248 |
| 184 | 200093_s_at | HG-U133A | N32864 | 121 | histidine triad nucleotide binding protein 1 | HINT1 | 3094 | | – | resp | 250 |
| 185 | 209009_at | HG-U133A | BC001169 | 164 | esterase D/formylglutathione hydrolase | ESD | 2098 | | – | resp | 252 |
| 186 | 202649_x_at | HG-U133A | NM_001022 | 165 | ribosomal protein S19 | RPS19 | 6223 | | – | resp | 254 |
| 187 | 213801_x_at | HG-U133A | AW304232 | 166 | ribosomal protein SA /// similar to Laminin receptor 1 | RPSA /// LOC388524 | 388524 /// 3921 | | – | resp | 254 |
| 188 | 222580_at | HG-U133B | AK023596 | 167 | zinc finger protein 644 | ZNF644 | 84146 | | – | resp | 256 |
| 189 | 200669_s_at | HG-U133A | NM_003340 | 168 | ubiquitin-conjugating enzyme E2D 3 (UBC4/5 homolog, yeast) | UBE2D3 | 7323 | | – | resp | 257 |
| 190 | 200038_s_at | HG-U133B | NM_000985 | 158 | ribosomal protein L17 | RPL17 | 6139 | | – | resp | 258 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 191 | 222412_s_at | HG-U133B | AW150923 | 169 | signal sequence receptor, gamma (translocon-associated protein gamma) | SSR3 | 6747 | | – | resp | 259 |
| 192 | 201001_s_at | HG-U133A | BG164064 | 170 | ubiquitin-conjugating enzyme E2 variant 1 | UBE2V1 /// Kua-UEV | 387522 /// 7335 | | – | resp | 260 |
| 193 | 209150_s_at | HG-U133A | U94831 | 171 | transmembrane 9 superfamily member 1 | TM9SF1 | 10548 | | – | resp | 263 |
| 194 | 216559_x_at | HG-U133A | AL050348 | 172 | heterogeneous nuclear ribonucleoprotein 1 | HNRPA1 | 3178 | | – | resp | 265 |
| 195 | 225063_at | HG-U133B | BF568780 | 173 | bone marrow stromal cell-derived ubiquitin-like | BMSC-UbP | 84993 | | – | resp | 269 |
| 196 | 217790_s_at | HG-U133A | NM_007107 | 174 | signal sequence receptor, gamma (translocon-associated protein gamma) | SSR3 | 6747 | | – | resp | 271 |
| 197 | 211942_x_at | HG-U133A | BF979419 | 175 | ribosomal protein L13a | RPL13A | 23521 | | – | resp | 275 |
| 198 | 212716_s_at | HG-U133A | AW083133 | 176 | eukaryotic translation initiation factor 3, subunit 12 | EIF3S12 | 27335 | | – | resp | 275 |
| 199 | 200990_at | HG-U133A | NM_005762 | 177 | tripartite motif-containing 28 | TRIM28 | 10155 | | – | resp | 276 |
| 200 | 239082_at | HG-U133B | BF437161 | 178 | | | | | – | resp | 276 |
| 201 | 224577_at | HG-U133B | AB033007 | 179 | endoplasmic reticulum-golgi intermediate compartment 32 kDa protein | KIAA1181 | 57222 | | – | resp | 278 |
| 202 | 202785_at | HG-U133A | NM_005001 | 180 | NADH dehydrogenase (ubiquinone) 1 alpha subcomplex, 7, 14.5 kDa | NDUFA7 | 4701 | | – | resp | 279 |
| 203 | 213356_x_at | HG-U133A | AL568186 | 181 | heterogeneous nuclear ribonucleoprotein A1 /// similar to Heterogeneous nuclear ribonucleoprotein A1 (Helix-destabilizing protein) (Single-strand binding protein) (hnRNP core protein A1) (HDP) | HNRPA1 /// LOC441507 | 3178 /// 441507 | | – | resp | 279 |
| 204 | 200726_at | HG-U133A | NM_002710 | 182 | protein phosphatase 1, catalytic subunit, gamma isoform | PPP1CC | 5501 | | – | resp | 280 |
| 205 | 201781_s_at | HG-U133A | AL558532 | 183 | aryl hydrocarbon receptor interacting protein | AIP | 9049 | | – | resp | 282 |
| 206 | 227711_at | HG-U133B | BG150433 | 184 | hypothetical protein FLJ32942 | FLJ32942 | 121355 | | – | resp | 283 |
| 207 | 201002_s_at | HG-U133A | U39361 | 185 | ubiquitin-conjugating enzyme E2 variant 1 | UBE2V1 /// Kua-UEV | 387522 /// 7335 | | – | resp | 284 |
| 208 | 200032_s_at | HG-U133B | NM_000661 | 186 | ribosomal protein L9 | RPL9 | 6133 | | – | resp | 285 |
| 209 | 227134_at | HG-U133B | AI341537 | 187 | synaptotagmin-like 1 | SYTL1 | 84958 | | – | resp | 288 |
| 210 | 213129_s_at | HG-U133A | AI970157 | 188 | glycine cleavage system protein H (aminomethyl carrier) | GCSH | 2653 | | – | resp | 292 |
| 211 | 225706_at | HG-U133B | AI761989 | 189 | glucocorticoid induced transcript 1 | GLCCI1 | 113263 | | – | resp | 293 |
| 212 | 200002_at | HG-U133A | NM_007209 | 58 | ribosomal protein L35 | RPL35 | 11224 | | – | resp | 294 |
| 213 | 223193_x_at | HG-U133B | AF201944 | 190 | growth and transformation-dependent protein | E2IG5 | 26355 | | – | resp | 297 |
| 214 | 200022_at | HG-U133B | NM_000979 | 191 | ribosomal protein L18 | RPL18 | 6141 | | – | resp | 298 |
| 215 | 200088_x_at | HG-U133A | AK026491 | 25 | ribosomal protein L12 | RPL12 | 6136 | | – | resp | 299 |
| 216 | 225700_at | HG-U133B | AC006042 | 192 | glucocorticoid induced transcript 1 | GLCCI1 | 113263 | | – | resp | 300 |
| 217 | 209787_s_at | HG-U133A | BC001282 | 193 | high mobility group nucleosomal binding domain 4 | HMGN4 | 10473 | | – | resp | 301 |
| 218 | 200081_s_at | HG-U133A | BE741754 | 56 | ribosomal protein S6 | RPS6 | 6194 | | – | resp | 303 |
| 219 | 224345_x_at | HG-U133B | AF107495 | 194 | growth and transformation-dependent protein | E2IG5 | 26355 | | – | resp | 304 |
| 220 | 209329_x_at | HG-U133A | BC000587 | 195 | hypothetical protein MGC2198 | MGC2198 | 192286 | | – | resp | 307 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 221 | 217773_s_at | HG-U133A | NM_002489 | 196 | NADH dehydrogenase (ubiquinone) 1 alpha subcomplex, 4, 9 kDa | NDUFA4 | 4697 | | – | resp | 308 |
| 222 | 201665_x_at | HG-U133A | NM_001021 | 197 | ribosomal protein S17 | RPS17 | 6218 | | – | resp | 309 |
| 223 | 200674_s_at | HG-U133A | NM_000994 | 198 | ribosomal protein L32 | RPL32 | 6161 | | – | resp | 311 |
| 224 | 202209_at | HG-U133A | NM_014463 | 199 | LSM3 homolog, U6 small nuclear RNA associated (*S. cerevisiae*) | LSM3 | 27258 | | – | resp | 311 |
| 225 | 229563_s_at | HG-U133B | BG231561 | 200 | ribosomal protein L10a | RPL10A | 4736 | | – | resp | 312 |
| 226 | 200057_s_at | HG-U133B | NM_007363 | 201 | non-POU domain containing, octamer-binding | NONO | 4841 | | – | resp | 313 |
| 227 | 212352_s_at | HG-U133A | BE780075 | 202 | transmembrane trafficking protein | TMP21 | 10972 | | – | resp | 313 |
| 228 | 221972_s_at | HG-U133A | AL571362 | 203 | calcium binding protein Cab45 precursor | Cab45 | 51150 | | – | resp | 314 |
| 229 | 226386_at | HG-U133B | BG397444 | 204 | chromosome 7 open reading frame 30 | C7orf30 | 115416 | | – | resp | 315 |
| 230 | 200741_s_at | HG-U133A | NM_001030 | 205 | ribosomal protein S27 (metallopanstimulin 1) | RPS27 | 6232 | | – | resp | 317 |
| 231 | 226073_at | HG-U133B | BE857362 | 206 | hypothetical protein LOC219854 | LOC219854 | 219854 | | – | resp | 318 |
| 232 | 238026_at | HG-U133B | AI458020 | 207 | | | | | – | resp | 318 |
| 233 | 207871_s_at | HG-U133A | NM_018412 | 208 | suppression of tumorigenicity 7 | ST7 | 7982 | | – | resp | 323 |
| 234 | 213376_at | HG-U133A | AI656706 | 209 | zinc finger and BTB domain containing 1 | ZBTB1 | 22890 | | – | resp | 323 |
| 235 | 200891_s_at | HG-U133A | NM_003144 | 210 | signal sequence receptor, alpha (translocon-associated protein alpha) | SSR1 | 6745 | | – | resp | 324 |
| 236 | 223157_at | HG-U133B | BC004894 | 211 | chromosome 4 open reading frame 14 | C4orf14 | 84273 | | – | resp | 324 |
| 237 | 225606_at | HG-U133B | AI949179 | 212 | BCL2-like 11 (apoptosis facilitator) | BCL2L11 | 10018 | | – | resp | 327 |
| 238 | 200968_s_at | HG-U133A | NM_000942 | 137 | peptidylprolyl isomerase B (cyclophilin B) | PPIB | 5479 | | – | resp | 328 |
| 239 | 213414_s_at | HG-U133A | BE259729 | 213 | ribosomal protein S19 | RPS19 | 6223 | | – | resp | 330 |
| 240 | 226845_s_at | HG-U133B | AL036350 | 214 | helicase/primase complex protein | LOC150678 | 150678 | | – | resp | 331 |
| 241 | 212460_at | HG-U133A | BE738425 | 215 | chromosome 14 open reading frame 147 | C14orf147 | 171546 | | – | resp | 332 |
| 242 | 231530_s_at | HG-U133B | BG150085 | 216 | chromosome 11 open reading frame 1 | C11orf1 | 64776 | | – | resp | 332 |
| 243 | 219762_s_at | HG-U133A | NM_015414 | 217 | ribosomal protein L36 | RPL36 | 25873 | | – | resp | 333 |
| 244 | 213897_s_at | HG-U133A | AI832239 | 218 | mitochondrial ribosomal protein L23 | MRPL23 | 6150 | | – | resp | 335 |
| 245 | 200682_s_at | HG-U133A | BG531983 | 219 | ubiquitin-conjugating enzyme E2L 3 | UBE2L3 | 7332 | | – | resp | 342 |
| 246 | 203338_at | HG-U133A | NM_006246 | 220 | protein phosphatase 2, regulatory subunit B (B56), epsilon isoform | PPP2R5E | 5529 | | – | resp | 343 |
| 247 | 224936_at | HG-U133B | BE252813 | 221 | eukaryotic translation initiation factor 2, subunit 3 gamma, 52 kDa | EIF2S3 | 1968 | | – | resp | 343 |
| 248 | 228690_s_at | HG-U133B | AI743115 | 222 | NADH dehydrogenase (ubiquinone) 1 alpha subcomplex, 11, 14.7 kDa | NDUFA11 | 126328 | | – | resp | 344 |
| 249 | 208645_s_at | HG-U133A | AF116710 | 223 | ribosomal protein S14 | RPS14 | 6208 | | – | resp | 345 |
| 250 | 202737_s_at | HG-U133A | NM_012321 | 224 | LSM4 homolog, U6 small nuclear RNA associated (*S. cerevisiae*) | LSM4 | 25804 | | – | resp | 346 |
| 251 | 212790_x_at | HG-U133A | BF942308 | 225 | ribosomal protein L13a | RPL13A | 23521 | | – | resp | 346 |
| 252 | 227126_at | HG-U133B | AI857788 | 226 | Transcribed locus | | | | – | resp | 347 |
| 253 | 200707_at | HG-U133A | NM_002743 | 227 | protein kinase C substrate 80K-H | PRKCSH | 5589 | | – | resp | 349 |
| 254 | 226453_at | HG-U133B | BF982002 | 228 | AYP1 protein | AYP1 | 84153 | | – | resp | 350 |
| 255 | 223191_at | HG-U133B | AF151037 | 229 | chromosome 14 open reading frame 112 | C14orf112 | 51241 | | – | resp | 352 |
| 256 | 204246_s_at | HG-U133A | NM_007234 | 230 | dynactin 3 (p22) | DCTN3 | 11258 | | – | resp | 353 |
| 257 | 208907_s_at | HG-U133A | BC005373 | 231 | mitochondrial ribosomal protein S18B | MRPS18B | 28973 | | – | resp | 353 |
| 258 | 203095_at | HG-U133A | NM_002453 | 232 | mitochondrial translational initiation factor 2 | MTIF2 | 4528 | | – | resp | 356 |
| 259 | 221700_s_at | HG-U133A | AF348700 | 233 | ubiquitin A-52 residue ribosomal protein fusion product 1 | UBA52 | 7311 | | – | resp | 356 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 260 | 200095_x_at | HG-U133B | AA320764 | 234 | ribosomal protein S10 | RPS10 | 6204 | | – | resp | 358 |
| 261 | 208826_x_at | HG-U133A | U27143 | 235 | histidine triad nucleotide binding protein 1 | HINT1 | 3094 | | – | resp | 358 |
| 262 | 226236_at | HG-U133B | BF675218 | 235 | hypothetical gene supported by AF147354 | LOC388789 | 388789 | | – | resp | 358 |
| 263 | 217774_s_at | HG-U133A | NM_016404 | 236 | hypothetical protein HSPC152 | HSPC152 | 51504 | | – | resp | 359 |
| 264 | 200089_s_at | HG-U133B | AI953886 | 237 | ribosomal protein L4 | RPL4 | 6124 | | – | resp | 361 |
| 265 | 202300_at | HG-U133A | NM_006402 | 238 | hepatitis B virus x interacting protein | HBXIP | 10542 | | – | resp | 365 |
| 266 | 210470_x_at | HG-U133A | BC003129 | 239 | non-POU domain containing, octamer-binding | NONO | 4841 | | – | resp | 367 |
| 267 | 200092_s_at | HG-U133B | BF216701 | 240 | ribosomal protein L37 | RPL37 | 6167 | | – | resp | 368 |
| 268 | 200716_x_at | HG-U133A | NM_012423 | 241 | ribosomal protein L13a | RPL13A | 23521 | | – | resp | 369 |
| 269 | 210434_x_at | HG-U133A | AF151056 | 243 | jumping translocation breakpoint | JTB | 10899 | | – | resp | 372 |
| 270 | 200819_s_at | HG-U133A | NM_001018 | 244 | ribosomal protein S15 | RPS15 | 6209 | | – | resp | 373 |
| 271 | 201049_s_at | HG-U133A | NM_022551 | 245 | ribosomal protein S18 | RPS18 | 6222 | | – | resp | 373 |
| 272 | 201922_at | HG-U133A | NM_014886 | 246 | TGF beta-inducible nuclear protein 1 | TINP1 | 10412 | | – | resp | 374 |
| 273 | 201113_at | HG-U133A | NM_003321 | 247 | Tu translation elongation factor, mitochondrial | TUFM | 7284 | | – | resp | 375 |
| 274 | 206174_s_at | HG-U133A | NM_002721 | 248 | protein phosphatase 6, catalytic subunit | PPP6C | 5537 | | – | resp | 380 |
| 275 | 203720_s_at | HG-U133A | NM_001983 | 249 | excision repair cross-complementing rodent repair deficiency, complementation group 1 (includes overlapping antisense sequence) | ERCC1 | 2067 | | – | resp | 381 |
| 276 | 223034_s_at | HG-U133B | BC000152 | 250 | chromosome 1 open reading frame 43 | C1orf43 | 25912 | | – | resp | 385 |
| 277 | 200092_s_at | HG-U133A | BF216701 | 241 | ribosomal protein L37 | RPL37 | 6167 | | – | resp | 387 |
| 278 | 217729_s_at | HG-U133A | NM_001130 | 251 | amino-terminal enhancer of split | AES | 166 | | – | resp | 392 |
| 279 | 202467_s_at | HG-U133A | NM_004236 | 252 | COP9 constitutive photomorphogenic homolog subunit 2 (*Arabidopsis*) | COPS2 | 9318 | | – | resp | 393 |
| 280 | 208066_s_at | HG-U133A | NM_001514 | 253 | general transcription factor IIB | GTF2B | 2959 | | – | resp | 395 |
| 281 | 207721_x_at | HG-U133A | NM_005340 | 254 | histidine triad nucleotide binding protein 1 | HINT1 | 3094 | | – | resp | 397 |
| 282 | 214687_x_at | HG-U133A | AK026577 | 255 | aldolase A, fructose-bisphosphate | ALDOA | 226 | | – | resp | 398 |
| 283 | 213969_x_at | HG-U133A | BF683426 | 256 | ribosomal protein L29 | RPL29 | 6159 | | – | resp | 400 |
| 284 | 221524_s_at | HG-U133A | AF272036 | 257 | Ras-related GTP binding D | RRAGD | 58528 | | – | resp | 402 |
| 285 | 223376_s_at | HG-U133B | AB055977 | 258 | brain protein I3 | BRI3 | 25798 | | – | resp | 404 |
| 286 | 203107_x_at | HG-U133A | NM_002952 | 259 | ribosomal protein S2 | RPS2 | 6187 | | – | resp | 405 |
| 287 | 202514_at | HG-U133A | AW139131 | 260 | discs, large homolog 1 (*Drosophila*) | DLG1 | 1739 | | – | resp | 406 |
| 288 | 208756_at | HG-U133A | U36764 | 261 | eukaryotic translation initiation factor 3, subunit 2 beta, 36 kDa | EIF3S2 | 8668 | | – | resp | 407 |
| 289 | 227525_at | HG-U133B | AA058770 | 262 | glucocorticoid induced transcript 1 | GLCCI1 | 113263 | | – | resp | 411 |
| 290 | 220261_s_at | HG-U133A | NM_018106 | 263 | zinc finger, DHHC domain containing 4 | ZDHHC4 | 55146 | | – | resp | 412 |
| 291 | 217990_at | HG-U133A | NM_016576 | 264 | guanosine monophosphate reductase 2 | GMPR2 | 51292 | | – | resp | 413 |
| 292 | 212391_x_at | HG-U133A | AI925635 | 265 | ribosomal protein S3A | RPS3A | 6189 | | – | resp | 414 |
| 293 | 219033_at | HG-U133A | NM_024615 | 266 | poly (ADP-ribose) polymerase family, member 8 | PARP8 | 79668 | | – | resp | 416 |
| 294 | 203034_s_at | HG-U133A | NM_000990 | 267 | ribosomal protein L27a | RPL27A | 6157 | | – | resp | 418 |
| 295 | 208856_x_at | HG-U133A | BC003655 | 268 | ribosomal protein, large, P0 | RPLP0 | 6175 | | – | resp | 421 |
| 296 | 224767_at | HG-U133B | AL044126 | 269 | Ribosomal protein L37 | RPL37 | 6167 | | – | resp | 422 |
| 297 | 202758_s_at | HG-U133A | NM_003721 | 270 | regulatory factor X-associated ankyrin-containing protein | RFXANK | 8625 | | – | resp | 424 |
| 298 | 223436_s_at | HG-U133B | BC005133 | 271 | tRNA splicing 2' phosphotransferase 1 | MGC11134 | 83707 | | – | resp | 427 |
| 299 | 203190_at | HG-U133A | NM_002496 | 272 | NADH dehydrogenase (ubiquinone) Fe—S protein 8, 23 kDa (NADH-coenzyme Q reductase) | NDUFS8 | 4728 | | – | resp | 428 |

TABLE 1A-continued

| Predictive Markers Upregulated Indicators of Non-Response and/or Short Time to Progression | | | | | | | | | | | |
|---|---|---|---|---|---|---|---|---|---|---|---|
| No. | ProbeSet ID | chip | Rep Public ID | SEQ ID NO: | Title | Gene Symbol | Entrez Gene ID | TTP marker | Response marker | Type of specificity | Rank |
| 300 | 200818_at | HG-U133A | NM_001697 | 273 | ATP synthase, H+ transporting, mitochondrial F1 complex, O subunit (oligomycin sensitivity conferring protein) | ATP5O | 539 | | – | resp | 430 |
| 301 | 227228_s_at | HG-U133B | AB040942 | 274 | KIAA1509 | KIAA1509 | 440193 | | – | resp | 430 |
| 302 | 234000_s_at | HG-U133B | AJ271091 | 275 | butyrate-induced transcript 1 | HSPC121 | 51495 | | – | resp | 432 |
| 303 | 205849_s_at | HG-U133A | NM_006294 | 276 | ubiquinol-cytochrome c reductase binding protein | UQCRB | 7381 | | – | resp | 436 |
| 304 | 226165_at | HG-U133B | BF674436 | 277 | hypothetical gene supported by BC055092 | LOC401466 | 401466 | | – | resp | 438 |
| 305 | 220942_x_at | HG-U133A | NM_014367 | 278 | growth and transformation-dependent protein | E2IG5 | 26355 | | – | resp | 440 |
| 306 | 231870_s_at | HG-U133B | BG291007 | 279 | CGI-07 protein | CGI-07 | 51068 | | – | resp | 440 |
| 307 | 212270_x_at | HG-U133A | BG168283 | 280 | ribosomal protein L17 | RPL17 | 6139 | | – | resp | 443 |
| 308 | 212773_s_at | HG-U133A | BG165094 | 281 | translocase of outer mitochondrial membrane 20 homolog (yeast) | TOMM20 | 9804 | | – | resp | 443 |
| 309 | 222785_x_at | HG-U133B | AJ250229 | 282 | chromosome 11 open reading frame 1 | C11orf1 | 64776 | | – | resp | 443 |
| 310 | 222497_x_at | HG-U133B | AL520719 | 283 | NMD3 homolog (*S. cerevisiae*) | NMD3 | 51068 | | – | resp | 444 |
| 311 | 200933_x_at | HG-U133A | NM_001007 | 284 | ribosomal protein S4, X-linked | RPS4X | 6191 | | – | resp | 448 |
| 312 | 226650_at | HG-U133B | AI984061 | 285 | hypothetical protein LOC90637 | LOC90637 | 90637 | | – | resp | 453 |
| 313 | 200031_s_at | HG-U133B | NM_001015 | 286 | ribosomal protein S11 | RPS11 | 6205 | | – | resp | 454 |
| 314 | 217747_s_at | HG-U133A | NM_001013 | 287 | ribosomal protein S9 | RPS9 | 6203 | | – | resp | 454 |
| 315 | 211720_x_at | HG-U133A | BC005863 | 288 | ribosomal protein, large, P0 | RPLP0 | 6175 | | – | resp | 455 |
| 316 | 203403_s_at | HG-U133A | NM_005977 | 289 | ring finger protein (C3H2C3 type) 6 | RNF6 | 6049 | | – | resp | 457 |
| 317 | 215963_x_at | HG-U133A | Z98200 | 290 | | | | | – | resp | 459 |
| 318 | 218034_at | HG-U133A | NM_016068 | 291 | tetratricopeptide repeat domain 11 | TTC11 | 51024 | | – | resp | 460 |
| 319 | 218258_at | HG-U133A | NM_015972 | 292 | polymerase (RNA) I polypeptide D, 16 kDa | POLR1D | 51082 | | – | resp | 462 |
| 320 | 201154_x_at | HG-U133A | NM_000968 | 293 | ribosomal protein L4 | RPL4 | 6124 | | – | resp | 463 |
| 321 | 200846_s_at | HG-U133A | NM_002708 | 294 | protein phosphatase 1, catalytic subunit, alpha isoform | PPP1CA | 5499 | | – | resp | 464 |
| 322 | 217313_at | HG-U133A | AC004692 | 295 | | | | | – | resp | 465 |
| 323 | 211061_s_at | HG-U133A | BC006390 | 296 | mannosyl (alpha-1,6-)-glycoprotein beta-1,2-N-acetylglucosaminyltransferase | MGAT2 | 4247 | | – | resp | 467 |
| 324 | 216383_at | HG-U133A | U52111 | 297 | ribosomal protein L18a | RPL18A | 6142 | | – | resp | 470 |
| 325 | 222467_s_at | HG-U133B | AK023950 | 298 | chromosome 11 open reading frame 23 | C11orf23 | 55291 | | – | resp | 471 |
| 326 | 202276_at | HG-U133A | NM_006304 | 299 | split hand/foot malformation (ectrodactyly) type 1 | SHFM1 | 7979 | | – | resp | 480 |
| 327 | 65588_at | HG-U133A | AA827892 | 300 | hypothetical LOC388796 | LOC388796 | 388796 | | – | resp | 481 |
| 328 | 234339_s_at | HG-U133B | AF296124 | 301 | glioma tumor suppressor candidate region gene 2 | GLTSCR2 | 29997 | | – | resp | 484 |
| 329 | 211487_x_at | HG-U133A | BC004886 | 302 | ribosomal protein S17 | RPS17 | 6218 | | – | resp | 492 |
| 330 | 201406_at | HG-U133A | NM_021029 | 303 | ribosomal protein L36a | RPL36A | 6173 | | – | resp | 494 |
| 331 | 212537_x_at | HG-U133A | BE733979 | 304 | ribosomal protein L17 | RPL17 | 6139 | | – | resp | 495 |
| 332 | 220647_s_at | HG-U133A | NM_016565 | 305 | E2IG2 protein | E2IG2 | 51287 | | – | resp | 502 |
| 333 | 200717_x_at | HG-U133A | NM_000971 | 306 | ribosomal protein L7 | RPL7 | 6129 | | – | resp | 504 |
| 334 | 223461_at | HG-U133B | AF151073 | 307 | TBC1 domain family, member 7 | TBC1D7 | 51256 | | – | resp | 506 |
| 335 | 207831_x_at | HG-U133A | NM_013407 | 308 | deoxyhypusine synthase | DHPS | 1725 | | – | resp | 508 |
| 336 | 201119_s_at | HG-U133A | NM_004074 | 309 | cytochrome c oxidase subunit 8A (ubiquitous) | COX8A | 1351 | | – | resp | 509 |
| 337 | 206782_s_at | HG-U133A | NM_005528 | 310 | DnaJ (Hsp40) homolog, subfamily C, member 4 | DNAJC4 | 3338 | | – | resp | 509 |
| 338 | 218836_at | HG-U133A | NM_024839 | 311 | ribonuclease P 21 kDa subunit | RPP21 | 79897 | | – | resp | 510 |
| 339 | 200084_at | HG-U133B | BE748698 | 312 | small acidic protein | SMAP | 10944 | | – | resp | 513 |
| 340 | 201033_x_at | HG-U133A | NM_001002 | 313 | ribosomal protein, large, P0 | RPLP0 | 6175 | | – | resp | 514 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 341 | 222212_s_at | HG-U133A | AK001105 | 314 | LAG1 longevity assurance homolog 2 (*S. cerevisiae*) | LASS2 | 29956 | | – | resp | 515 |
| 342 | 202029_x_at | HG-U133A | NM_000999 | 315 | ribosomal protein L38 | RPL38 | 6169 | | – | resp | 518 |
| 343 | 208910_s_at | HG-U133A | L04636 | 316 | complement component 1, q subcomponent binding protein | C1QBP | 708 | | – | resp | 520 |
| 344 | 217816_s_at | HG-U133A | NM_020357 | 317 | PEST-containing nuclear protein | PCNP | 57092 | | – | resp | 521 |
| 345 | 210646_x_at | HG-U133A | BC001675 | 318 | ribosomal protein L13a | RPL13A | 23521 | | – | resp | 527 |
| 346 | 223423_at | HG-U133B | BC000181 | 319 | G protein-coupled receptor 160 | GPR160 | 26996 | | – | resp | 532 |
| 347 | 209091_s_at | HG-U133A | AF263293 | 320 | SH3-domain GRB2-like endophilin B1 | SH3GLB1 | 51100 | | – | resp | 533 |
| 348 | 200809_x_at | HG-U133A | NM_000976 | 321 | ribosomal protein L12 | RPL12 | 6136 | | – | resp | 541 |
| 349 | 224068_x_at | HG-U133B | U39402 | 322 | RNA binding motif protein 22 | RBM22 | 55696 | | – | resp | 541 |
| 350 | 200032_s_at | HG-U133A | NM_000661 | 186 | ribosomal protein L9 | RPL9 | 6133 | | – | resp | 548 |
| 351 | 227990_at | HG-U133B | AA843238 | 323 | Step II splicing factor SLU7 | SLU7 | 10569 | | – | resp | 548 |
| 352 | 223038_s_at | HG-U133B | BG479856 | 324 | chromosome 12 open reading frame 14 | C12orf14 | 58516 | | – | resp | 558 |
| 353 | 224930_x_at | HG-U133B | BE559788 | 325 | ribosomal protein L7a | RPL7A | 6130 | | – | resp | 558 |
| 354 | 218401_s_at | HG-U133A | NM_012482 | 326 | zinc finger protein 281 | ZNF281 | 23528 | | – | resp | 561 |
| 355 | 213588_x_at | HG-U133A | AA838274 | 327 | ribosomal protein L14 | RPL14 | 9045 | | – | resp | 566 |
| 356 | 226816_s_at | HG-U133B | AI745170 | 328 | KIAA1143 protein | KIAA1143 | 57456 | | – | resp | 566 |
| 357 | 212397_at | HG-U133A | AL137751 | 329 | radixin | RDX | 5962 | | – | resp | 568 |
| 358 | 200084_at | HG-U133A | BE748698 | 312 | small acidic protein | SMAP | 10944 | | – | resp | 570 |
| 359 | 202983_at | HG-U133A | AI760760 | 330 | SWI/SNF related, matrix associated, actin dependent regulator of chromatin, subfamily a, member 3 | SMARCA3 | 6596 | | – | resp | 571 |
| 360 | 201338_x_at | HG-U133A | NM_002097 | 331 | general transcription factor IIIA | GTF3A | 2971 | | – | resp | 573 |
| 361 | 214182_at | HG-U133A | AA243143 | 332 | | | | | – | resp | 573 |
| 362 | 200689_x_at | HG-U133A | NM_001404 | 333 | eukaryotic translation elongation factor 1 gamma | EEF1G | 1937 | | – | resp | 577 |
| 363 | 225002_s_at | HG-U133B | BE349022 | 334 | sulfatase modifying factor 2 | SUMF2 | 25870 | | – | resp | 582 |
| 364 | 210024_s_at | HG-U133A | AB017644 | 335 | ubiquitin-conjugating enzyme E2E 3 (UBC4/5 homolog, yeast) | UBE2E3 | 10477 | | – | resp | 588 |
| 365 | 200089_s_at | HG-U133A | AI953886 | 238 | ribosomal protein L4 | RPL4 | 6124 | | – | resp | 594 |
| 366 | 217256_x_at | HG-U133A | Z98950 | 336 | | | | | – | resp | 594 |
| 367 | 200926_at | HG-U133A | NM_001025 | 337 | ribosomal protein S23 | RPS23 | 6228 | | – | resp | 596 |
| 368 | 225237_s_at | HG-U133B | BF435123 | 338 | musashi homolog 2 (*Drosophila*) | MSI2 | 124540 | | – | resp | 598 |
| 369 | 203517_at | HG-U133A | NM_006554 | 339 | metaxin 2 | MTX2 | 10651 | | – | resp | 602 |
| 370 | 200929_at | HG-U133A | NM_006827 | 340 | transmembrane trafficking protein | TMP21 | 10972 | | – | resp | 614 |
| 371 | 203897_at | HG-U133A | BE963444 | 341 | hypothetical protein A-211C6.1 | LOC57149 | 57149 | | – | resp | 621 |
| 372 | 224479_s_at | HG-U133B | BC006235 | 342 | mitochondrial ribosomal protein L45 | MRPL45 | 84311 | | – | resp | 623 |
| 373 | 223244_s_at | HG-U133B | AF217092 | 343 | 13 kDa differentiation-associated protein | DAP13 | 55967 | | – | resp | 625 |
| 374 | 208699_x_at | HG-U133A | BF696840 | 344 | transketolase (Wernicke-Korsakoff syndrome) | TKT | 7086 | | – | resp | 626 |
| 375 | 200892_s_at | HG-U133A | BC000451 | 345 | splicing factor, arginine/serine-rich 10 (transformer 2 homolog, *Drosophila*) | SFRS10 | 6434 | | – | resp | 636 |
| 376 | 228089_x_at | HG-U133B | H72927 | 346 | similar to RIKEN cDNA 1810059G22 | LOC374395 | 374395 | | – | resp | 637 |
| 377 | 202736_s_at | HG-U133A | AA112507 | 347 | LSM4 homolog, U6 small nuclear RNA associated (*S. cerevisiae*) | LSM4 | 25804 | | – | resp | 641 |
| 378 | 217906_at | HG-U133A | NM_014315 | 348 | kelch domain containing 2 | KLHDC2 | 23588 | | – | resp | 644 |
| 379 | 224703_at | HG-U133B | AI814644 | 349 | | | | | – | resp | 646 |
| 380 | 218930_s_at | HG-U133A | NM_018374 | 350 | hypothetical protein FLJ11273 | FLJ11273 | 54664 | | – | resp | 651 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 381 | 200810_s_at | HG-U133A | NM_001280 | 160 | cold inducible RNA binding protein | CIRBP | 1153 | | – | resp | 652 |
| 382 | 225312_at | HG-U133B | AV704551 | 351 | COMM domain containing 6 | COMMD6 | 170622 | | – | resp | 654 |
| 383 | 210101_x_at | HG-U133A | AF257318 | 352 | SH3-domain GRB2-like endophilin B1 | SH3GLB1 | 51100 | | – | resp | 656 |
| 384 | 222452_s_at | HG-U133B | AA741071 | 353 | hypothetical protein SP192 | SP192 | 60313 | | – | resp | 658 |
| 385 | 202169_s_at | HG-U133A | AF302110 | 354 | aminoadipate-semialdehyde dehydrogenase-phosphopantetheinyl transferase | AASDHPPT | 60496 | | – | resp | 662 |
| 386 | 211710_x_at | HG-U133A | BC005817 | 355 | ribosomal protein L4 | RPL4 | 6124 | | – | resp | 663 |
| 387 | 202343_x_at | HG-U133A | NM_001862 | 356 | cytochrome c oxidase subunit Vb | COX5B | 1329 | | – | resp | 667 |
| 388 | 208097_s_at | HG-U133A | NM_030755 | 357 | thioredoxin domain containing | TXNDC | 81542 | | – | resp | 680 |
| 389 | 217339_x_at | HG-U133A | AJ275978 | 358 | cancer/testis antigen 1B | CTAG1B | 1485 | – | – | resp | 4 |
| 390 | 202469_s_at | HG-U133A | AU149367 | 359 | cleavage and polyadenylation specific factor 6, 68 kDa | CPSF6 | 11052 | – | – | resp | 38 |
| 391 | 214548_x_at | HG-U133A | AF064092 | 360 | GNAS complex locus | GNAS | 2778 | – | – | resp | 138 |
| 392 | 200780_x_at | HG-U133A | NM_000516 | 361 | GNAS complex locus | GNAS | 2778 | – | – | resp | 190 |
| 393 | 224972_at | HG-U133B | BF381837 | 362 | Chromosome 20 open reading frame 52 | C20orf52 | 140823 | – | – | resp | 198 |
| 394 | 208833_s_at | HG-U133A | AF119662 | 363 | ataxin 10 | ATXN10 | 25814 | – | – | resp | 280 |
| 395 | 202107_s_at | HG-U133A | NM_004526 | 364 | MCM2 minichromosome maintenance deficient 2, mitotin (*S. cerevisiae*) | MCM2 | 4171 | – | | TTP | 8 |
| 396 | 210766_s_at | HG-U133A | AF053640 | 365 | CSE1 chromosome segregation 1-like (yeast) | CSE1L | 1434 | – | | TTP | 9 |
| 397 | 221601_s_at | HG-U133A | AI084226 | 366 | regulator of Fas-induced apoptosis | TOSO | 9214 | – | | TTP | 15 |
| 398 | 209568_s_at | HG-U133A | AF186779 | 367 | ral guanine nucleotide dissociation stimulator-like 1 | RGL1 | 23179 | – | | TTP | 17 |
| 399 | 201555_at | HG-U133A | NM_002388 | 368 | MCM3 minichromosome maintenance deficient 3 (*S. cerevisiae*) | MCM3 | 4172 | – | | TTP | 21 |
| 400 | 212563_at | HG-U133A | BG491842 | 369 | block of proliferation 1 | BOP1 | 23246 | – | | TTP | 23 |
| 401 | 221602_s_at | HG-U133A | AF057557 | 370 | regulator of Fas-induced apoptosis | TOSO | 9214 | – | | TTP | 25 |
| 402 | 200608_s_at | HG-U133A | NM_006265 | 371 | RAD21 homolog (*S. pombe*) | RAD21 | 5885 | – | | TTP | 26 |
| 403 | 202589_at | HG-U133A | NM_001071 | 372 | thymidylate synthetase | TYMS | 7298 | – | | TTP | 33 |
| 404 | 201930_at | HG-U133A | NM_005915 | 373 | MCM6 minichromosome maintenance deficient 6 (MIS5 homolog, *S. pombe*) (*S. cerevisiae*) | MCM6 | 4175 | – | | TTP | 34 |
| 405 | 201726_at | HG-U133A | BC003376 | 374 | ELAV (embryonic lethal, abnormal vision, *Drosophila*)-like 1 (Hu antigen R) | ELAVL1 | 1994 | – | | TTP | 36 |
| 406 | 217821_s_at | HG-U133A | AF118023 | 375 | WW domain binding protein 11 | WBP11 | 51729 | – | | TTP | 44 |
| 407 | 216237_s_at | HG-U133A | AA807529 | 376 | MCM5 minichromosome maintenance deficient 5, cell division cycle 46 (*S. cerevisiae*) | MCM5 | 4174 | – | | TTP | 45 |
| 408 | 201589_at | HG-U133A | D80000 | 377 | SMC1 structural maintenance of chromosomes 1-like 1 (yeast) | SMC1L1 | 8243 | – | | TTP | 46 |
| 409 | 213911_s_at | HG-U133A | BF718636 | 378 | H2A histone family, member Z | H2AFZ | 3015 | – | | TTP | 47 |
| 410 | 208766_s_at | HG-U133A | BC001449 | 379 | heterogeneous nuclear ribonucleoprotein R | HNRPR | 10236 | – | | TTP | 54 |
| 411 | 226547_at | HG-U133B | AI817830 | 380 | MYST histone acetyltransferase (monocytic leukemia) 3 | MYST3 | 7994 | – | | TTP | 56 |
| 412 | 221952_x_at | HG-U133A | AB037814 | 381 | KIAA1393 | KIAA1393 | 57570 | – | | TTP | 60 |
| 413 | 202642_s_at | HG-U133A | NM_003496 | 382 | transformation/transcription domain-associated protein | TRRAP | 8295 | – | | TTP | 64 |
| 414 | 218350_s_at | HG-U133A | NM_015895 | 383 | geminin, DNA replication inhibitor | GMNN | 51053 | – | | TTP | 69 |
| 415 | 225827_at | HG-U133B | AI832074 | 384 | eukaryotic translation initiation factor 2C, 2 | EIF2C2 | 27161 | – | | TTP | 70 |
| 416 | 223024_at | HG-U133B | AL562950 | 385 | adaptor-related protein complex 1, mu 1 subunit | AP1M1 | 8907 | – | | TTP | 72 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 417 | 210983_s_at | HG-U133A | AF279900 | 386 | MCM7 minichromosome maintenance deficient 7 (*S. cerevisiae*) | MCM7 | 4176 | – | | TT | 75 |
| 418 | 200045_at | HG-U133B | NM_001090 | 387 | ATP-binding cassette, sub-family F (GCN20), member 1 | ABCF1 | 23 | – | | TTP | 77 |
| 419 | 212316_at | HG-U133A | AA502912 | 388 | nucleoporin 210 kDa | NUP210 | 23225 | – | | TTP | 79 |
| 420 | 200882_s_at | HG-U133A | NM_002810 | 389 | proteasome (prosome, macropain) 26S subunit, non-ATPase, 4 | PSMD4 | 5710 | – | | TTP | 80 |
| 421 | 201639_s_at | HG-U133A | NM_013291 | 390 | cleavage and polyadenylation specific factor 1, 160 kDa | CPSF1 | 29894 | – | | TTP | 83 |
| 422 | 213893_x_at | HG-U133A | AA161026 | 391 | postmeiotic segregation increased 2-like 5 | PMS2L5 | 5383 | – | | TTP | 84 |
| 423 | 226936_at | HG-U133B | BG492359 | 392 | CDNA clone IMAGE: 4452583, partial cds | C6orf173 | | – | | TTP | 88 |
| 424 | 228245_s_at | HG-U133B | AW594320 | 393 | ovostatin /// similar to ovostatin-2 | OVOS /// LOC440080 | 408186 /// 440080 | – | | TTP | 89 |
| 425 | 225655_at | HG-U133B | AK025578 | 394 | ubiquitin-like, containing PHD and RING finger domains, 1 | UHRF1 | 29128 | – | | TTP | 91 |
| 426 | 223516_s_at | HG-U133B | AF216754 | 395 | chromosome 6 open reading frame 49 | C6orf49 | 29964 | – | | TTP | 97 |
| 427 | 201128_s_at | HG-U133A | NM_001096 | 396 | ATP citrate lyase | ACLY | 47 | – | | TTP | 100 |
| 428 | 208821_at | HG-U133A | J04564 | 397 | small nuclear ribonucleoprotein polypeptides B and B1 | SNRPB | 6628 | – | | TTP | 102 |
| 429 | 200090_at | HG-U133B | BG168896 | 398 | farnesyltransferase, CAAX box, alpha | FNTA | 2339 | – | | TTP | 105 |
| 430 | 218437_s_at | HG-U133A | NM_020347 | 399 | leucine zipper transcription factor-like 1 | LZTFL1 | 54585 | – | | TTP | 106 |
| 431 | 225549_at | HG-U133B | BF129093 | 400 | DEAD (Asp-Glu-Ala-Asp) box polypeptide 6 | DDX6 | 1656 | – | | TTP | 107 |
| 432 | 201180_s_at | HG-U133A | J03198 | 401 | guanine nucleotide binding protein (G protein), alpha inhibiting activity polypeptide 3 | GNAI3 | 2773 | – | | TTP | 108 |
| 433 | 235242_at | HG-U133B | BE739287 | 402 | CDNA FLJ41375 fis, clone BRCAN2007700 | | | – | | TTP | 110 |
| 434 | 225834_at | HG-U133B | AL135396 | 403 | Similar to RIKEN cDNA 2700049P18 gene | MGC57827 | 389835 | – | | TTP | 112 |
| 435 | 200098_s_at | HG-U133B | T33068 | 404 | anaphase promoting complex subunit 5 | ANAPC5 | 51433 | – | | TTP | 121 |
| 436 | 210543_s_at | HG-U133A | U34994 | 405 | protein kinase, DNA-activated, catalytic polypeptide | PRKDC | 5591 | – | | TTP | 126 |
| 437 | 213378_s_at | HG-U133A | AI983033 | 406 | DEAD/H (Asp-Glu-Ala-Asp/His) box polypeptide 11 (CHL1-like helicase homolog, *S. cerevisiae*) | DDX11 | 1663 | – | | TTP | 131 |
| 438 | 220448_at | HG-U133A | NM_022055 | 407 | potassium channel, subfamily K, member 12 | KCNK12 | 56660 | – | | TTP | 136 |
| 439 | 228273_at | HG-U133B | BG165011 | 408 | Hypothetical protein FLJ11029 | FLJ11029 | 55771 | – | | TTP | 140 |
| 440 | 222988_s_at | HG-U133B | AF151020 | 409 | transmembrane protein 9 | TMEM9 | 252839 | – | | TTP | 146 |
| 441 | 209773_s_at | HG-U133A | BC001886 | 410 | ribonucleotide reductase M2 polypeptide | RRM2 | 6241 | – | | TTP | 148 |
| 442 | 202715_at | HG-U133A | NM_004341 | 411 | carbamoyl-phosphate synthetase 2, aspartate transcarbamylase, and dihydroorotase | CAD | 790 | – | | TTP | 152 |
| 443 | 202171_at | HG-U133A | AU146275 | 412 | zinc finger protein 161 | ZNF161 | 7716 | – | | TTP | 155 |
| 444 | 203999_at | HG-U133A | AV731490 | 413 | synaptotagmin I | SYT1 | 6857 | – | | TTP | 159 |
| 445 | 214526_x_at | HG-U133A | NM_005394 | 414 | | | | – | | TTP | 160 |
| 446 | 212282_at | HG-U133A | BF038366 | 415 | hypothetical protein MAC30 | MAC30 | 27346 | – | | TTP | 164 |
| 447 | 202779_s_at | HG-U133A | NM_014501 | 416 | ubiquitin-conjugating enzyme E2S | UBE2S | 27338 | – | | TTP | 166 |
| 448 | 201115_at | HG-U133A | NM_006230 | 417 | polymerase (DNA directed), delta 2, regulatory subunit 50 kDa | POLD2 | 5425 | – | | TTP | 174 |
| 449 | 214756_x_at | HG-U133A | AB017004 | 418 | | | | – | | TTP | 180 |
| 450 | 200853_at | HG-U133A | NM_002106 | 419 | H2A histone family, member Z | H2AFZ | 3015 | – | | TTP | 182 |
| 451 | 200098_s_at | HG-U133A | T33068 | 404 | anaphase promoting complex subunit 5 | ANAPC5 | 51433 | – | | TTP | 184 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 452 | 225244_at | HG-U133B | AA019893 | 420 | SVAP1 protein | IMAGE3451454 | 116841 | – | | TTP | 187 |
| 453 | 213122_at | HG-U133A | AI096375 | 421 | TSPY-like 5 | TSPYL5 | 85453 | – | | TTP | 193 |
| 454 | 211714_x_at | HG-U133A | BC005838 | 422 | tubulin, beta polypeptide | TUBB | 203068 | – | | TTP | 197 |
| 455 | 212350_at | HG-U133A | AB029031 | 423 | TBC1 (tre-2/USP6, BUB2, cdc16) domain family, member 1 | TBC1D1 | 23216 | – | | TTP | 199 |
| 456 | 215714_s_at | HG-U133A | AF254822 | 424 | SWI/SNF related, matrix associated, actin dependent regulator of chromatin, subfamily a, member 4 | SMARCA4 | 6597 | – | | TTP | 203 |
| 457 | 204053_x_at | HG-U133A | U96180 | 425 | phosphatase and tensin homolog (mutated in multiple advanced cancers 1) | PTEN | 5728 | – | | TTP | 206 |
| 458 | 212058_at | HG-U133A | AI184562 | 426 | U2-associated SR140 protein | SR140 | 23350 | – | | TTP | 208 |
| 459 | 225265_at | HG-U133B | AI580100 | 427 | RNA binding motif, single stranded interacting protein 1 | RBMS1 | 5937 | – | | TTP | 212 |
| 460 | 212281_s_at | HG-U133A | BF038366 | 415 | hypothetical protein MAC30 | MAC30 | 27346 | – | | TTP | 213 |
| 461 | 228361_at | HG-U133B | AL561296 | 428 | E2F transcription factor 2 | E2F2 | 1870 | – | | TTP | 215 |
| 462 | 208974_x_at | HG-U133A | BC003572 | 429 | karyopherin (importin) beta 1 | KPNB1 | 3837 | – | | TTP | 221 |
| 463 | 201652_at | HG-U133A | NM_006837 | 430 | COP9 constitutive photomorphogenic homolog subunit 5 (*Arabidopsis*) | COPS5 | 10987 | – | | TTP | 224 |
| 464 | 222398_s_at | HG-U133B | BC002360 | 431 | U5 snRNP-specific protein, 116 kD | U5-116 KD | 9343 | – | | TTP | 228 |
| 465 | 212610_at | HG-U133A | U79291 | 432 | protein tyrosine phosphatase, non-receptor type 11 (Noonan syndrome 1) | PTPN11 | 5781 | – | | TTP | 230 |
| 466 | 222987_s_at | HG-U133B | NM_016456 | 433 | transmembrane protein 9 | TMEM9 | 252839 | – | | TTP | 231 |
| 467 | 241224_x_at | HG-U133B | AA770014 | 434 | Down syndrome critical region gene 8 | DSCR8 | 84677 | – | | TTP | 232 |
| 468 | 207057_at | HG-U133A | NM_004731 | 435 | | | | – | | TTP | 233 |
| 469 | 209026_x_at | HG-U133A | AF141349 | 436 | tubulin, beta polypeptide | TUBB | 203068 | – | | TTP | 237 |
| 470 | 200773_x_at | HG-U133A | NM_002823 | 437 | prothymosin, alpha (gene sequence 28) | PTMA | 5757 | – | | TTP | 241 |
| 471 | 204033_at | HG-U133A | NM_004237 | 438 | thyroid hormone receptor interactor 13 | TRIP13 | 9319 | – | | TTP | 242 |
| 472 | 225068_at | HG-U133B | AK024412 | 439 | kelch-like 12 (*Drosophila*) | KLHL12 | 59349 | – | | TTP | 245 |
| 473 | 203022_at | HG-U133A | NM_006397 | 440 | ribonuclease H2, large subunit | RNASEH2A | 10535 | – | | TTP | 249 |
| 474 | 213720_s_at | HG-U133A | AI831675 | 441 | SWI/SNF related, matrix associated, actin dependent regulator of chromatin, subfamily a, member 4 | SMARCA4 | 6597 | – | | TTP | 251 |
| 475 | 225081_s_at | HG-U133B | AK022955 | 442 | transcription factor RAM2 | RAM2 | 55536 | – | | TTP | 255 |
| 476 | 201680_x_at | HG-U133A | NM_015908 | 443 | arsenate resistance protein ARS2 | ARS2 | 51593 | – | | TTP | 256 |
| 477 | 223065_s_at | HG-U133B | BC003074 | 444 | STARD3 N-terminal like | STARD3NL | 83930 | – | | TTP | 257 |
| 478 | 205436_s_at | HG-U133A | NM_002105 | 445 | H2A histone family, member X | H2AFX | 3014 | – | | TTP | 263 |
| 479 | 213069_at | HG-U133A | AI148659 | 446 | HEG homolog | HEG | 57493 | – | | TTP | 267 |
| 480 | 200073_s_at | HG-U133A | M94630 | 447 | heterogeneous nuclear ribonucleoprotein D (AU-rich element RNA binding protein 1, 37 kDa) | HNRPD | 3184 | – | | TTP | 269 |
| 481 | 200060_s_at | HG-U133B | BC001659 | 448 | RNA binding protein S1, serine-rich domain | RNPS1 | 10921 | – | | TTP | 270 |
| 482 | 205124_at | HG-U133A | NM_005919 | 449 | MADS box transcription enhancer factor 2, polypeptide B (myocyte enhancer factor 2B) | MEF2B | 4207 | – | | TTP | 275 |
| 483 | 206052_s_at | HG-U133A | NM_006527 | 450 | stem-loop (histone) binding protein | SLBP | 7884 | – | | TTP | 276 |
| 484 | 222619_at | HG-U133B | AU150752 | 451 | Zinc finger protein 281 | ZNF281 | 23528 | – | | TTP | 277 |
| 485 | 225684_at | HG-U133B | BG496998 | 452 | | | | – | | TTP | 284 |
| 486 | 202362_at | HG-U133A | NM_002884 | 453 | RAP1A, member of RAS oncogene family | RAP1A | 5906 | – | | TTP | 286 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 487 | 221505_at | HG-U133A | AW612574 | 454 | acidic (leucine-rich) nuclear phosphoprotein 32 family, member E | ANP32E | 81611 | – | – | TTP | 291 |
| 488 | 213947_s_at | HG-U133A | AI867102 | 455 | nucleoporin 210 kDa | NUP210 | 23225 | – | – | TTP | 18 |
| 489 | 209188_x_at | HG-U133A | BC002809 | 456 | down-regulator of transcription 1, TBP-binding (negative cofactor 2) | DR1 | 1810 | – | – | TTP | 98 |
| 490 | 210243_s_at | HG-U133A | AF038661 | 457 | UDP-Gal:betaGlcNAc beta 1,4-galactosyltransferase, polypeptide 3 | B4GALT3 | 8703 | – | – | TTP | 162 |
| 491 | 205449_at | HG-U133A | NM_013299 | 458 | Sac3 homology domain 1 (*S. cerevisiae*) | SHD1 | 29901 | – | – | TTP | 170 |
| 492 | 217988_at | HG-U133A | NM_021178 | 459 | cyclin B1 interacting protein 1 | CCNB1IP1 | 57820 | – | – | TTP/resp | 4 |
| 493 | 205361_s_at | HG-U133A | AI718295 | 460 | prefoldin 4 | PFDN4 | 5203 | – | – | TTP/resp | 7 |
| 494 | 202605_at | HG-U133A | NM_000181 | 461 | glucuronidase, beta | GUSB | 2990 | – | – | TTP/resp | 9 |
| 495 | 225315_at | HG-U133B | BF344406 | 462 | mitochondrial ribosomal protein L21 | MRPL21 | 219927 | – | – | TTP/resp | 9 |
| 496 | 225261_x_at | HG-U133B | AJ238376 | 463 | TH1-like (*Drosophila*) | TH1L | 51497 | – | – | TTP/resp | 10 |
| 497 | 223474_at | HG-U133B | AI932310 | 464 | chromosome 14 open reading frame 4 | C14orf4 | 64207 | – | – | TTP/resp | 12 |
| 498 | 216306_x_at | HG-U133A | X62006 | 465 | polypyrimidine tract binding protein 1 | PTBP1 | 5725 | – | – | TTP/resp | 14 |
| 499 | 201066_at | HG-U133A | NM_001916 | 466 | cytochrome c-1 | CYC1 | 1537 | – | – | TTP/resp | 16 |
| 500 | 202189_x_at | HG-U133A | NM_002819 | 467 | polypyrimidine tract binding protein 1 | PTBP1 | 5725 | – | – | TTP/resp | 20 |
| 501 | 211270_x_at | HG-U133A | BC002397 | 468 | polypyrimidine tract binding protein 1 | PTBP1 | 5725 | – | – | TTP/resp | 22 |
| 502 | 225006_x_at | HG-U133B | AJ238379 | 469 | TH1-like (*Drosophila*) | TH1L | 51497 | – | – | TTP/resp | 24 |
| 503 | 201754_at | HG-U133A | NM_004374 | 470 | cytochrome c oxidase subunit VIc | COX6C | 1345 | – | – | TTP/resp | 27 |
| 504 | 212015_x_at | HG-U133A | BF690062 | 471 | polypyrimidine tract binding protein 1 | PTBP1 | 5725 | – | – | TTP/resp | 29 |
| 505 | 41577_at | HG-U133A | AB020630 | 472 | protein phosphatase 1, regulatory (inhibitor) subunit 16B | PPP1R16B | 26051 | – | – | TTP/resp | 31 |
| 506 | 225865_x_at | HG-U133B | AJ238374 | 473 | TH1-like (*Drosophila*) | TH1L | 51497 | – | – | TTP/resp | 40 |
| 507 | 211271_x_at | HG-U133A | BC004383 | 474 | polypyrimidine tract binding protein 1 | PTBP1 | 5725 | – | – | TTP/resp | 42 |
| 508 | 200040_at | HG-U133B | NM_006559 | 475 | KH domain containing, RNA binding, signal transduction associated 1 | KHDRBS1 | 10657 | – | – | TTP/resp | 43 |
| 509 | 211755_s_at | HG-U133A | BC005960 | 476 | ATP synthase, H+ transporting, mitochondrial F0 complex, subunit b, isoform 1 | ATP5F1 | 515 | – | – | TTP/resp | 48 |
| 510 | 222445_at | HG-U133B | AK025831 | 477 | solute carrier family 39 (zinc transporter), member 9 | SLC39A9 | 55334 | – | – | TTP/resp | 48 |
| 511 | 226434_at | HG-U133B | BF000655 | 478 | hypothetical protein MGC22793 | MGC22793 | 221908 | – | – | TTP/resp | 50 |
| 512 | 202596_at | HG-U133A | BC000436 | 479 | endosulfine alpha | ENSA | 2029 | – | – | TTP/resp | 52 |
| 513 | 203739_at | HG-U133A | NM_006526 | 480 | zinc finger protein 217 | ZNF217 | 7764 | – | – | TTP/resp | 53 |
| 514 | 211987_at | HG-U133A | NM_001068 | 481 | topoisomerase (DNA) II beta 180 kDa | TOP2B | 7155 | – | – | TTP/resp | 59 |
| 515 | 217492_s_at | HG-U133A | AF023139 | 482 | phosphatase and tensin homolog (mutated in multiple advanced cancers 1) | PTEN | 5728 | – | – | TTP/resp | 65 |
| 516 | 223354_x_at | HG-U133B | BC003191 | 483 | chromosome 2 open reading frame 33 | C2orf33 | 56947 | – | – | TTP/resp | 67 |
| 517 | 210792_x_at | HG-U133A | AF033111 | 484 | CD27-binding (Siva) protein | SIVA | 10572 | – | – | TTP/resp | 71 |
| 518 | 209187_at | HG-U133A | AW516932 | 485 | down-regulator of transcription 1, TBP-binding (negative cofactor 2) | DR1 | 1810 | – | – | TTP/resp | 73 |
| 519 | 226032_at | HG-U133B | AU153405 | 486 | caspase 2, apoptosis-related cysteine protease (neural precursor cell expressed, developmentally down-regulated 2) | CASP2 | 835 | – | – | TTP/resp | 74 |
| 520 | 201493_s_at | HG-U133A | BE778078 | 487 | pumilio homolog 2 (*Drosophila*) | PUM2 | 23369 | – | – | TTP/resp | 78 |
| 521 | 204031_s_at | HG-U133A | NM_005016 | 488 | poly(rC) binding protein 2 | PCBP2 | 5094 | – | – | TTP/resp | 86 |
| 522 | 202720_at | HG-U133A | NM_015641 | 489 | testis derived transcript (3 LIM domains) | TES | 26136 | – | – | TTP/resp | 94 |

TABLE 1A-continued

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| Predictive Markers Upregulated Indicators of Non-Response and/or Short Time to Progression | | | | | | | | | | | |
| 523 | 212279_at | HG-U133A | BE779865 | 490 | hypothetical protein MAC30 | MAC30 | 27346 | – | – | TTP/resp | 103 |
| 524 | 211858_x_at | HG-U133A | AF088184 | 491 | GNAS complex locus | GNAS | 2778 | – | – | TTP/resp | 115 |
| 525 | 226574_at | HG-U133B | AI872384 | 492 | paraspeckle component 1 /// TPTE and PTEN homologous inositol lipid phosphatase pseudogene | PSPC1 /// LOC374491 | 374491 /// 55269 | – | – | TTP/resp | 119 |
| 526 | 201390_s_at | HG-U133A | NM_001320 | 493 | casein kinase 2, beta polypeptide | CSNK2B | 1460 | – | – | TTP/resp | 123 |
| 527 | 211940_x_at | HG-U133A | BE869922 | 494 | H3 histone, family 3A | H3F3A | 3020 | – | – | TTP/resp | 134 |
| 528 | 223231_at | HG-U133B | AF212250 | 495 | TatD DNase domain containing 1 | TATDN1 | 83940 | – | – | TTP/resp | 134 |
| 529 | 225222_at | HG-U133B | AI243268 | 496 | hippocampus abundant transcript 1 | HIAT1 | 64645 | – | – | TTP/resp | 139 |
| 530 | 212315_s_at | HG-U133A | AA502912 | 388 | nucleoporin 210 kDa | NUP210 | 23225 | – | – | TTP/resp | 149 |
| 531 | 216515_x_at | HG-U133A | AL121585 | 497 | prothymosin, alpha (gene sequence 28) | PTMA | 5757 | – | – | TTP/resp | 153 |
| 532 | 201019_s_at | HG-U133A | NM_001412 | 498 | eukaryotic translation initiation factor 1A, X-linked | EIF1AX | 1964 | – | – | TTP/resp | 168 |
| 533 | 222230_s_at | HG-U133A | AK022248 | 499 | actin-related protein 10 homolog (*S. cerevisiae*) | ACTR10 | 55860 | – | – | TTP/resp | 173 |
| 534 | 222992_s_at | HG-U133B | AF261090 | 500 | NADH dehydrogenase (ubiquinone) 1 beta subcomplex, 9, 22 kDa | NDUFB9 | 4715 | – | – | TTP/resp | 176 |
| 535 | 201901_s_at | HG-U133A | Z14077 | 501 | YY1 transcription factor | YY1 | 7528 | – | – | TTP/resp | 196 |
| 536 | 202487_s_at | HG-U133A | NM_012412 | 502 | H2A histone family, member V | H2AFV | 94239 | – | – | TTP/resp | 209 |
| 537 | 207614_s_at | HG-U133A | NM_003592 | 503 | cullin 1 | CUL1 | 8454 | – | – | TTP/resp | 210 |
| 538 | 202495_at | HG-U133A | NM_003192 | 504 | tubulin-specific chaperone c | TBCC | 6903 | – | – | TTP/resp | 219 |
| 539 | 210949_s_at | HG-U133A | BC000533 | 505 | eukaryotic translation initiation factor 3, subunit 8, 110 kDa | EIF3S8 | 8663 | – | – | TTP/resp | 234 |
| 540 | 218247_s_at | HG-U133A | NM_016626 | 506 | ring finger and KH domain containing 2 | RKHD2 | 51320 | – | – | TTP/resp | 236 |
| 541 | 211931_s_at | HG-U133A | BG505670 | 507 | heterogeneous nuclear ribonucleoprotein A3 | HNRPA3 | 220988 | – | – | TTP/resp | 238 |
| 542 | 200647_x_at | HG-U133A | NM_003752 | 508 | eukaryotic translation initiation factor 3, subunit 8, 110 kDa | EIF3S8 | 8663 | – | – | TTP/resp | 244 |
| 543 | 223091_x_at | HG-U133B | AF258660 | 509 | chromosome 2 open reading frame 33 | C2orf33 | 56947 | – | – | TTP/resp | 244 |
| 544 | 215230_x_at | HG-U133A | AA679705 | 510 | eukaryotic translation initiation factor 3, subunit 8, 110 kDa | EIF3S8 | 8663 | – | – | TTP/resp | 272 |
| 545 | 200893_at | HG-U133A | NM_004593 | 511 | splicing factor, arginine/serine-rich 10 (transformer 2 homolog, *Drosophila*) | SFRS10 | 6434 | – | – | TTP/resp | 285 |
| 546 | 218738_s_at | HG-U133A | NM_016271 | 512 | ring finger protein 138 | RNF138 | 51444 | – | – | TTP/resp | 289 |
| 547 | 200844_s_at | HG-U133A | BE869583 | 513 | peroxiredoxin 6 | PRDX6 | 9588 | – | – | TTP/resp | 292 |
| 548 | 200082_s_at | HG-U133A | AI805587 | 514 | ribosomal protein S7 | RPS7 | 6201 | | – | resp | 1 |
| 549 | 224841_x_at | HG-U133B | BF316352 | 515 | growth arrest-specific 5 | GAS5 | 60674 | | – | resp | 1 |
| 550 | 200082_s_at | HG-U133B | AI805587 | 514 | ribosomal protein S7 | RPS7 | 6201 | | – | resp | 2 |
| 551 | 206790_s_at | HG-U133A | NM_004545 | 516 | NADH dehydrogenase (ubiquinone) 1 beta subcomplex, 1, 7 kDa | NDUFB1 | 4707 | | – | resp | 2 |
| 552 | 224741_x_at | HG-U133B | BG329175 | 517 | growth arrest-specific 5 | GAS5 | 60674 | | – | resp | 2 |
| 553 | 226835_s_at | HG-U133B | BG330520 | 518 | Similar to RPE-spondin | | 441951 | | – | resp | 3 |
| 554 | 224915_x_at | HG-U133B | AV756131 | 519 | Similar to RPE-spondin | | 441951 | | – | resp | 4 |
| 555 | 200937_s_at | HG-U133A | NM_000969 | 520 | ribosomal protein L5 | RPL5 | 6125 | | – | resp | 5 |
| 556 | 220755_s_at | HG-U133A | NM_016947 | 521 | chromosome 6 open reading frame 48 | C6orf48 | 50854 | | – | resp | 11 |
| 557 | 201520_s_at | HG-U133A | BF034561 | 522 | G-rich RNA sequence binding factor 1 | GRSF1 | 2926 | | – | resp | 14 |
| 558 | 217719_at | HG-U133A | NM_016091 | 523 | eukaryotic translation initiation factor 3, subunit 6 interacting protein | EIF3S6IP | 51386 | | – | resp | 15 |
| 559 | 226227_x_at | HG-U133B | BF185165 | 524 | Similar to RPE-spondin | | 441951 | | – | resp | 16 |

TABLE 1A-continued

Predictive Markers Upregulated Indicators of Non-Response and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 560 | 202232_s_at | HG-U133A | NM_006360 | 52 | dendritic cell protein | GA17 | 10480 | | – | resp | 17 |
| 561 | 208796_s_at | HG-U133A | BC000196 | 525 | cyclin G1 | CCNG1 | 900 | | – | resp | 23 |
| 562 | 200023_s_at | HG-U133B | NM_003754 | 526 | eukaryotic translation initiation factor 3, subunit 5 epsilon, 47 kDa | EIF3S5 | 8665 | | – | resp | 26 |
| 563 | 200834_s_at | HG-U133A | NM_001024 | 527 | ribosomal protein S21 | RPS21 | 6227 | | – | resp | 27 |
| 564 | 201258_at | HG-U133A | NM_001020 | 528 | ribosomal protein S16 | RPS16 | 6217 | | – | resp | 36 |
| 565 | 200023_s_at | HG-U133A | NM_003754 | 526 | eukaryotic translation initiation factor 3, subunit 5 epsilon, 47 kDa | EIF3S5 | 8665 | | – | resp | 40 |
| 566 | 225698_at | HG-U133B | BF314746 | 529 | TIGA1 | TIGA1 | 114915 | | – | resp | 41 |
| 567 | 200024_at | HG-U133B | NM_001009 | 530 | | | | | – | resp | 58 |
| 568 | 221434_s_at | HG-U133A | NM_031210 | 531 | chromosome 14 open reading frame 156 | C14orf156 | 81892 | | – | resp | 63 |
| 569 | 225190_x_at | HG-U133B | AW402660 | 532 | ribosomal protein L35a | RPL35A | 6165 | | – | resp | 70 |
| 570 | 200024_at | HG-U133A | NM_001009 | 530 | | | | | – | resp | 71 |
| 571 | 200903_s_at | HG-U133A | NM_000687 | 533 | S-adenosylhomocysteine hydrolase | AHCY | 191 | | – | resp | 76 |
| 572 | 234875_at | HG-U133B | AJ224082 | 534 | | | | | – | resp | 84 |
| 573 | 225065_x_at | HG-U133B | AI826279 | 535 | hypothetical protein MGC40157 | MGC40157 | 125144 | | – | resp | 98 |
| 574 | 217969_at | HG-U133A | NM_013265 | 536 | chromosome 11 open reading frame2 | C11orf2 | 738 | | – | resp | 104 |
| 575 | 201653_at | HG-U133A | NM_005776 | 537 | cornichon homolog (*Drosophila*) | CNIH | 10175 | | – | resp | 105 |
| 576 | 200019_s_at | HG-U133B | NM_001997 | 538 | Finkel-Biskis-Reilly murine sarcoma virus (FBR-MuSV) ubiquitously expressed (fox derived); ribosomal protein S30 | FAU | 2197 | | – | resp | 107 |
| 577 | 200030_s_at | HG-U133A | NM_002635 | 539 | solute carrier family 25 (mitochondrial carrier; phosphate carrier), member 3 | SLC25A3 | 5250 | | – | resp | 112 |
| 578 | 216380_x_at | HG-U133A | AC005011 | 540 | | | | | – | resp | 121 |
| 579 | 200826_at | HG-U133A | NM_004597 | 541 | small nuclear ribonucleoprotein D2 polypeptide 16.5 kDa | SNRPD2 | 6633 | | – | resp | 122 |
| 580 | 200030_s_at | HG-U133B | NM_002635 | 539 | solute carrier family 25 (mitochondrial carrier; phosphate carrier), member 3 | SLC25A3 | 5250 | | – | resp | 124 |
| 581 | 221691_x_at | HG-U133A | AB042278 | 542 | nucleophosmin (nucleolar phosphoprotein B23, numatrin) | NPM1 | 4869 | | – | resp | 127 |
| 582 | 211937_at | HG-U133A | NM_001417 | 543 | eukaryotic translation initiation factor 4B | EIF4B | 1975 | | – | resp | 132 |
| 583 | 208742_s_at | HG-U133A | U78303 | 544 | sin3-associated polypeptide, 18 kDa | SAP18 | 10284 | | – | resp | 146 |
| 584 | 200869_at | HG-U133A | NM_000980 | 545 | ribosomal protein L18a | RPL18A | 6142 | | – | resp | 158 |
| 585 | 212644_s_at | HG-U133A | AI671747 | 546 | chromosome 14 open reading frame 32 | C14orf32 | 93487 | | – | resp | 160 |
| 586 | 222975_s_at | HG-U133B | AI423180 | 547 | upstream of NRAS | UNR | 7812 | | – | resp | 176 |
| 587 | 219030_at | HG-U133A | NM_016058 | 548 | CGI-121 protein | CGI-121 | 51002 | | – | resp | 189 |
| 588 | 201682_at | HG-U133A | NM_004279 | 549 | peptidase (mitochondrial processing) beta | PMPCB | 9512 | | – | resp | 195 |
| 589 | 207573_x_at | HG-U133A | NM_006476 | 550 | ATP synthase, H+ transporting, mitochondrial F0 complex, subunit g | ATP5L | 10632 | | – | resp | 206 |
| 590 | 209786_at | HG-U133A | BC001282 | 193 | high mobility group nucleosomal binding domain 4 | HMGN4 | 10473 | | – | resp | 219 |
| 591 | 200019_s_at | HG-U133A | NM_001997 | 538 | Finkel-Biskis-Reilly murine sarcoma virus (FBR-MuSV) ubiquitously expressed (fox derived); ribosomal protein S30 | FAU | 2197 | | – | resp | 236 |
| 592 | 210453_x_at | HG-U133A | AL050277 | 551 | ATP synthase, H+ transporting, mitochondrial F0 complex, subunit g | ATP5L | 10632 | | – | resp | 248 |
| 593 | 226243_at | HG-U133B | BF590958 | 552 | Similar to CG14903-PA | | 391356 | | – | resp | 253 |

TABLE 1A-continued

| Predictive Markers Upregulated Indicators of Non-Response and/or Short Time to Progression | | | | | | | | | | | |
|---|---|---|---|---|---|---|---|---|---|---|---|
| No. | ProbeSet ID | chip | Rep Public ID | SEQ ID NO: | Title | Gene Symbol | Entrez Gene ID | TTP marker | Response marker | Type of specificity | Rank |
| 594 | 222465_at | HG-U133B | AF165521 | 553 | chromosome 15 open reading frame 15 | C15orf15 | 51187 | | – | resp | 255 |
| 595 | 229050_s_at | HG-U133B | AL533103 | 554 | hypothetical protein MGC16037 | MGC16037 | 84973 | | – | resp | 294 |
| 596 | 217915_s_at | HG-U133A | NM_016304 | 555 | chromosome 15 open reading frame 15 | C15orf15 | 51187 | | – | resp | 296 |
| 597 | 201532_at | HG-U133A | NM_002788 | 556 | proteasome (prosome, macropain) subunit, alpha type, 3 | PSMA3 | 5684 | | – | resp | 309 |
| 598 | 239237_at | HG-U133B | AI798822 | 557 | LOC442534 | | 442534 | | – | resp | 322 |
| 599 | 202026_at | HG-U133A | NM_003002 | 558 | succinate dehydrogenase complex, subunit D, integral membrane protein | SDHD | 6392 | | – | resp | 325 |
| 600 | 221726_at | HG-U133A | BE250348 | 559 | ribosomal protein L22 | RPL22 | 6146 | | – | resp | 326 |
| 601 | 201177_s_at | HG-U133A | NM_005499 | 560 | SUMO-1 activating enzyme subunit 2 | UBA2 | 10054 | | – | resp | 357 |
| 602 | 201892_s_at | HG-U133A | NM_000884 | 561 | IMP (inosine monophosphate) dehydrogenase 2 | IMPDH2 | 3615 | | – | resp | 360 |
| 603 | 200037_s_at | HG-U133B | NM_016587 | 562 | chromobox homolog 3 (HP1 gamma homolog, *Drosophila*) | CBX3 | 11335 | | – | resp | 368 |
| 604 | 216274_s_at | HG-U133A | N99438 | 563 | SEC11-like 1 (*S. cerevisiae*) | SEC11L1 | 23478 | | – | resp | 376 |
| 605 | 214167_s_at | HG-U133A | AA555113 | 564 | ribosomal protein, large, P0 | RPLP0 | 6175 | | – | resp | 389 |
| 606 | 213738_s_at | HG-U133A | AI587323 | 565 | ATP synthase, H+ transporting, mitochondrial F1 complex, alpha subunit, isoform 1, cardiac muscle | ATP5A1 | 498 | | – | resp | 424 |
| 607 | 222410_s_at | HG-U133B | AF121856 | 566 | sorting nexin 6 | SNX6 | 58533 | | – | resp | 495 |
| 608 | 222784_at | HG-U133B | AJ249900 | 567 | | | | | – | resp | 496 |
| 609 | 200003_s_at | HG-U133B | NM_000991 | 568 | ribosomal protein L28 | RPL28 | 6158 | | – | resp | 503 |
| 610 | 222427_s_at | HG-U133B | AK021413 | 569 | leucyl-tRNA synthetase | LARS | 51520 | | – | resp | 516 |
| 611 | 200715_x_at | HG-U133A | BC000514 | 570 | ribosomal protein L13a | RPL13A | 23521 | | – | resp | 524 |
| 612 | 201554_x_at | HG-U133A | NM_004130 | 571 | glycogenin | GYG | 2992 | | – | resp | 526 |
| 613 | 200047_s_at | HG-U133B | NM_003403 | 572 | YY1 transcription factor | YY1 | 7528 | | – | resp | 529 |
| 614 | 215733_x_at | HG-U133A | AJ012833 | 573 | cancer/testis antigen 2 | CTAG2 | 30848 | | – | resp | 3 |
| 615 | 201491_at | HG-U133A | NM_012111 | 574 | AHA1, activator of heat shock 90 kDa protein ATPase homolog 1 (yeast) | AHSA1 | 10598 | – | | TTP | 266 |
| 616 | 210467_x_at | HG-U133A | BC003408 | 575 | melanoma antigen family A, 12 | MAGEA12 | 4111 | – | | TTP | 283 |
| 617 | 210546_x_at | HG-U133A | U87459 | 576 | cancer/testis antigen 1B /// cancer/testis antigen 1A | CTAG1B /// CTAG1A | 1485 /// 246100 | – | – | TTP/resp | 1 |
| 618 | 211674_x_at | HG-U133A | AF038567 | 577 | cancer/testis antigen 1B /// cancer/testis antigen 1A | CTAG1B /// CTAG1A | 1485 /// 246100 | – | – | TTP/resp | 1 |
| 619 | 224985_at | HG-U133B | BE964484 | 578 | Neuroblastoma RAS viral (v-ras) oncogene homolog | NRAS | 4893 | – | – | TTP/resp | 2 |
| 620 | 200043_at | HG-U133A | NM_004450 | 579 | enhancer of rudimentary homolog (*Drosophila*) | ERH | 2079 | – | – | TTP/resp | 3 |
| 621 | 200043_at | HG-U133B | NM_004450 | 579 | enhancer of rudimentary homolog (*Drosophila*) | ERH | 2079 | – | – | TTP/resp | 13 |
| 622 | 222783_s_at | HG-U133B | BF516292 | 580 | SPARC related modular calcium binding 1 | SMOC1 | 64093 | – | – | TTP/resp | 21 |
| 623 | 211747_s_at | HG-U133A | BC005938 | 581 | LSM5 homolog, U6 small nuclear RNA associated (*S. cerevisiae*) | LSM5 | 23658 | – | – | TTP/resp | 25 |
| 624 | 223358_s_at | HG-U133B | AW269834 | 582 | Phosphodiesterase 7A | PDE7A | 5150 | – | – | TTP/resp | 37 |
| 625 | 200921_s_at | HG-U133A | NM_001731 | 583 | B-cell translocation gene 1, anti-proliferative | BTG1 | 694 | – | – | TTP/resp | 67 |
| 626 | 200037_s_at | HG-U133A | NM_016587 | 562 | chromobox homolog 3 (HP1 gamma homolog, *Drosophila*) | CBX3 | 11335 | – | – | TTP/resp | 99 |

TABLE 1A-continued

| Predictive Markers Upregulated Indicators of Non-Response and/or Short Time to Progression | | | | | | | | | | | |
|---|---|---|---|---|---|---|---|---|---|---|---|
| No. | ProbeSet ID | chip | Rep Public ID | SEQ ID NO: | Title | Gene Symbol | Entrez Gene ID | TTP marker | Response marker | Type of specificity | Rank |
| 627 | 208743_s_at | HG-U133A | BC001359 | 584 | tyrosine 3-monooxygenase/tryptophan 5-monooxygenase activation protein, beta polypeptide | YWHAB | 7529 | – | – | TTP/resp | 118 |
| 628 | 201825_s_at | HG-U133A | AL572542 | 585 | CGI-49 protein | CGI-49 | 51097 | – | – | TTP/resp | 143 |
| 629 | 200047_s_at | HG-U133A | NM_003403 | 572 | YY1 transcription factor | YY1 | 7528 | – | – | TTP/resp | 240 |
| 630 | 202591_s_at | HG-U133A | NM_003143 | 586 | single-stranded DNA binding protein 1 | SSBP1 | 6742 | – | – | TTP/resp | 248 |
| 631 | 209036_s_at | HG-U133A | BC001917 | 587 | malate dehydrogenase 2, NAD (mitochondrial) | MDH2 | 4191 | – | – | TTP/resp | 271 |
| 632 | 200949_x_at | HG-U133A | NM_001023 | 588 | ribosomal protein S20 | RPS20 | 6224 | | – | resp | 30 |
| 633 | 219939_s_at | HG-U133A | NM_007158 | 589 | upstream of NRAS | UNR | 7812 | | – | resp | 82 |
| 634 | 214003_x_at | HG-U133A | BF184532 | 590 | ribosomal protein S20 | RPS20 | 6224 | | – | resp | 118 |
| 635 | 208764_s_at | HG-U133A | D13119 | 591 | ATP synthase, H+ transporting, mitochondrial F0 complex, subunit c (subunit 9), isoform 2 | ATP5G2 | 517 | | – | resp | 170 |
| 636 | 201011_at | HG-U133A | NM_002950 | 592 | ribophorin I | RPN1 | 6184 | | – | resp | 179 |
| 637 | 222035_s_at | HG-U133A | AI984479 | 593 | poly(A) polymerase alpha | PAPOLA | 10914 | | – | resp | 187 |
| 638 | 209066_x_at | HG-U133A | M26700 | 594 | ubiquinol-cytochrome c reductase binding protein | UQCRB | 7381 | | – | resp | 298 |
| 639 | 212807_s_at | HG-U133A | BF447105 | 595 | sortilin 1 | SORT1 | 6272 | | – | resp | 349 |
| 640 | 212266_s_at | HG-U133A | AW084582 | 596 | splicing factor, arginine/serine-rich 5 | SFRS5 | 6430 | | – | resp | 362 |
| 641 | 217846_at | HG-U133A | NM_005051 | 597 | glutaminyl-tRNA synthetase | QARS | 5859 | | – | resp | 379 |
| 642 | 202579_x_at | HG-U133A | NM_006353 | 598 | high mobility group nucleosomal binding domain 4 | HMGN4 | 10473 | | – | resp | 451 |
| 643 | 202105_at | HG-U133A | NM_001551 | 599 | immunoglobulin (CD79A) binding protein 1 | IGBP1 | 3476 | | – | resp | 599 |
| 644 | 203380_x_at | HG-U133A | NM_006925 | 600 | splicing factor, arginine/serine-rich 5 | SFRS5 | 6430 | | – | resp | 683 |
| 645 | 208668_x_at | HG-U133A | BC003689 | 601 | high-mobility group nucleosomal binding domain 2 | HMGN2 | 3151 | – | | TTP | 67 |
| 646 | 212718_at | HG-U133A | BF797555 | 602 | poly(A) polymerase alpha | PAPOLA | 10914 | – | | TTP | 85 |
| 647 | 218233_s_at | HG-U133A | NM_017601 | 603 | chromosome 6 open reading frame 49 | C6orf49 | 29964 | – | | TTP | 127 |
| 648 | 218482_at | HG-U133A | NM_020189 | 604 | e(y)2 protein | e(y)2 | 56943 | – | | TTP | 226 |
| 649 | 218850_s_at | HG-U133A | NM_014240 | 605 | LIM domains containing 1 | LIMD1 | 8994 | – | | TTP | 264 |
| 650 | 230769_at | HG-U133B | AI916261 | 606 | FLJ37099 protein | FLJ37099 | 163259 | – | – | TTP | 1 |
| 651 | 207654_x_at | HG-U133A | NM_001938 | 607 | down-regulator of transcription 1, TBP-binding (negative cofactor 2) | DR1 | 1810 | – | – | TTP | 227 |
| 652 | 210532_s_at | HG-U133A | AF116639 | 608 | chromosome 14 open reading frame 2 | C14orf2 | 9556 | – | – | TTP/resp | 1 |
| 653 | 209899_s_at | HG-U133A | AF217197 | 609 | fuse-binding protein-interacting repressor | SIAHBP1 | 22827 | – | – | TTP/resp | 4 |
| 654 | 211783_s_at | HG-U133A | BC006177 | 610 | metastasis associated 1 | MTA1 | 9112 | – | – | TTP/resp | 55 |
| 655 | 201840_at | HG-U133A | NM_006156 | 611 | neural precursor cell expressed, developmentally down-regulated 8 | NEDD8 | 4738 | – | – | TTP/resp | 71 |
| 656 | 200920_s_at | HG-U133A | AL535380 | 612 | B-cell translocation gene 1, anti-proliferative | BTG1 | 694 | – | – | TTP/resp | 87 |
| 657 | 222789_at | HG-U133B | R45958 | 613 | round spermatid basic protein 1 | RSBN1 | 54665 | – | – | TTP/resp | 222 |

TABLE 1B

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 658 | 219073_s_at | HG-U133A | NM_017784 | 614 | oxysterol binding protein-like 10 | OSBPL10 | 114884 | + | + | resp | 116 |
| 659 | 227168_at | HG-U133B | BF475488 | 615 | hypothetical gene supported by AK098833 | LOC440823 | 440823 | | + | resp | 3 |
| 660 | 204122_at | HG-U133A | NM_003332 | 616 | TYRO protein tyrosine kinase binding protein | TYROBP | 7305 | | + | resp | 6 |
| 661 | 209101_at | HG-U133A | M92934 | 617 | connective tissue growth factor | CTGF | 1490 | | + | resp | 6 |
| 662 | 204208_at | HG-U133A | NM_003800 | 618 | RNA guanylyltransferase and 5'-phosphatase | RNGTT | 8732 | | + | resp | 8 |
| 663 | 223044_at | HG-U133B | AL136944 | 619 | solute carrier family 40 (iron-regulated transporter), member 1 | SLC40A1 | 30061 | | + | resp | 9 |
| 664 | 213915_at | HG-U133A | NM_005601 | 620 | natural killer cell group 7 sequence | NKG7 | 4818 | | + | resp | 10 |
| 665 | 224616_at | HG-U133B | BG110975 | 621 | dynein, cytoplasmic, light intermediate polypeptide 2 | DNCLI2 | 1783 | | + | resp | 11 |
| 666 | 214574_x_at | HG-U133A | NM_007161 | 622 | leukocyte specific transcript 1 | LST1 | 7940 | | + | resp | 12 |
| 667 | 204834_at | HG-U133A | NM_006682 | 623 | fibrinogen-like 2 | FGL2 | 10875 | | + | resp | 13 |
| 668 | 212646_at | HG-U133A | D42043 | 624 | raft-linking protein | RAFTLIN | 23180 | | + | resp | 18 |
| 669 | 231078_at | HG-U133B | H69701 | 625 | Mitochondrial solute carrier protein | MSCP | 51312 | | + | resp | 20 |
| 670 | 230499_at | HG-U133B | AA805622 | 626 | Baculoviral IAP repeat-containing 3 | BIRC3 | 330 | | + | resp | 21 |
| 671 | 208540_x_at | HG-U133A | NM_021039 | 627 | | | | | + | resp | 24 |
| 672 | 203568_s_at | HG-U133A | NM_006355 | 628 | tripartite motif-containing 38 | TRIM38 | 10475 | | + | resp | 29 |
| 673 | 200941_at | HG-U133A | AK026575 | 629 | heat shock factor binding protein 1 | HSBP1 | 3281 | | + | resp | 31 |
| 674 | 222368_at | HG-U133A | AW972351 | 630 | | | | | + | resp | 33 |
| 675 | 1729_at | HG-U133A | L41690 | 631 | TNFRSF1A-associated via death domain | TRADD | 8717 | | + | resp | 34 |
| 676 | 212136_at | HG-U133A | AW517686 | 632 | ATPase, Ca++ transporting, plasma membrane 4 | ATP2B4 | 493 | | + | resp | 36 |
| 677 | 213193_x_at | HG-U133A | AL559122 | 633 | T cell receptor beta constant 1 | TRBC1 | 28639 | | + | resp | 38 |
| 678 | 203290_at | HG-U133A | NM_002122 | 634 | major histocompatibility complex, class II, DQ alpha 1 /// major histocompatibility complex, class II, DQ alpha 2 | HLA-DQA1 /// HLA-DQA2 | 3117 /// 3281 | | + | resp | 40 |
| 679 | 229147_at | HG-U133B | AW070877 | 635 | | | | | + | resp | 42 |
| 680 | 221495_s_at | HG-U133A | AF322111 | 636 | KIAA1049 protein | KIAA1049 | 22980 | | + | resp | 46 |
| 681 | 203221_at | HG-U133A | AI758763 | 637 | transducin-like enhancer of split 1 (E(sp1) homolog, *Drosophila*) | TLE1 | 7088 | | + | resp | 56 |
| 682 | 203542_s_at | HG-U133A | AI690205 | 638 | Kruppel-like factor 9 | KLF9 | 687 | | + | resp | 57 |
| 683 | 213275_x_at | HG-U133A | W47179 | 639 | Cathepsin B | CTSB | 1508 | | + | resp | 64 |
| 684 | 216063_at | HG-U133A | N55205 | 640 | | | | | + | resp | 65 |
| 685 | 213311 s_at | HG-U133A | BF000251 | 641 | KIAA1049 protein | KIAA1049 | 22980 | | + | resp | 66 |
| 686 | 202436_s_at | HG-U133A | AU144855 | 642 | cytochrome P450, family 1, subfamily B, polypeptide 1 | CYP1B1 | 1545 | | + | resp | 70 |
| 687 | 215051_x_at | HG-U133A | BF213829 | 643 | allograft inflammatory factor 1 | AIF1 | 199 | | + | resp | 73 |
| 688 | 238025_at | HG-U133B | AA706818 | 644 | mixed lineage kinase domain-like | MLKL | 197259 | | + | resp | 73 |
| 689 | 200860_s_at | HG-U133A | BC000779 | 645 | CCR4-NOT transcription complex, subunit 1 | CNOT1 | 23019 | | + | resp | 74 |
| 690 | 200696_s_at | HG-U133A | NM_000177 | 646 | gelsolin (amyloidosis, Finnish type) | GSN | 2934 | | + | resp | 79 |
| 691 | 201705_at | HG-U133A | NM_002811 | 647 | proteasome (prosome, macropain) 26S subunit, non-ATPase, 7 (Mov34 homolog) | PSMD7 | 5713 | | + | resp | 79 |
| 692 | 220792_at | HG-U133A | NM_018699 | 648 | PR domain containing 5 | PRDM5 | 11107 | | + | resp | 80 |
| 693 | 219910_at | HG-U133A | NM_007076 | 649 | Huntingtin interacting protein E | HYPE | 11153 | | + | resp | 83 |
| 694 | 211981_at | HG-U133A | NM_001845 | 650 | collagen, type IV, alpha 1 | COL4A1 | 1282 | | + | resp | 85 |
| 695 | 210950_s_at | HG-U133A | BC003573 | 651 | farnesyl-diphosphate farnesyltransferase 1 | FDFT1 | 2222 | | + | resp | 86 |

TABLE 1B-continued

| Predictive Markers Upregulated Indicators of Response and/or Long Time to Progression | | | | | | | | | | | |
|---|---|---|---|---|---|---|---|---|---|---|---|
| No. | ProbeSet ID | chip | Rep Public ID | SEQ ID NO: | Title | Gene Symbol | Entrez Gene ID | TTP marker | Response marker | Type of specificity | Rank |
| 696 | 212135_s_at | HG-U133A | AW517686 | 632 | ATPase, Ca++ transporting, plasma membrane 4 | ATP2B4 | 493 | | + | resp | 86 |
| 697 | 217889_s_at | HG-U133A | NM_024843 | 652 | cytochrome b reductase 1 | CYBRD1 | 79901 | | + | resp | 90 |
| 698 | 204207_s_at | HG-U133A | AB012142 | 653 | RNA guanylyltransferase and 5'-phosphatase | RNGTT | 8732 | | + | resp | 91 |
| 699 | 213274_s_at | HG-U133A | AA020826 | 654 | cathepsin B | CTSB | 1508 | | + | resp | 93 |
| 700 | 243780_at | HG-U133B | AW575863 | 655 | CDNA FLJ46553 fis, clone THYMU3038879 | | | | + | resp | 96 |
| 701 | 209118_s_at | HG-U133A | AF141347 | 656 | tubulin, alpha 3 | TUBA3 | 7846 | | + | resp | 98 |
| 702 | 205051_s_at | HG-U133A | NM_000222 | 657 | v-kit Hardy-Zuckerman 4 feline sarcoma viral oncogene homolog | KIT | 3815 | | + | resp | 101 |
| 703 | 202497_x_at | HG-U133A | AI631159 | 658 | solute carrier family 2 (facilitated glucose transporter), member 3 | SLC2A3 | 6515 | | + | resp | 102 |
| 704 | 208791_at | HG-U133A | M25915 | 659 | clusterin (complement lysis inhibitor, SP-40, 40, sulfated glycoprotein 2, testosterone-repressed prostate message 2, apolipoprotein J) | CLU | 1191 | | + | resp | 105 |
| 705 | 209607_x_at | HG-U133A | U08032 | 660 | sulfotransferase family, cytosolic, 1A, phenol-preferring, member 3 | SULT1A3 | 6818 | | + | resp | 108 |
| 706 | 203973_s_at | HG-U133A | NM_005195 | 661 | CCAAT/enhancer binding protein (C/EBP), delta | CEBPD | 1052 | | + | resp | 111 |
| 707 | 209047_at | HG-U133A | AL518391 | 662 | aquaporin 1 (channel-forming integral protein, 28 kDa) | AQP1 | 358 | | + | resp | 117 |
| 708 | 212007_at | HG-U133A | AI927512 | 663 | UBX domain containing 2 | UBXD2 | 23190 | | + | resp | 119 |
| 709 | 224917_at | HG-U133B | BF674052 | 664 | likely ortholog of rat vacuole membrane protein 1 | VMP1 | 81671 | | + | resp | 124 |
| 710 | 213574_s_at | HG-U133A | AA861608 | 665 | Karyopherin (importin) beta 1 | KPNB1 | 3837 | | + | resp | 129 |
| 711 | 206666_at | HG-U133A | NM_002104 | 666 | granzyme K (serine protease, granzyme 3; tryptase II) | GZMK | 3003 | | + | resp | 146 |
| 712 | 210666_at | HG-U133A | AF050145 | 667 | iduronate 2-sulfatase (Hunter syndrome) | IDS | 3423 | | + | resp | 148 |
| 713 | 209013_x_at | HG-U133A | AF091395 | 668 | triple functional domain (PTPRF interacting) | TRIO | 7204 | | + | resp | 153 |
| 714 | 213164_at | HG-U133A | AI867198 | 669 | solute carrier family 5 (inositol transporters), member 3 | SLC5A3 | 6526 | | + | resp | 153 |
| 715 | 205641_s_at | HG-U133A | NM_003789 | 670 | TNFRSF1A-associated via death domain | TRADD | 8717 | | + | resp | 155 |
| 716 | 226599_at | HG-U133B | AA527080 | 671 | KIAA1727 protein | KIAA1727 | 85462 | | + | resp | 155 |
| 717 | 210835_s_at | HG-U133A | AF222711 | 672 | C-terminal binding protein 2 | CTBP2 | 1488 | | + | resp | 159 |
| 718 | 226430_at | HG-U133B | AI394438 | 673 | hypothetical protein LOC253981 | LOC253981 | 253981 | | + | resp | 160 |
| 719 | 213396_s_at | HG-U133A | AA456929 | 674 | A kinase (PRKA) anchor protein 10 | AKAP10 | 11216 | | + | resp | 161 |
| 720 | 209018_s_at | HG-U133A | BF432478 | 675 | PTEN induced putative kinase 1 | PINK1 | 65018 | | + | resp | 164 |
| 721 | 239629_at | HG-U133B | AI634046 | 676 | | | | | + | resp | 168 |
| 722 | 212724_at | HG-U133A | BG054844 | 677 | Rho family GTPase 3 | RND3 | 390 | | + | resp | 172 |
| 723 | 219577_s_at | HG-U133A | NM_019112 | 678 | ATP-binding cassette, sub-family A (ABC1), member 7 | ABCA7 | 10347 | | + | resp | 175 |
| 724 | 206150_at | HG-U133A | NM_001242 | 679 | tumor necrosis factor receptor superfamily, member 7 | TNFRSF7 | 939 | | + | resp | 177 |
| 725 | 238063_at | HG-U133B | AA806283 | 680 | hypothetical protein FLJ32028 | FLJ32028 | 201799 | | + | resp | 188 |
| 726 | 202292_x_at | HG-U133A | NM_007260 | 681 | lysophospholipase II | LYPLA2 | 11313 | | + | resp | 191 |
| 727 | 212041_at | HG-U133A | AL566172 | 682 | ATPase, H+ transporting, lysosomal 38 kDa, V0 subunit d isoform 1 | ATP6V0D1 | 9114 | | + | resp | 199 |
| 728 | 205990_s_at | HG-U133A | NM_003392 | 683 | wingless-type MMTV integration site family, member 5A | WNT5A | 7474 | | + | resp | 200 |
| 729 | 212944_at | HG-U133A | AK024896 | 684 | Mitochondrial ribosomal protein S6 | MRPS6 | 64968 | | + | resp | 203 |

TABLE 1B-continued

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 730 | 224159_x_at | HG-U133B | AF220023 | 685 | tripartite motif-containing 4 | TRIM4 | 89122 | | + | resp | 205 |
| 731 | 235638_at | HG-U133B | AI167789 | 686 | Ras association (RalGDS/AF-6) domain family 6 | RASSF6 | 166824 | | + | resp | 206 |
| 732 | 212588_at | HG-U133A | Y00062 | 687 | protein tyrosine phosphatase, receptor type, C | PTPRC | 5788 | | + | resp | 209 |
| 733 | 202283_at | HG-U133A | NM_002615 | 688 | serine (or cysteine) proteinase inhibitor, clade F (alpha-2 antiplasmin, pigment epithelium derived factor), member 1 | SERPINF1 | 5176 | | + | resp | 211 |
| 734 | 221804_s_at | HG-U133A | BE565675 | 689 | family with sequence similarity 45, member B /// family with sequence similarity 45, member A | FAM45B /// FAM45A | 404636 /// 55855 | | + | resp | 215 |
| 735 | 203909_at | HG-U133A | NM_006359 | 690 | solute carrier family 9 (sodium/hydrogen exchanger), isoform 6 | SLC9A6 | 10479 | | + | resp | 216 |
| 736 | 200675_at | HG-U133A | NM_004356 | 691 | CD81 antigen (target of antiproliferative antibody 1) | CD81 | 975 | | + | resp | 217 |
| 737 | 209939_x_at | HG-U133A | AF005775 | 692 | CASP8 and FADD-like apoptosis regulator | CFLAR | 8837 | | + | resp | 218 |
| 738 | 212884_x_at | HG-U133A | AI358867 | 693 | | | | | + | resp | 219 |
| 739 | 206337_at | HG-U133A | NM_001838 | 694 | chemokine (C-C motif) receptor 7 | CCR7 | 1236 | | + | resp | 220 |
| 740 | 208178_x_at | HG-U133A | NM_007118 | 695 | triple functional domain (PTPRF interacting) | TRIO | 7204 | | + | resp | 220 |
| 741 | 225626_at | HG-U133B | AK000680 | 696 | phosphoprotein associated with glycosphingolipid-enriched microdomains | PAG | 55824 | | + | resp | 221 |
| 742 | 201024_x_at | HG-U133A | BG261322 | 697 | eukaryotic translation initiation factor 5B | EIF5B | 9669 | | + | resp | 223 |
| 743 | 204115_at | HG-U133A | NM_004126 | 698 | guanine nucleotide binding protein (G protein), gamma 11 | GNG11 | 2791 | | + | resp | 224 |
| 744 | 212240_s_at | HG-U133A | AI679268 | 699 | phosphoinositide-3-kinase, regulatory subunit 1 (p85 alpha) | PIK3R1 | 5295 | | + | resp | 224 |
| 745 | 202615_at | HG-U133A | BF222895 | 700 | guanine nucleotide binding protein (G protein), q polypeptide | GNAQ | 2776 | | + | resp | 225 |
| 746 | 210580_x_at | HG-U133A | L25275 | 701 | sulfotransferase family, cytosolic, 1A, phenol-preferring, member 3 | SULT1A3 | 6818 | | + | resp | 226 |
| 747 | 242121_at | HG-U133B | AW973232 | 702 | Ring finger protein 12 | RNF12 | 51132 | | + | resp | 226 |
| 748 | 213539_at | HG-U133A | NM_000732 | 703 | CD3D antigen, delta polypeptide (TiT3 complex) | CD3D | 915 | | + | resp | 233 |
| 749 | 218505_at | HG-U133A | NM_024673 | 704 | FLJ12270 protein | FLJ12270 | 79726 | | + | resp | 235 |
| 750 | 212982_at | HG-U133A | AI621223 | 705 | zinc finger, DHHC domain containing 17 | ZDHHC17 | 23390 | | + | resp | 249 |
| 751 | 202803_s_at | HG-U133A | NM_000211 | 706 | integrin, beta 2 (antigen CD18 (p95), lymphocyte function-associated antigen 1; macrophage antigen 1 (mac-1) beta subunit) | ITGB2 | 3689 | | + | resp | 251 |
| 752 | 236368_at | HG-U133B | BF059292 | 707 | KIAA0368 | KIAA0368 | 23392 | | + | resp | 261 |
| 753 | 218223_s_at | HG-U133A | NM_016274 | 708 | CK2 interacting protein 1; HQ0024c protein | CKIP-1 | 51177 | | + | resp | 262 |
| 754 | 203186_s_at | HG-U133A | NM_002961 | 709 | S100 calcium binding protein A4 (calcium protein, calvasculin, metastasin, murine placental homolog) | S100A4 | 6275 | | + | resp | 264 |
| 755 | 219563_at | HG-U133A | NM_024633 | 710 | chromosome 14 open reading frame 139 | C14orf139 | 79686 | | + | resp | 266 |
| 756 | 219290_x_at | HG-U133A | NM_014395 | 711 | dual adaptor of phosphotyrosine and 3-phosphoinositides | DAPP1 | 27071 | | + | resp | 268 |
| 757 | 214085_x_at | HG-U133A | AI912583 | 712 | | | | | + | resp | 270 |
| 758 | 208648_at | HG-U133A | W60953 | 713 | valosin-containing protein | VCP | 7415 | | + | resp | 272 |
| 759 | 211339_s_at | HG-U133A | D13720 | 714 | IL2-inducible T-cell kinase | ITK | 3702 | | + | resp | 274 |
| 760 | 213095_x_at | HG-U133A | AF299327 | 715 | allograft inflammatory factor 1 | AIF1 | 199 | | + | resp | 291 |

TABLE 1B-continued

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| Predictive Markers Upregulated Indicators of Response and/or Long Time to Progression | | | | | | | | | | | |
| 761 | 221731_x_at | HG-U133A | BF218922 | 716 | chondroitin sulfate proteoglycan 2 (versican) | CSPG2 | 1462 | | + | resp | 302 |
| 762 | 201828_x_at | HG-U133A | NM_003928 | 717 | CAAX box 1 | CXX1 | 8933 | | + | resp | 305 |
| 763 | 203988_s_at | HG-U133A | NM_004480 | 718 | fucosyltransferase 8 (alpha (1,6) fucosyltransferase) | FUT8 | 2530 | | + | resp | 306 |
| 764 | 225918_at | HG-U133B | AI742940 | 719 | Hypothetical protein LOC146346 | LOC146346 | 146346 | | + | resp | 311 |
| 765 | 215949_x_at | HG-U133A | BF002659 | 720 | immunoglobulin heavy constant mu | IGHM | 3507 | | + | resp | 312 |
| 766 | 209164_s_at | HG-U133A | BC002976 | 721 | cytochrome b-561 | CYB561 | 1534 | | + | resp | 314 |
| 767 | 201998_at | HG-U133A | AI743792 | 722 | ST6 beta-galactosamide alpha-2,6-sialyltranferase 1 | ST6GAL1 | 6480 | | + | resp | 315 |
| 768 | 202484_s_at | HG-U133A | AF072242 | 723 | methyl-CpG binding domain protein 2 | MBD2 | 8932 | | + | resp | 316 |
| 769 | 215588_x_at | HG-U133A | AK024958 | 724 | RIO kinase 3 (yeast) | RIOK3 | 8780 | | + | resp | 316 |
| 770 | 235028_at | HG-U133B | BG288330 | 725 | CDNA FLJ42313 fis, clone TRACH2019425 | | | | + | resp | 317 |
| 771 | 238701_x_at | HG-U133B | BE176566 | 726 | FLJ45803 protein | FLJ45803 | 399948 | | + | resp | 319 |
| 772 | 202771_at | HG-U133A | NM_014745 | 727 | family with sequence similarity 38, member A | FAM38A | 9780 | | + | resp | 320 |
| 773 | 235327_x_at | HG-U133B | BG111015 | 728 | UBX domain containing 4 | UBXD4 | 165324 | | + | resp | 326 |
| 774 | 210357_s_at | HG-U133A | BC000669 | 729 | spermine oxidase | SMOX | 54498 | | + | resp | 328 |
| 775 | 204588_s_at | HG-U133A | NM_003982 | 730 | solute carrier family 7 (cationic amino acid transporter, y+ system), member 7 | SLC7A7 | 9056 | | + | resp | 333 |
| 776 | 32069_at | HG-U133A | AB014515 | 731 | Nedd4 binding protein 1 | N4BP1 | 9683 | | + | resp | 334 |
| 777 | 203868_s_at | HG-U133A | NM_001078 | 732 | vascular cell adhesion molecule 1 | VCAM1 | 7412 | | + | resp | 336 |
| 778 | 201012_at | HG-U133A | NM_000700 | 733 | annexin A1 | ANXA1 | 301 | | + | resp | 337 |
| 779 | 231093_at | HG-U133B | BF514552 | 734 | Fc receptor-like protein 3 | FCRH3 | 115352 | | + | resp | 340 |
| 780 | 213425_at | HG-U133A | AI968085 | 735 | wingless-type MMTV integration site family, member 5A | WNT5A | 7474 | | + | resp | 342 |
| 781 | 214494_s_at | HG-U133A | NM_005200 | 736 | spastic paraplegia 7, paraplegin (pure and complicated autosomal recessive) | SPG7 | 6687 | | + | resp | 342 |
| 782 | 214902_x_at | HG-U133A | AL080232 | 737 | FLJ42393 protein | FLJ42393 | 401105 | | + | resp | 344 |
| 783 | 202908_at | HG-U133A | NM_006005 | 738 | Wolfram syndrome 1 (wolframin) | WFS1 | 7466 | | + | resp | 348 |
| 784 | 205968_at | HG-U133A | NM_002252 | 739 | potassium voltage-gated channel, delayed-rectifier, subfamily S, member 3 | KCNS3 | 3790 | | + | resp | 349 |
| 785 | 202449_s_at | HG-U133A | NM_002957 | 740 | retinoid X receptor, alpha | RXRA | 6256 | | + | resp | 355 |
| 786 | 209539_at | HG-U133A | D25304 | 741 | Rac/Cdc42 guanine nucleotide exchange factor (GEF) 6 | ARHGEF6 | 9459 | | + | resp | 355 |
| 787 | 241223_x_at | HG-U133B | AI821721 | 742 | | | | | + | resp | 356 |
| 788 | 234675_x_at | HG-U133B | AK027219 | 743 | CDNA: FLJ23566 fis, clone LNG10880 | | | | + | resp | 369 |
| 789 | 212994_at | HG-U133A | BE543527 | 744 | THO complex 2 | THOC2 | 57187 | | + | resp | 375 |
| 790 | 225929_s_at | HG-U133B | AA233374 | 745 | chromosome 17 open reading frame 27 | C17orf27 | 57674 | | + | resp | 377 |
| 791 | 215111_s_at | HG-U133A | AK027071 | 746 | transforming growth factor beta 1 induced transcript 4 | TGFB1I4 | 8848 | | + | resp | 381 |
| 792 | 204872_at | HG-U133A | NM_007005 | 747 | transducin-like enhancer of split 4 (E(sp1) homolog, *Drosophila*) | TLE4 | 7091 | | + | resp | 382 |
| 793 | 208082_x_at | HG-U133A | NM_030757 | 748 | | | | | + | resp | 398 |
| 794 | 227749_at | HG-U133B | AI703496 | 749 | Transcribed locus | | | | + | resp | 407 |
| 795 | 213572_s_at | HG-U133A | AI554300 | 750 | serine (or cysteine) proteinase inhibitor, clade B (ovalbumin), member 1 | SERPINB1 | 1992 | | + | resp | 408 |
| 796 | 212754_s_at | HG-U133A | AI760249 | 751 | KIAA1040 protein | KIAA1040 | 23041 | | + | resp | 410 |

TABLE 1B-continued

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 797 | 203123_s_at | HG-U133A | AU154469 | 752 | solute carrier family 11 (proton-coupled divalent metal ion transporters), member 2 | SLC11A2 | 4891 | | + | resp | 412 |
| 798 | 214726_x_at | HG-U133A | AL556041 | 753 | adducin 1 (alpha) | ADD1 | 118 | | + | resp | 415 |
| 799 | 212810_s_at | HG-U133A | W72527 | 754 | solute carrier family 1 (glutamate/neutral amino acid transporter), member 4 | SLC1A4 | 6509 | | + | resp | 434 |
| 800 | 207730_x_at | HG-U133A | NM_017932 | 755 | KIAA1881 | KIAA1881 | 114782 | | + | resp | 437 |
| 801 | 225361_x_at | HG-U133B | AI348001 | 756 | similar to hypothetical protein MGC17347 | LOC159090 | 159090 | | + | resp | 439 |
| 802 | 201778_s_at | HG-U133A | NM_014774 | 757 | KIAA0494 gene product | KIAA0494 | 9813 | | + | resp | 442 |
| 803 | 216858_x_at | HG-U133A | AL080112 | 758 | | | | | + | resp | 445 |
| 804 | 214696_at | HG-U133A | AF070569 | 759 | hypothetical protein MGC14376 | MGC14376 | 84981 | | + | resp | 456 |
| 805 | 218066_at | HG-U133A | NM_006598 | 760 | solute carrier family 12 (potassium/chloride transporters), member 7 | SLC12A7 | 10723 | | + | resp | 457 |
| 806 | 210563_x_at | HG-U133A | U97075 | 761 | CASP8 and FADD-like apoptosis regulator | CFLAR | 8837 | | + | resp | 461 |
| 807 | 201057_s_at | HG-U133A | NM_004487 | 762 | golgi autoantigen, golgin subfamily b, macrogolgin (with transmembrane signal), 1 | GOLGB1 | 2804 | | + | resp | 465 |
| 808 | 209183_s_at | HG-U133A | AL136653 | 763 | chromosome 10 open reading frame 10 | C10orf10 | 11067 | | + | resp | 469 |
| 809 | 226474_at | HG-U133B | AA005023 | 764 | nucleotide-binding oligomerization domains 27 | NOD27 | 84166 | | + | resp | 472 |
| 810 | 225507_at | HG-U133B | BF591408 | 765 | chromosome 6 open reading frame 111 | C6orf111 | 25957 | | + | resp | 474 |
| 811 | 212177_at | HG-U133A | AW081113 | 766 | chromosome 6 open reading frame 111 | C6orf111 | 25957 | | + | resp | 476 |
| 812 | 216510_x_at | HG-U133A | AB035175 | 767 | immunoglobulin heavy constant gamma 1 (G1m marker) /// similar to Ig heavy chain V-III region VH26 precursor | IGHG1 /// LOC390714 | 3500 /// 390714 | | + | resp | 478 |
| 813 | 215600_x_at | HG-U133A | AK022174 | 768 | F-box and WD-40 domain protein 12 | FBXW12 | 285231 | | + | resp | 483 |
| 814 | 215811_at | HG-U133A | AF238870 | 769 | | | | | + | resp | 484 |
| 815 | 220940_at | HG-U133A | NM_025190 | 770 | KIAA1641 | KIAA1641 | 57730 | | + | resp | 497 |
| 816 | 217728_at | HG-U133A | NM_014624 | 771 | S100 calcium binding protein A6 (calcyclin) | S100A6 | 6277 | | + | resp | 499 |
| 817 | 232266_x_at | HG-U133B | AK024379 | 772 | Cell division cycle 2-like 5 (cholinesterase-related cell division controller) | CDC2L5 | 8621 | | + | resp | 507 |
| 818 | 201674_s_at | HG-U133A | BC000729 | 773 | A kinase (PRKA) anchor protein 1 | AKAP1 | 8165 | | + | resp | 511 |
| 819 | 206846_s_at | HG-U133A | NM_006044 | 774 | histone deacetylase 6 | HDAC6 | 10013 | | + | resp | 515 |
| 820 | 202587_s_at | HG-U133A | BC001116 | 775 | adenylate kinase 1 | AK1 | 203 | | + | resp | 519 |
| 821 | 211034_s_at | HG-U133A | BC006270 | 776 | AF-1 specific protein phosphatase | FLJ30092 | 196515 | | + | resp | 523 |
| 822 | 209485_s_at | HG-U133A | W19983 | 777 | oxysterol binding protein-like 1A | OSBPL1A | 114876 | | + | resp | 524 |
| 823 | 232008_s_at | HG-U133B | AF283775 | 778 | bobby sox homolog (*Drosophila*) | BBX | 56987 | | + | resp | 528 |
| 824 | 218155_x_at | HG-U133A | AK026565 | 779 | hypothetical protein FLJ10534 | FLJ10534 | 55720 | | + | resp | 529 |
| 825 | 207986_x_at | HG-U133A | NM_001915 | 780 | | | | | + | resp | 534 |
| 826 | 234981_x_at | HG-U133B | BE537881 | 781 | similar to mouse 2310016A09Rik gene | LOC134147 | 134147 | | + | resp | 537 |
| 827 | 226659_at | HG-U133B | Z97832 | 782 | differentially expressed in FDCP 6 homolog (mouse) | DEF6 | 50619 | | + | resp | 540 |
| 828 | 201141_at | HG-U133A | NM_002510 | 783 | glycoprotein (transmembrane) nmb | GPNMB | 10457 | | + | resp | 549 |
| 829 | 221973_at | HG-U133A | AI983904 | 784 | Hypothetical protein LOC150759 | LOC150759 | 150759 | | + | resp | 551 |
| 830 | 206380_s_at | HG-U133A | NM_002621 | 785 | properdin P factor, complement | PFC | 5199 | | + | resp | 552 |
| 831 | 215179_x_at | HG-U133A | AK023843 | 786 | Placental growth factor, vascular endothelial growth factor-related protein | PGF | 5228 | | + | resp | 554 |
| 832 | 211582_x_at | HG-U133A | AF000424 | 787 | leukocyte specific transcript 1 | LST1 | 7940 | | + | resp | 556 |
| 833 | 217761_at | HG-U133A | NM_018269 | 788 | membrane-type 1 matrix metalloproteinase cytoplasmic tail binding protein-1 | MTCBP-1 | 55256 | | + | resp | 557 |

TABLE 1B-continued

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 834 | 210915_x_at | HG-U133A | M15564 | 789 | T cell receptor beta constant 1 | TRBC1 | 28639 | | + | resp | 561 |
| 835 | 233702_x_at | HG-U133B | AK024599 | 790 | CDNA: FLJ20946 fis, clone ADSE01819 | | | | + | resp | 562 |
| 836 | 204842_x_at | HG-U133A | BC002763 | 791 | protein kinase, cAMP-dependent, regulatory, type II, alpha | PRKAR2A | 5576 | | + | resp | 563 |
| 837 | 33323_r_at | HG-U133A | X57348 | 792 | stratifin | SFN | 2810 | | + | resp | 565 |
| 838 | 204232_at | HG-U133A | NM_004106 | 793 | Fc fragment of IgE, high affinity I, receptor for; gamma polypeptide | FCER1G | 2207 | | + | resp | 567 |
| 839 | 233056_x_at | HG-U133B | AK024674 | 794 | discs, large (*Drosophila*) homolog-associated protein 4 | DLGAP4 | 22839 | | + | resp | 569 |
| 840 | 215553_x_at | HG-U133A | AK024315 | 795 | WD repeat domain 45 | WDR45 | 11152 | | + | resp | 574 |
| 841 | 222380_s_at | HG-U133A | AI907083 | 796 | Similar to Microneme antigen | | 391733 | | + | resp | 578 |
| 842 | 60471_at | HG-U133A | AA625133 | 797 | Ras and Rab interactor 3 | RIN3 | 79890 | | + | resp | 586 |
| 843 | 206929_s_at | HG-U133A | NM_005597 | 798 | nuclear factor I/C (CCAAT-binding transcription factor) | NFIC | 4782 | | + | resp | 591 |
| 844 | 211452_x_at | HG-U133A | AF130054 | 799 | | | | | + | resp | 592 |
| 845 | 239748_x_at | HG-U133B | H09533 | 800 | | | | | + | resp | 596 |
| 846 | 222187_x_at | HG-U133A | X78262 | 801 | Ras-GTPase-activating protein SH3-domain-binding protein | G3BP | 10146 | | + | resp | 603 |
| 847 | 208246_x_at | HG-U133A | NM_017618 | 802 | Thymidine kinase 2, mitochondrial | TK2 | 7084 | | + | resp | 605 |
| 848 | 243198_at | HG-U133B | AA020920 | 803 | testis expressed gene 9 | TEX9 | 374618 | | + | resp | 609 |
| 849 | 211992_at | HG-U133A | AI445745 | 804 | WNK lysine deficient protein kinase 1 | WNK1 | 65125 | | + | resp | 612 |
| 850 | 217198_x_at | HG-U133A | U80164 | 805 | immunoglobulin heavy locus /// immunoglobulin heavy constant gamma 1 (G1m marker) | IGH@ /// IGHG1 | 3492 /// 3500 | | + | resp | 614 |
| 851 | 34210_at | HG-U133A | N90866 | 806 | CD52 antigen (CAMPATH-1 antigen) | CD52 | 1043 | | + | resp | 616 |
| 852 | 231828_at | HG-U133B | AL117474 | 807 | *Homo sapiens*, clone IMAGE: 5218355, mRNA | | | | + | resp | 619 |
| 853 | 202040_s_at | HG-U133A | NM_005056 | 808 | Jumonji, AT rich interactive domain 1A (RBBP2-like) | JARID1A | 5927 | | + | resp | 622 |
| 854 | 222357_at | HG-U133A | AW974823 | 809 | zinc finger and BTB domain containing 20 | ZBTB20 | 26137 | | + | resp | 631 |
| 855 | 238668_at | HG-U133B | AI130690 | 810 | Transcribed locus | | | | + | resp | 633 |
| 856 | 236715_x_at | HG-U133B | BF056139 | 811 | | | | | + | resp | 640 |
| 857 | 241347_at | HG-U133B | AA936632 | 812 | KIAA1618 | KIAA1618 | 57714 | | + | resp | 645 |
| 858 | 208459_s_at | HG-U133A | NM_015024 | 813 | exportin 7 | XPO7 | 23039 | | + | resp | 648 |
| 859 | 208238_x_at | HG-U133A | NM_013344 | 814 | | | | | + | resp | 667 |
| 860 | 204661_at | HG-U133A | NM_001803 | 815 | CD52 antigen (CAMPATH-1 antigen) | CD52 | 1043 | | + | resp | 668 |
| 861 | 202450_s_at | HG-U133A | NM_000396 | 816 | cathepsin K (pycnodysostosis) | CTSK | 1513 | | + | resp | 675 |
| 862 | 209377_s_at | HG-U133A | AF274949 | 817 | high mobility group nucleosomal binding domain 3 | HMGN3 | 9324 | | + | resp | 681 |
| 863 | 215577_at | HG-U133A | AU146791 | 818 | Ubiquitin-conjugating enzyme E2E 1 (UBC4/5 homolog, yeast) | UBE2E1 | 7324 | | + | resp | 688 |
| 864 | 221253_s_at | HG-U133A | NM_030810 | 819 | thioredoxin domain containing 5 | TXNDC5 | 81567 | + | | TTP | 92 |
| 865 | 216231_s_at | HG-U133A | AW188940 | 820 | beta-2-microglobulin | B2M | 567 | + | | TTP | 156 |
| 866 | 223577_x_at | HG-U133B | AA827878 | 821 | | | | + | | TTP | 194 |
| 867 | 228759_at | HG-U133B | BG236289 | 822 | cAMP responsive element binding protein 3-like 2 | CREB3L2 | 64764 | + | | TTP | 204 |

TABLE 1B-continued

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 868 | 221992_at | HG-U133A | AI925734 | 823 | Hypothetical protein LOC283970 | LOC283970 | 283970 | + | | TTP | 207 |
| 869 | 212739_s_at | HG-U133A | AL523860 | 824 | non-metastatic cells 4, protein expressed in | NME4 | 4833 | + | | TTP | 246 |
| 870 | 201063_at | HG-U133A | NM_002901 | 825 | reticulocalbin 1, EF-hand calcium binding domain | RCN1 | 5954 | + | | TTP | 247 |
| 871 | 227013_at | HG-U133B | AI535735 | 826 | LATS, large tumor suppressor, homolog 2 (*Drosophila*) | LATS2 | 26524 | + | | TTP | 250 |
| 872 | AFFX-BioC-3_at | HG-U133B | AFFX-BioC-3 | | | | | + | | TTP | 254 |
| 873 | 210889_s_at | HG-U133A | M31933 | 827 | Fc fragment of IgG, low affinity IIb, receptor (CD32) | FCGR2B | 2213 | + | | TTP | 274 |
| 874 | 213601_at | HG-U133A | AB011537 | 828 | slit homolog 1 (*Drosophila*) | SLIT1 | 6585 | + | + | TTP/resp | 111 |
| 875 | 210944_s_at | HG-U133A | BC003169 | 829 | calpain 3, (p94) | CAPN3 | 825 | + | + | TTP/resp | 122 |
| 876 | 32811_at | HG-U133A | X98507 | 830 | myosin IC | MYO1C | 4641 | + | + | TTP/resp | 150 |
| 877 | 213348_at | HG-U133A | N33167 | 831 | cyclin-dependent kinase inhibitor 1C (p57, Kip2) | CDKN1C | 1028 | | + | resp | 132 |
| 878 | 200710_at | HG-U133A | NM_000018 | 832 | acyl-Coenzyme A dehydrogenase, very long chain | ACADVL | 37 | | + | resp | 198 |
| 879 | 220232_at | HG-U133A | NM_024906 | 833 | stearoyl-CoA desaturase 4 | SCD4 | 79966 | | + | resp | 272 |
| 880 | 209345_s_at | HG-U133A | AL561930 | 834 | phosphatidylinositol 4-kinase type II | PI4KII | 55361 | | + | resp | 350 |
| 881 | 231825_x_at | HG-U133B | AK025060 | 835 | activating transcription factor 7 interacting protein | ATF7IP | 55729 | | + | resp | 374 |
| 882 | 215067_x_at | HG-U133A | AU147942 | 836 | peroxiredoxin 2 | PRDX2 | 7001 | | + | resp | 447 |
| 883 | 215499_at | HG-U133A | AA780381 | 837 | Mitogen-activated protein kinase kinase 3 | MAP2K3 | 5606 | | + | resp | 482 |
| 884 | 206323_x_at | HG-U133A | NM_002547 | 838 | oligophrenin 1 | OPHN1 | 4983 | | + | resp | 505 |
| 885 | 220725_x_at | HG-U133A | NM_025095 | 839 | Dynein, axonemal, heavy polypeptide 3 | DNAH3 | 55567 | | + | resp | 537 |
| 886 | 237475_x_at | HG-U133B | AI151104 | 840 | *Homo sapiens*, clone IMAGE: 4829003, mRNA | | | | + | resp | 581 |
| 887 | 228919_at | HG-U133B | AA601031 | 841 | | | | | + | resp | 589 |
| 888 | 215504_x_at | HG-U133A | AF131777 | 842 | *Homo sapiens*, clone IMAGE: 4822875, mRNA | | | | + | resp | 604 |
| 889 | 216524_x_at | HG-U133A | AL049260 | 843 | | | | | + | resp | 657 |
| 890 | 221569_at | HG-U133A | AL136797 | 844 | Abelson helper integration site | AHI1 | 54806 | + | + | TTP/resp | 253 |
| 891 | 228658_at | HG-U133B | R54042 | 845 | hypothetical protein LOC150271 | LOC150271 | 150271 | | + | resp | 16 |
| 892 | 210538_s_at | HG-U133A | U37546 | 846 | baculoviral IAP repeat-containing 3 | BIRC3 | 330 | | + | resp | 37 |
| 893 | 202439_s_at | HG-U133A | NM_000202 | 847 | iduronate 2-sulfatase (Hunter syndrome) | IDS | 3423 | | + | resp | 107 |
| 894 | 212221_x_at | HG-U133A | AV703259 | 848 | iduronate 2-sulfatase (Hunter syndrome) | IDS | 3423 | | + | resp | 165 |
| 895 | 211316_x_at | HG-U133A | AF009616 | 849 | CASP8 and FADD-like apoptosis regulator | CFLAR | 8837 | | + | resp | 196 |
| 896 | 209136_s_at | HG-U133A | BG390445 | 850 | ubiquitin specific protease 10 | USP10 | 9100 | | + | resp | 318 |
| 897 | 201811_x_at | HG-U133A | NM_004844 | 851 | SH3-domain binding protein 5 (BTK-associated) | SH3BP5 | 9467 | | + | resp | 359 |
| 898 | 222391_at | HG-U133B | AL080250 | 852 | transmembrane protein 30A | TMEM30A | 55754 | | + | resp | 421 |
| 899 | 214179_s_at | HG-U133A | H93013 | 853 | nuclear factor (erythroid-derived 2)-like 1 | NFE2L1 | 4779 | | + | resp | 439 |
| 900 | 201810_s_at | HG-U133A | AL562152 | 854 | SH3-domain binding protein 5 (BTK-associated) | SH3BP5 | 9467 | | + | resp | 474 |
| 901 | 212616_at | HG-U133A | BF668950 | 855 | chromodomain helicase DNA binding protein 9 | CHD9 | 80205 | | + | resp | 475 |
| 902 | 205504_at | HG-U133A | NM_000061 | 856 | Bruton agammaglobulinemia tyrosine kinase | BTK | 695 | | + | resp | 487 |

TABLE 1B-continued

| Predictive Markers Upregulated Indicators of Response and/or Long Time to Progression | | | | | | | | | | | |
|---|---|---|---|---|---|---|---|---|---|---|---|
| No. | ProbeSet ID | chip | Rep Public ID | SEQ ID NO: | Title | Gene Symbol | Entrez Gene ID | TTP marker | Response marker | Type of specificity | Rank |
| 903 | 200759_x_at | HG-U133A | NM_003204 | 857 | nuclear factor (erythroid-derived 2)-like 1 | NFE2L1 | 4779 | | + | resp | 611 |
| 904 | 209276_s_at | HG-U133A | AF162769 | 858 | glutaredoxin (thioltransferase) | GLRX | 2745 | + | | TTP | 151 |
| 905 | 202727_s_at | HG-U133A | NM_000416 | 859 | interferon gamma receptor 1 | IFNGR1 | 3459 | + | | TTP | 168 |
| 906 | 202011_at | HG-U133A | NM_003257 | 860 | tight junction protein 1 (zona occludens 1) | TJP1 | 7082 | + | + | TTP | 63 |
| 907 | 206662_at | HG-U133A | NM_002064 | 861 | glutaredoxin (thioltransferase) | GLRX | 2745 | + | + | TTP/resp | 30 |
| 908 | 209475_at | HG-U133A | AF106069 | 862 | ubiquitin specific protease 15 | USP15 | 9958 | + | + | TTP/resp | 46 |
| 909 | 235661_at | HG-U133B | T99553 | 863 | Transcribed locus | | | + | + | TTP/resp | 201 |
| 910 | 235875_at | HG-U133B | BF510711 | 864 | Solute carrier family 1 (glutamate/neutral amino acid transporter), member 4 | SLC1A4 | 6509 | | + | resp | 329 |
| 911 | 225373_at | HG-U133B | BE271644 | 865 | PP2135 protein | PP2135 | 64115 | + | + | TTP | 189 |

Table 2. Glucocorticoid Predictive Marker Identification

TABLE 2A

| Predictive Markers Upregulated Indicators of Non-Reponse and/or Short Time to Progression | | | | | | | | | | | |
|---|---|---|---|---|---|---|---|---|---|---|---|
| No. | ProbeSet ID | chip | Rep Public ID | SEQ ID NO: | Title | Gene Symbol | Entrez Gene ID | TTP marker | Response marker | Type of specificity | Rank |
| 912 | 208918_s_at | HG-U133A | AI334128 | 866 | NAD kinase | FLJ13052 | 65220 | | – | resp | 2 |
| 913 | 208235_x_at | HG-U133A | NM_021123 | 867 | G antigen 5 /// G antigen 7 /// G antigen 7B<br>GAGE7 ///<br>GAGE7B | GAGE5 ///<br>2579 ///<br>26748 | 2577 /// | | – | resp | 3 |
| 914 | 221810_at | HG-U133A | AA631242 | 868 | RAB15, member RAS onocogene family | RAB15 | 376267 | | – | resp | 5 |
| 915 | 212725_s_at | HG-U133A | N37081 | 869 | hypothetical protein TI-227H | TI-227H | 29793 | | – | resp | 8 |
| 916 | 200964_at | HG-U133A | NM_003334 | 870 | ubiquitin-activating enzyme E1 (A1S9T and BN75 temperature sensitivity complementing) | UBE1 | 7317 | | – | resp | 9 |
| 917 | 226670_s_at | HG-U133B | AL109839 | 871 | Chromosome 20 open reading frame 119 | C20orf119 | 80336 | | – | resp | 12 |
| 918 | 222753_s_at | HG-U133B | AL136660 | 872 | signal peptidase complex subunit 3 homolog (*S. cerevisiae*) | SPCS3 | 60559 | | – | resp | 13 |
| 919 | 213373_s_at | HG-U133A | BF439983 | 873 | caspase 8, apoptosis-related cysteine protease | CASP8 | 841 | | – | resp | 19 |
| 920 | 202148_s_at | HG-U133A | NM_006907 | 874 | pyrroline-5-carboxylate reductase 1 | PYCR1 | 5831 | | – | resp | 26 |
| 921 | 212337_at | HG-U133A | AI687738 | 875 | hypothetical protein TI-227H | TI-227H | 29793 | | – | resp | 28 |
| 922 | 211761_s_at | HG-U133A | BC005975 | 876 | calcyclin binding protein | CACYBP | 27101 | | – | resp | 36 |
| 923 | 201381_x_at | HG-U133A | AF057356 | 877 | calcyclin binding protein | CACYBP | 27101 | | – | resp | 38 |
| 924 | 225364_at | HG-U133B | BE222274 | 878 | serine/threonine kinase 4 | STK4 | 6789 | | – | resp | 39 |
| 925 | 200665_s_at | HG-U133A | NM_003118 | 879 | secreted protein, acidic, cysteine-rich (osteonectin) | SPARC | 6678 | | – | resp | 48 |
| 926 | 201577_at | HG-U133A | NM_000269 | 880 | non-metastatic cells 1, protein (NM23A) expressed in | NME1 | 4830 | | – | resp | 50 |
| 927 | 226914_at | HG-U133B | AU158936 | 881 | Actin related protein 2/3 complex, subunit 5-like | ARPC5L | 81873 | | – | resp | 51 |
| 928 | 225401_at | HG-U133B | BF977145 | 882 | kidney predominant protein NCU-G1 | MGC31963 | 112770 | | – | resp | 52 |
| 929 | 222154_s_at | HG-U133A | AK002064 | 883 | DNA polymerase-transactivated protein 6 | DNAPTP6 | 26010 | | – | resp | 57 |
| 930 | 200791_s_at | HG-U133A | NM_003870 | 884 | IQ motif containing GTPase activating protein 1 | IQGAP1 | 8826 | | – | resp | 65 |
| 931 | 202555_s_at | HG-U133A | NM_005965 | 885 | myosin, light polypeptide kinase | MYLK | 4638 | | – | resp | 66 |
| 932 | 208801_at | HG-U133A | BE856385 | 886 | signal recognition particle 72 kDa | SRP72 | 6731 | | – | resp | 72 |
| 933 | 227556_at | HG-U133B | AI094580 | 887 | non-metastatic cells 7, protein expressed in (nucleoside-diphosphate kinase) | NME7 | 29922 | | – | resp | 84 |
| 934 | 213135_at | HG-U133A | U90902 | 888 | T-cell lymphoma invasion and metastasis 1 | TIAM1 | 7074 | | – | resp | 98 |
| 935 | 206656_s_at | HG-U133A | BC000353 | 889 | chromosome 20 open reading frame 3 | C20orf3 | 57136 | | – | resp | 104 |
| 936 | 206640_x_at | HG-U133A | NM_001477 | 890 | G antigen 2 /// G antigen 4 /// G antigen 5 /// G antigen 6 /// G antigen 7 /// G antigen 7B | GAGE2 ///<br>GAGE4 ///<br>GAGE5 ///<br>GAGE6 ///<br>GAGE7 ///<br>GAGE7B | 2574 ///<br>2576 ///<br>2577 ///<br>2578 ///<br>2579 ///<br>26748 | | – | resp | 1 |
| 937 | 208155_x_at | HG-U133A | NM_001476 | 891 | G antigen 4 /// G antigen 5 /// G antigen 6 /// G antigen 7B | GAGE4 ///<br>GAGE5 ///<br>GAGE6 ///<br>GAGE7B | 2576///<br>2577 ///<br>2578 ///<br>26748 | | – | resp | 2 |
| 938 | 207086_x_at | HG-U133A | NM_001474 | 892 | G antigen 2 /// G antigen 4 /// G antigen 5 /// G antigen 6 /// G antigen 7 /// G antigen 7B /// G antigen 8 | GAGE2 ///<br>GAGE4 ///<br>GAGE5 ///<br>GAGE6 /// | 2574 ///<br>2576 ///<br>2577 ///<br>2578 /// | | – | resp | 3 |

TABLE 2A-continued

Predictive Markers Upregulated Indicators of Non-Reponse and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 939 | 207739_s_at | HG-U133A | NM_001472 | 893 | G antigen 1 /// G antigen 2 /// G antigen 3 /// G antigen 4 /// G antigen 5 /// G antigen 6 /// G antigen 7 /// G antigen 7B /// G antigen 8 | GAGE7 /// GAGE7B /// GAGE8 GAGE1 /// GAGE2 /// GAGE3 /// GAGE4 /// GAGE5 /// GAGE6 /// GAGE7 /// GAGE7B /// GAGE8 | 2579 /// 26748 /// 26749 2543 /// 2574 /// 2575 /// 2576 /// 2577 /// 2578 /// 2579 /// 26748 /// 26749 | | – | resp | 5 |
| 940 | 207663_x_at | HG-U133A | NM_001473 | 894 | G antigen 3 | GAGE3 | 2575 | | – | resp | 8 |
| 941 | 205013_s_at | HG-U133A | NM_000675 | 895 | adenosine A2a receptor | ADORA2A | 135 | | – | resp | 13 |
| 942 | 201506_at | HG-U133A | NM_000358 | 896 | transforming growth factor, beta-induced, 68 kDa | TGFBI | 7045 | | – | resp | 17 |
| 943 | 241224_x_at | HG-U133B | AA770014 | 434 | Down syndrome critical region gene 8 | DSCR8 | 84677 | | – | resp | 21 |
| 944 | 204960_at | HG-U133A | NM_005608 | 897 | protein tyrosine phosphatase, receptor type, C-associated protein | PTPRCAP | 5790 | | – | resp | 24 |
| 945 | 235863_at | HG-U133B | AI805145 | 898 | homolog of mouse skeletal muscle sarcoplasmic reticulum protein JP-45 | FLJ32416 | 126306 | | – | resp | 28 |
| 946 | 228116_at | HG-U133B | AW167298 | 899 | Hypothetical LOC283029 | | 283029 | | – | resp | 29 |
| 947 | 208890_s_at | HG-U133A | BC004542 | 900 | plexin B2 | PLXNB2 | 23654 | | – | resp | 30 |
| 948 | 242881_x_at | HG-U133B | BG285837 | 901 | hypothetical LOC389048 | LOC389048 | 389048 | | – | resp | 33 |
| 949 | 212311_at | HG-U133A | AA522514 | 902 | KIAA0746 protein | KIAA0746 | 23231 | | – | resp | 35 |
| 950 | 224318_s_at | HG-U133B | AF311326 | 903 | hypothetical protein FLJ10081 | FLJ10081 | 55683 | | – | resp | 37 |
| 951 | 224806_at | HG-U133B | BE563152 | 904 | LOC440448 | | 440448 | | – | resp | 54 |
| 952 | 208072_s_at | HG-U133A | NM_003648 | 905 | diacylglycerol kinase, delta 130 kDa | DGKD | 8527 | | – | resp | 57 |
| 953 | 231887_s_at | HG-U133B | AB033100 | 906 | KIAA1274 | KIAA1274 | 27143 | | – | resp | 58 |
| 954 | 212443_at | HG-U133A | AB011112 | 907 | KIAA0540 protein | KIAA0540 | 23218 | | – | resp | 60 |
| 955 | 200859_x_at | HG-U133A | NM_001456 | 908 | filamin A, alpha (actin binding protein 280) | FLNA | 2316 | | – | resp | 63 |
| 956 | 204912_at | HG-U133A | NM_001558 | 909 | interleukin 10 receptor, alpha | IL10RA | 3587 | | – | resp | 66 |
| 957 | 211373_s_at | HG-U133A | U34349 | 910 | presenilin 2 (Alzheimer disease 4) | PSEN2 | 5664 | | – | resp | 68 |
| 958 | 213008_at | HG-U133A | BG403615 | 911 | hypothetical protein FLJ10719 | FLJ10719 | 55215 | | – | resp | 77 |
| 959 | 218695_at | HG-U133A | NM_019037 | 912 | exosome component 4 | EXOSC4 | 54512 | | – | resp | 77 |
| 960 | 43427_at | HG-U133A | AI970898 | 913 | hypothetical protein LOC283445 | LOC283445 | 283445 | | – | resp | 84 |
| 961 | 203523_at | HG-U133A | NM_002339 | 914 | lymphocyte-specific protein 1 | LSP1 | 4046 | | – | resp | 87 |
| 962 | 212287_at | HG-U133A | BF382924 | 915 | suppressor of zeste 12 homolog (*Drosophila*) | SUZ12 | 23512 | | – | resp | 88 |
| 963 | 203020_at | HG-U133A | NM_014857 | 916 | RAB GTPase activating protein 1-like | RABGAP1L | 9910 | | – | resp | 99 |
| 964 | 201071_x_at | HG-U133A | NM_012433 | 917 | splicing factor 3b, subunit 1, 155 kDa | SF3B1 | 23451 | | – | resp | 105 |
| 965 | 47553_at | HG-U133A | AA813332 | 918 | deafness, autosomal recessive 31 | DFNB31 | 25861 | | – | resp | 106 |
| 966 | 222244_s_at | HG-U133A | AK000749 | 919 | hypothetical protein FLJ20618 | FLJ20618 | 55000 | | – | resp | 117 |
| 967 | 208794_s_at | HG-U133A | D26156 | 920 | SWI/SNF related, matrix associated, actin dependent regulator of chromatin, subfamily a, member 4 | SMARCA4 | 6597 | | – | resp | 119 |
| 968 | 239481_at | HG-U133B | AI864183 | 921 | hypothetical protein FLJ37659 | FLJ37659 | 286499 | | – | resp | 133 |

TABLE 2A-continued

Predictive Markers Upregulated Indicators of Non-Reponse and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 969 | 208858_s_at | HG-U133A | BC004998 | 922 | likely ortholog of mouse membrane bound C2 domain containing protein | MBC2 | 23344 | – | | TTP | 3 |
| 970 | 200011_s_at | HG-U133A | NM_001659 | 923 | ADP-ribosylation factor 3 | ARF3 | 377 | – | | TTP | 16 |
| 971 | 201003_x_at | HG-U133A | NM_003349 | 924 | | | | – | | TTP | 18 |
| 972 | 216194_s_at | HG-U133A | AD001527 | 925 | cytoskeleton associated protein 1 | CKAP1 | 1155 | – | | TTP | 19 |
| 973 | 202670_at | HG-U133A | AI571419 | 926 | mitogen-activated protein kinase kinase 1 | MAP2K1 | 5604 | – | | TTP | 25 |
| 974 | 205903_s_at | HG-U133A | NM_002249 | 927 | potassium intermediate/small conductance calcium-activated channel, subfamily N, member 3 | KCNN3 | 3782 | – | | TTP | 26 |
| 975 | 226760_at | HG-U133B | BF666325 | 928 | hypothetical protein LOC203411 | LOC203411 | 203411 | – | | TTP | 29 |
| 976 | 204839_at | HG-U133A | NM_015918 | 929 | processing of precursor 5, ribonuclease P/MRP subunit (*S. cerevisiae*) | POP5 | 51367 | – | | TTP | 30 |
| 977 | 224233_s_at | HG-U133B | BC002535 | 930 | misato | FLJ10504 | 55154 | – | | TTP | 36 |
| 978 | 204808_s_at | HG-U133A | NM_014254 | 931 | transmembrane protein 5 | TMEM5 | 10329 | – | | TTP | 42 |
| 979 | 212013_at | HG-U133A | D86983 | 932 | Melanoma associated gene | D2S448 | 7837 | – | | TTP | 43 |
| 980 | 201012_at | HG-U133A | NM_000700 | 733 | annexin A1 | ANXA1 | 301 | – | | TTP | 47 |
| 981 | 225685_at | HG-U133B | AI801777 | 933 | CDC42 effector protein (Rho GTPase binding) 3 | CDC42EP3 | 10602 | – | | TTP | 48 |
| 982 | 202001_s_at | HG-U133A | NM_002490 | 934 | NADH dehydrogenase (ubiquinone) 1 alpha subcomplex, 6, 14 kDa | NDUFA6 | 4700 | – | | TTP | 51 |
| 983 | 202911_at | HG-U133A | NM_000179 | 935 | mutS homolog 6 (*E. coli*) | MSH6 | 2956 | – | | TTP | 52 |
| 984 | 221807_s_at | HG-U133A | BG399562 | 936 | hypothetical protein PP2447 | PP2447 | 80305 | – | | TTP | 53 |
| 985 | 210978_s_at | HG-U133A | BC002616 | 937 | transgelin 2 | TAGLN2 | 8407 | – | | TTP | 54 |
| 986 | 201475_x_at | HG-U133A | NM_004990 | 938 | methionine-tRNA synthetase | MARS | 4141 | – | | TTP | 60 |
| 987 | 207918_s_at | HG-U133A | NM_003308 | 939 | testis specific protein, Y-linked 1 /// testis specific protein, Y-linked 2 | TSPY1 /// TSPY2 | 64591 /// 7258 | – | | TTP | 65 |
| 988 | 208270_s_at | HG-U133A | NM_020216 | 940 | arginyl aminopeptidase (aminopeptidase B) | RNPEP | 6051 | – | | TTP | 66 |
| 989 | 201157_s_at | HG-U133A | AF020500 | 941 | N-myristoyltransferase 1 | NMT1 | 4836 | – | | TTP | 67 |
| 990 | 218135_at | HG-U133A | NM_016570 | 942 | PTX1 protein | PTX1 | 51290 | – | | TTP | 76 |
| 991 | 222606_at | HG-U133B | AA824298 | 943 | | | | – | | TTP | 83 |
| 992 | 208679_s_at | HG-U133A | AF279893 | 944 | actin related protein 2/3 complex, subunit 2, 34 kDa | ARPC2 | 10109 | – | | TTP | 84 |
| 993 | 215171_s_at | HG-U133A | AK023063 | 945 | translocase of inner mitochondrial membrane 17 homolog A (yeast) | TIMM17A | 10440 | – | | TTP | 86 |
| 994 | 208284_x_at | HG-U133A | NM_013421 | 946 | gamma-glutamyltransferase 1 | GGT1 | 2678 | – | | TTP | 92 |
| 995 | 230172_at | HG-U133B | AL039706 | 947 | family with sequence similarity 14, member B | FAM14B | 122509 | – | | TTP | 95 |
| 996 | 217900_at | HG-U133A | NM_018060 | 948 | mitochondrial isoleucine tRNA synthetase | FLJ10326 | 55699 | – | | TTP | 96 |
| 997 | 201804_x_at | HG-U133A | NM_001281 | 949 | cytoskeleton associated protein 1 | CKAP1 | 1155 | – | | TTP | 107 |
| 998 | 231736_x_at | HG-U133B | NM_020300 | 950 | microsomal glutathione S-transferase 1 | MGST1 | 4257 | – | | TTP | 110 |
| 999 | 201966_at | HG-U133A | NM_004550 | 951 | NADH dehydrogenase (ubiquinone) Fe—S protein 2, 49 kDa (NADH-coenzyme Q reductase) | NDUFS2 | 4720 | – | | TTP | 112 |
| 1000 | 212024_x_at | HG-U133A | U80184 | 952 | flightless I homolog (*Drosophila*) | FLII | 2314 | – | | TTP | 115 |
| 1001 | 200980_s_at | HG-U133A | NM_000284 | 953 | pyruvate dehydrogenase (lipoamide) alpha 1 | PDHA1 | 5160 | – | | TTP | 116 |
| 1002 | 218296_x_at | HG-U133A | NM_018116 | 954 | misato | FLJ10504 | 55154 | – | | TTP | 117 |
| 1003 | 232520_s_at | HG-U133B | AK023585 | 955 | NSFL1 (p97) cofactor (p47) | NSFL1C | 55968 | – | | TTP | 120 |
| 1004 | 218556_at | HG-U133A | NM_014182 | 956 | ORM1-like 2 (*S. cerevisiae*) | ORMDL2 | 29095 | – | | TTP | 124 |

TABLE 2A-continued

Predictive Markers Upregulated Indicators of Non-Reponse and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 1005 | 203371_s_at | HG-U133A | NM_002491 | 957 | NADH dehydrogenase (ubiquinone) 1 beta subcomplex, 3, 12 kDa | NDUFB3 | 4709 | – | | TTP | 126 |
| 1006 | 209919_x_at | HG-U133A | L20490 | 958 | gamma-glutamyltransferase 1 | GGT1 | 2678 | – | | TTP | 129 |
| 1007 | 217966_s_at | HG-U133A | NM_022083 | 959 | chromosome 1 open reading frame 24 | C1orf24 | 116496 | – | | TTP | 136 |
| 1008 | 218720_x_at | HG-U133A | NM_012410 | 960 | seizure related 6 homolog (mouse)-like 2 | SEZ6L2 | 26470 | – | | TTP | 141 |
| 1009 | 214853_s_at | HG-U133A | AI091079 | 961 | SHC (Src homology 2 domain containing) transforming protein 1 | SHC1 | 6464 | – | | TTP | 144 |
| 1010 | 212012_at | HG-U133A | BF342851 | 962 | Melanoma associated gene | D2S448 | 7837 | – | | TTP | 145 |
| 1011 | 214749_s_at | HG-U133A | AK000818 | 963 | armadillo repeat containing, X-linked 6 | ARMCX6 | 54470 | – | | TTP | 147 |
| 1012 | 202017_at | HG-U133A | NM_000120 | 964 | epoxide hydrolase 1, microsomal (xenobiotic) | EPHX1 | 2052 | – | | TTP | 148 |
| 1013 | 225313_at | HG-U133B | AI627538 | 965 | chromosome 20 open reading frame 177 | C20orf177 | 63939 | – | | TTP | 151 |
| 1014 | 217967_s_at | HG-U133A | AF288391 | 966 | chromosome 1 open reading frame 24 | C1orf24 | 116496 | – | | TTP | 154 |
| 1015 | 205902_at | HG-U133A | AJ251016 | 967 | potassium intermediate/small conductance calcium-activated channel, subfamily N, member 3 | KCNN3 | 3782 | – | | TTP | 161 |
| 1016 | 200616_s_at | HG-U133A | BC000371 | 968 | KIAA0152 | KIAA0152 | 9761 | – | | TTP | 162 |
| 1017 | 201387_s_at | HG-U133A | NM_004181 | 969 | ubiquitin carboxyl-terminal esterase L1 (ubiquitin thiolesterase) | UCHL1 | 7345 | – | | TTP | 171 |
| 1018 | 200916_at | HG-U133A | NM_003564 | 970 | transgelin 2 | TAGLN2 | 8407 | – | | TTP | 180 |
| 1019 | 224955_at | HG-U133B | AI590088 | 971 | TEA domain family member 1 (SV40 transcriptional enhancer factor) | TEAD1 | 7003 | – | | TTP | 183 |
| 1020 | 244040_at | HG-U133B | N47474 | 972 | Potassium intermediate/small conductance calcium-activated channel, subfamily N, member 3 | KCNN3 | 3782 | – | | TTP | 185 |
| 1021 | 212371_at | HG-U133A | AL049397 | 973 | CGI-146 protein | PNAS-4 | 51029 | – | | TTP | 186 |
| 1022 | 238761_at | HG-U133B | BE645241 | 974 | Mediator of RNA polymerase II transcription, subunit 28 homolog (yeast) | MED28 | 80306 | – | | TTP | 187 |
| 1023 | 216705_s_at | HG-U133A | X02189 | 975 | adenosine deaminase | ADA | 100 | – | – | resp | 6 |
| 1024 | 218058_at | HG-U133A | NM_014593 | 976 | CXXC finger 1 (PHD domain) | CXXC1 | 30827 | – | – | resp | 7 |
| 1025 | 201377_at | HG-U133A | NM_014847 | 977 | ubiquitin associated protein 2-like | UBAP2L | 9898 | – | – | resp | 17 |
| 1026 | 204639_at | HG-U133A | NM_000022 | 978 | adenosine deaminase | ADA | 100 | – | – | resp | 21 |
| 1027 | 201307_at | HG-U133A | AL534972 | 979 | septin 11 | SEPT11 | 55752 | – | – | resp | 22 |
| 1028 | 225105_at | HG-U133B | BF969397 | 980 | hypothetical protein | LOC387882 | 387882 | – | – | resp | 41 |
| 1029 | 209836_x_at | HG-U133A | AF060511 | 981 | LAT1-3TM protein | LAT1-3TM | 81893 | – | – | resp | 43 |
| 1030 | 201897_s_at | HG-U133A | NM_001826 | 982 | CDC28 protein kinase regulatory subunit 1B | CKS1B | 1163 | – | – | resp | 53 |
| 1031 | 201349_at | HG-U133A | NM_004252 | 983 | solute carrier family 9 (sodium/hydrogen exchanger), isoform 3 regulator 1 | SLC9A3R1 | 9368 | – | – | resp | 66 |
| 1032 | 217836_s_at | HG-U133A | NM_018253 | 984 | YY1 associated protein 1 | YY1AP1 | 55249 | – | – | resp | 70 |
| 1033 | 208972_s_at | HG-U133A | AL080089 | 985 | ATP synthase, H+ transporting, mitochondrial F0 complex, subunit c (subunit 9), isoform 1 | ATP5G1 | 516 | – | – | resp | 71 |
| 1034 | 226219_at | HG-U133B | AW575123 | 986 | hypothetical protein LOC257106 | LOC257106 | 257106 | – | – | resp | 88 |
| 1035 | 202403_s_at | HG-U133A | AA788711 | 987 | collagen, type I, alpha 2 | COL1A2 | 1278 | – | – | TTP | 1 |
| 1036 | 213513_x_at | HG-U133A | BG034239 | 988 | actin related protein 2/3 complex, subunit 2, 34 kDa | ARPC2 | 10109 | – | – | TTP | 2 |
| 1037 | 207988_s_at | HG-U133A | NM_005731 | 989 | actin related protein 2/3 complex, subunit 2, 34 kDa | ARPC2 | 10109 | – | – | TTP | 6 |

TABLE 2A-continued

Predictive Markers Upregulated Indicators of Non-Reponse and/or Short Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 1038 | 207493_x_at | HG-U133A | NM_003147 | 990 | synovial sarcoma, X breakpoint 2 | SSX2 | 6757 | – | – | TTP | 13 |
| 1039 | 218151_x_at | HG-U133A | NM_024531 | 991 | G protein-coupled receptor 172A | GPR172A | 79581 | – | – | TTP | 15 |
| 1040 | 222518_at | HG-U133B | BF525399 | 992 | ADP-ribosylation factor guanine nucleotide-exchange factor 2 (brefeldin A-inhibited) | ARFGEF2 | 10564 | – | – | TTP | 47 |
| 1041 | 218041_x_at | HG-U133A | NM_018573 | 993 | solute carrier family 38, member 2 | SLC38A2 | 54407 | – | – | TTP | 53 |
| 1042 | 217871_s_at | HG-U133A | NM_002415 | 994 | macrophage migration inhibitory factor (glycosylation-inhibiting factor) | MIF | 4282 | – | – | TTP | 108 |
| 1043 | 215603_x_at | HG-U133A | AI344075 | 995 | gamma-glutamyltransferase 1 /// gamma-glutamyltransferase-like 4 | GGT1 /// GGTL4 | 2678 /// 91227 | – | – | TTP/resp | 3 |
| 1044 | 202671_s_at | HG-U133A | NM_003681 | 996 | pyridoxal (pyridoxine, vitamin B6) kinase | PDXK | 8566 | – | – | TTP/resp | 7 |
| 1045 | 243606_at | HG-U133B | BE883167 | 997 | Transcribed locus, moderately similar to NP_055301.1 neuronal thread protein AD7c-NTP [*Homo sapiens*] | | | – | – | TTP/resp | 8 |
| 1046 | 216829_at | HG-U133A | X72475 | 998 | immunoglobulin kappa constant | IGKC | 3514 | – | – | TTP/resp | 12 |
| 1047 | 207131_x_at | HG-U133A | NM_013430 | 999 | gamma-glutamyltransferase 1 | GGT1 | 2678 | – | – | TTP/resp | 21 |
| 1048 | 212539_at | HG-U133A | AI422099 | 1000 | chromodomain helicase DNA binding protein 1-like | CHD1L | 9557 | – | – | TTP/resp | 26 |
| 1049 | 221676_s_at | HG-U133A | BC002342 | 1001 | coronin, actin binding protein, 1C | CORO1C | 23603 | – | – | TTP/resp | 31 |
| 1050 | 221970_s_at | HG-U133A | AU158148 | 1002 | DKFZP586L0724 protein | DKFZP586L0724 | 25926 | – | – | TTP/resp | 31 |
| 1051 | 200991_s_at | HG-U133A | NM_014748 | 1003 | sorting nexin 17 | SNX17 | 9784 | – | – | TTP/resp | 34 |
| 1052 | 218592_s_at | HG-U133A | NM_017829 | 1004 | cat eye syndrome chromosome region, candidate 5 | CECR5 | 27440 | – | – | TTP/resp | 42 |
| 1053 | 205213_at | HG-U133A | NM_014716 | 1005 | centaurin, beta 1 | CENTB1 | 9744 | – | – | TTP/resp | 43 |
| 1054 | 229711_s_at | HG-U133B | AA902480 | 1006 | Carboxypeptidase M | CPM | 1368 | – | – | TTP/resp | 45 |
| 1055 | 211759_x_at | HG-U133A | BC005969 | 1007 | cytoskeleton associated protein 1 | CKAP1 | 1155 | – | – | TTP/resp | 46 |
| 1056 | 205788_s_at | HG-U133A | NM_014827 | 1008 | | | | – | – | TTP/resp | 49 |
| 1057 | 200793_s_at | HG-U133A | NM_001098 | 1009 | aconitase 2, mitochondrial | ACO2 | 50 | – | – | TTP/resp | 56 |
| 1058 | 211417_x_at | HG-U133A | L20493 | 1010 | gamma-glutamyltransferase 1 | GGT1 | 2678 | – | – | TTP/resp | 61 |
| 1059 | 208095_s_at | HG-U133A | NM_001222 | 1011 | signal recognition particle 72 kDa | SRP72 | 6731 | – | – | TTP/resp | 66 |
| 1060 | 200782_at | HG-U133A | NM_001154 | 1012 | annexin A5 | ANXA5 | 308 | – | – | TTP/resp | 72 |
| 1061 | 218014_at | HG-U133A | NM_024844 | 1013 | pericentrin 1 | PCNT1 | 79902 | – | – | TTP/resp | 75 |
| 1062 | 223096_at | HG-U133B | AF161469 | 1014 | nucleolar protein NOP5/NOP58 | NOP5/NOP58 | 51602 | – | – | TTP/resp | 112 |
| 1063 | 232010_at | HG-U133B | AA129444 | 1015 | follistatin-like 5 | FSTL5 | 56884 | | – | resp | 27 |
| 1064 | 227167_s_at | HG-U133B | AW511319 | 1016 | Mesenchymal stem cell protein DSC96 | | | – | | TTP | 14 |
| 1065 | 224918_x_at | HG-U133B | AI220117 | 1017 | microsomal glutathione S-transferase 1 | MGST1 | 4257 | – | | TTP | 105 |
| 1066 | 225904_at | HG-U133B | N64686 | 1018 | LOC126731 | LOC126731 | 126731 | – | – | resp | 13 |
| 1067 | 235353_at | HG-U133B | AI887866 | 1019 | KIAA0746 protein | KIAA0746 | 23231 | | – | resp | 46 |
| 1068 | 203606_at | HG-U133A | NM_004553 | 1020 | NADH dehydrogenase (ubiquinone) Fe—S protein 6, 13 kDa (NADH-coenzyme Q reductase) | NDUFS6 | 4726 | | – | resp | 127 |
| 1069 | 208683_at | HG-U133A | M23254 | 1021 | calpain 2, (m/II) large subunit | CAPN2 | 824 | – | | TTP | 177 |
| 1070 | 200734_s_at | HG-U133A | BG341906 | 1022 | ADP-ribosylation factor 3 | ARF3 | 377 | – | – | TTP/resp | 5 |

TABLE 2B

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 1071 | 229233_at | HG-U133B | H05240 | 1023 | neuregulin 3 | NRG3 | 10718 | | + | resp | 1 |
| 1072 | 225524_at | HG-U133B | AU152178 | 1024 | anthrax toxin receptor 2 | ANTXR2 | 118429 | | + | resp | 4 |
| 1073 | 201465_s_at | HG-U133A | BC002646 | 1025 | v-jun sarcoma virus 17 oncogene homolog (avian) | JUN | 3725 | | + | resp | 6 |
| 1074 | 201464_x_at | HG-U133A | BG491844 | 1026 | v-jun sarcoma virus 17 oncogene homolog (avian) | JUN | 3725 | | + | resp | 11 |
| 1075 | 217731_s_at | HG-U133A | NM_021999 | 1027 | integral membrane protein 2B | ITM2B | 9445 | | + | resp | 12 |
| 1076 | 208961_s_at | HG-U133A | AB017493 | 1028 | Kruppel-like factor 6 | KLF6 | 1316 | | + | resp | 14 |
| 1077 | 230493_at | HG-U133B | AW664964 | 1029 | WGAR9166 | LOC387914 | 387914 | | + | resp | 15 |
| 1078 | 221220_s_at | HG-U133A | NM_017988 | 1030 | SCY1-like 2 (*S. cerevisiae*) | SCYL2 | 55681 | | + | resp | 16 |
| 1079 | 211560_s_at | HG-U133A | AF130113 | 1031 | aminolevulinate, delta-, synthase 2 (sideroblastic/hypochromic anemia) | ALAS2 | 212 | | + | resp | 19 |
| 1080 | AFFX-r2- | HG-U133A Hs18SrRNA-5_at | AFFX-r2-Hs18SrRNA-5 | | | | | | + | resp | 22 |
| 1081 | 220751_s_at | HG-U133A | NM_016348 | 1032 | chromosome 5 open reading frame 4 | C5orf4 | 10826 | | + | resp | 23 |
| 1082 | 201432_at | HG-U133A | NM_001752 | 1033 | catalase | CAT | 847 | | + | resp | 24 |
| 1083 | 206871_at | HG-U133A | NM_001972 | 1034 | elastase 2, neutrophil | ELA2 | 1991 | | + | resp | 24 |
| 1084 | 208781_x_at | HG-U133A | AF062483 | 1035 | sorting nexin 3 | SNX3 | 8724 | | + | resp | 32 |
| 1085 | 202687_s_at | HG-U133A | U57059 | 1036 | tumor necrosis factor (ligand) superfamily, member 10 | TNFSF10 | 8743 | | + | resp | 33 |
| 1086 | 212603_at | HG-U133A | NM_005830 | 1037 | mitochondrial ribosomal protein S31 | MRPS31 | 10240 | | + | resp | 34 |
| 1087 | 217144_at | HG-U133A | X04801 | 1038 | ubiquitin B | UBB | 7314 | | + | resp | 34 |
| 1088 | AFFX-HUMRGE/M10098_5_at | HG-U133A | AFFX-HUMRGE/M10098_5 | | | | | | + | resp | 35 |
| 1089 | 208960_s_at | HG-U133A | BE675435 | 1039 | Kruppel-like factor 6 | KLF6 | 1316 | | + | resp | 38 |
| 1090 | 224688_at | HG-U133B | BE962299 | 1040 | Hypothetical protein FLJ10099 | FLJ10099 | 55069 | | + | resp | 40 |
| 1091 | 209930_s_at | HG-U133A | L13974 | 1041 | nuclear factor (erythroid-derived 2), 45 kDa | NFE2 | 4778 | | + | resp | 42 |
| 1092 | 224606_at | HG-U133B | BG250721 | 1042 | *Homo sapiens*, clone IMAGE: 4096273, mRNA | | | | + | resp | 42 |
| 1093 | 205225_at | HG-U133A | NM_000125 | 1043 | estrogen receptor 1 | ESR1 | 2099 | | + | resp | 46 |
| 1094 | AFFX-r2-Hs18SrRNA-5_at | HG-U133B | AFFX-r2-Hs18SrRNA-5 | | | | | + | resp | 46 | |
| 1095 | 205383_s_at | HG-U133A | NM_015642 | 1044 | zinc finger and BTB domain containing 20 | ZBTB20 | 26137 | | + | resp | 47 |
| 1096 | 207459_x_at | HG-U133A | NM_002100 | 1045 | glycophorin B (includes Ss blood group) | GYPB | 2994 | | + | resp | 50 |
| 1097 | 221824_s_at | HG-U133A | AA770170 | 1046 | membrane-associated ring finger (C3HC4) 8 | MARCH8 | 220972 | | + | resp | 56 |
| 1098 | 210504_at | HG-U133A | U65404 | 1047 | Kruppel-like factor 1 (erythroid) | KLF1 | 10661 | | + | resp | 57 |
| 1099 | 56256_at | HG-U133A | AA150165 | 1048 | SID1 transmembrane family, member 2 | SIDT2 | 51092 | | + | resp | 57 |
| 1100 | 214407_x_at | HG-U133A | AI240545 | 1049 | glycophorin B (includes Ss blood group) | GYPB | 2994 | | + | resp | 58 |
| 1101 | 213281_at | HG-U133A | BE327172 | 1050 | | | | | + | resp | 61 |
| 1102 | 228360_at | HG-U133B | BF060747 | 1051 | hypothetical protein LOC130576 | LOC130576 | 130576 | | + | resp | 69 |
| 1103 | 205389_s_at | HG-U133A | AI659683 | 1052 | ankyrin 1, erythrocytic | ANK1 | 286 | | + | resp | 74 |
| 1104 | 209140_x_at | HG-U133A | L42024 | 1053 | major histocompatibility complex, class I, B | HLA-B | 3106 | | + | resp | 76 |

TABLE 2B-continued

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 1105 | 205838_at | HG-U133A | NM_002099 | 1054 | glycophorin A (includes MN blood group) | GYPA | 2993 | | + | resp | 79 |
| 1106 | 216389_s_at | HG-U133A | AF283773 | 1055 | WD repeat domain 23 | WDR23 | 80344 | | + | resp | 79 |
| 1107 | AFFX-HUMRGE/M10098_5_at | HG-U133B | AFFX-HUMRGE/M10098_5 | | | | | | + | resp | 80 |
| 1108 | 202364_at | HG-U133A | NM_005962 | 1056 | MAX interactor 1 | MXI1 | 4601 | | + | resp | 81 |
| 1109 | 223309_x_at | HG-U133B | BG025248 | 1057 | intracellular membrane-associated calcium-independent phospholipase A2 gamma | IPLA2(GAMMA) | 50640 | | + | resp | 83 |
| 1110 | 219497_s_at | HG-U133A | NM_022893 | 1058 | B-cell CLL/lymphoma 11A (zinc finger protein) | BCL11A | 53335 | | + | resp | 88 |
| 1111 | 206834_at | HG-U133A | NM_000519 | 1059 | hemoglobin, delta | HBD | 3045 | | + | resp | 89 |
| 1112 | 210648_x_at | HG-U133A | AB047360 | 1060 | sorting nexin 3 | SNX3 | 8724 | | + | resp | 97 |
| 1113 | 211820_x_at | HG-U133A | U00179 | 1061 | glycophorin A (includes MN blood group) | GYPA | 2993 | | + | resp | 116 |
| 1114 | 208621_s_at | HG-U133A | BF663141 | 1062 | villin 2 (ezrin) | VIL2 | 7430 | | + | resp | 5 |
| 1115 | 213515_x_at | HG-U133A | AI133353 | 1063 | hemoglobin, gamma G | HBG2 | 3048 | | + | resp | 9 |
| 1116 | 217732_s_at | HG-U133A | AF092128 | 1064 | integral membrane protein 2B | ITM2B | 9445 | | + | resp | 9 |
| 1117 | 223952_x_at | HG-U133B | AF240698 | 1065 | dehydrogenase/reductase (SDR family) member 9 | DHRS9 | 10170 | | + | resp | 10 |
| 1118 | 204419_x_at | HG-U133A | NM_000184 | 1066 | hemoglobin, gamma G | HBG2 | 3048 | | + | resp | 11 |
| 1119 | 204848_x_at | HG-U133A | NM_000559 | 1067 | hemoglobin, gamma A /// hemoglobin, gamma G | HBG1 /// HBG2 | 3047 /// 3048 | | + | resp | 12 |
| 1120 | 218717_s_at | HG-U133A | NM_018192 | 1068 | leprecan-like 1 | LEPREL1 | 55214 | | + | resp | 13 |
| 1121 | 221911_at | HG-U133A | BE881590 | 1069 | hypothetical protein LOC221810 | LOC221810 | 221810 | | + | resp | 14 |
| 1122 | 224009_x_at | HG-U133B | AF240697 | 1070 | dehydrogenase/reductase (SDR family) member 9 | DHRS9 | 10170 | | + | resp | 16 |
| 1123 | 235278_at | HG-U133B | BF032500 | 1071 | *Homo sapiens*, clone IMAGE: 4513167, mRNA | | | | + | resp | 18 |
| 1124 | 234419_x_at | HG-U133B | AJ275401 | 1072 | | | | | + | resp | 20 |
| 1125 | 234390_x_at | HG-U133B | Z27446 | 1073 | IG rearranged H-chain mRNA V-region | | | | + | resp | 21 |
| 1126 | 216542_x_at | HG-U133A | AJ275355 | 1074 | hypothetical protein MGC27165 | MGC27165 | 283650 | | + | resp | 22 |
| 1127 | 219799_s_at | HG-U133A | NM_005771 | 1075 | dehydrogenase/reductase (SDR family) member 9 | DHRS9 | 10170 | | + | resp | 26 |
| 1128 | 221841_s_at | HG-U133A | BF514079 | 1076 | Kruppel-like factor 4 (gut) | KLF4 | 9314 | | + | resp | 27 |
| 1129 | 206181_at | HG-U133A | NM_003037 | 1077 | signaling lymphocytic activation molecule family member 1 | SLAMF1 | 6504 | | + | resp | 29 |
| 1130 | 219377_at | HG-U133A | NM_022751 | 1078 | chromosome 18 open reading frame 11 | C18orf11 | 64762 | | + | resp | 30 |
| 1131 | 228415_at | HG-U133B | AA205444 | 1079 | Adaptor-related protein complex 1, sigma 2 subunit | AP1S2 | 8905 | | + | resp | 31 |
| 1132 | 204466_s_at | HG-U133A | BG260394 | 1080 | synuclein, alpha (non A4 component of amyloid precursor) | SNCA | 6622 | | + | resp | 38 |
| 1133 | 203751_x_at | HG-U133A | AI762296 | 1081 | jun D proto-oncogene | JUND | 3727 | | + | resp | 44 |
| 1134 | 220059_at | HG-U133A | NM_012108 | 1082 | BCR downstream signaling 1 | BRDG1 | 26228 | | + | resp | 49 |
| 1135 | 203502_at | HG-U133A | NM_001724 | 1083 | 2,3-bisphosphoglycerate mutase | BPGM | 669 | | + | resp | 51 |
| 1136 | 217865_at | HG-U133A | NM_018434 | 1084 | ring finger protein 130 | RNF130 | 55819 | | + | resp | 51 |
| 1137 | 202206_at | HG-U133A | AW450363 | 1085 | ADP-ribosylation factor-like 7 | ARL7 | 10123 | | + | resp | 52 |
| 1138 | 209968_s_at | HG-U133A | U63041 | 1086 | neural cell adhesion molecule 1 | NCAM1 | 4684 | | + | resp | 52 |
| 1139 | 208729_x_at | HG-U133A | D83043 | 1087 | major histocompatibility complex, class I, B | HLA-B | 3106 | | + | resp | 53 |

TABLE 2B-continued

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 1140 | 208029_s_at | HG-U133A | NM_018407 | 1088 | lysosomal associated protein transmembrane 4 beta | LAPTM4B | 55353 | | + | resp | 54 |
| 1141 | 217478_s_at | HG-U133A | X76775 | 1089 | major histocompatibility complex, class II, DM alpha | HLA-DMA | 3108 | | + | resp | 55 |
| 1142 | 201849_at | HG-U133A | NM_004052 | 1090 | BCL2/adenovirus E1B 19 kDa interacting protein 3 | BNIP3 | 664 | | + | resp | 58 |
| 1143 | 216833_x_at | HG-U133A | U05255 | 1091 | glycophorin B (includes Ss blood group) /// glycophorin E | GYPB /// GYPE | 2994 /// 2996 | | + | resp | 61 |
| 1144 | 37028_at | HG-U133A | U83981 | 1092 | protein phosphatase 1, regulatory (inhibitor) subunit 15A | PPP1R15A | 23645 | | + | resp | 74 |
| 1145 | 209357_at | HG-U133A | AF109161 | 1093 | Cbp/p300-interacting transactivator, with Glu/Asp-rich carboxy-terminal domain, 2 | CITED2 | 10370 | | + | resp | 75 |
| 1146 | 209295_at | HG-U133A | AF016266 | 1094 | tumor necrosis factor receptor superfamily, member 10b | TNFRSF10B | 8795 | | + | resp | 82 |
| 1147 | 202511_s_at | HG-U133A | AK001899 | 1095 | APG5 autophagy 5-like (*S. cerevisiae*) | APG5L | 9474 | | + | resp | 86 |
| 1148 | 208812_x_at | HG-U133A | BC004489 | 1096 | major histocompatibility complex, class I, B /// major histocompatibility complex, class I, C | HLA-B /// HLA-C | 3106 /// 3107 | | + | resp | 91 |
| 1149 | 204992_s_at | HG-U133A | NM_002628 | 1097 | profilin 2 | PFN2 | 5217 | | + | resp | 92 |
| 1150 | 203685_at | HG-U133A | NM_000633 | 1098 | B-cell CLL/lymphoma 2 | BCL2 | 596 | | + | resp | 93 |
| 1151 | 224693_at | HG-U133B | AI133137 | 1099 | chromosome 20 open reading frame 108 | C20orf108 | 116151 | | + | resp | 94 |
| 1152 | 211530_x_at | HG-U133A | M90686 | 1100 | HLA-G histocompatibility antigen, class I, G | HLA-G | 3135 | | + | resp | 98 |
| 1153 | 204621_s_at | HG-U133A | AI935096 | 1101 | nuclear receptor subfamily 4, group A, member 2 | NR4A2 | 4929 | | + | resp | 102 |
| 1154 | 200633_at | HG-U133A | NM_018955 | 1102 | ubiquitin B | UBB | 7314 | | + | resp | 104 |
| 1155 | 221004_s_at | HG-U133A | NM_030926 | 1103 | integral membrane protein 2C | ITM2C | 81618 | | + | resp | 105 |
| 1156 | 229713_at | HG-U133B | AW665227 | 1104 | | | | | + | resp | 108 |
| 1157 | 203428_s_at | HG-U133A | AB028628 | 1105 | ASF1 anti-silencing function 1 homolog A (*S. cerevisiae*) | ASF1A | 25842 | | + | resp | 110 |
| 1158 | 218858_at | HG-U133A | NM_022783 | 1106 | DEP domain containing 6 | DEPDC6 | 64798 | | + | resp | 116 |
| 1159 | 204622_x_at | HG-U133A | NM_006186 | 1107 | nuclear receptor subfamily 4, group A, member 2 | NR4A2 | 4929 | | + | resp | 117 |
| 1160 | 200628_s_at | HG-U133A | M61715 | 1108 | tryptophanyl-tRNA synthetase | WARS | 7453 | | + | resp | 124 |
| 1161 | 216248_s_at | HG-U133A | S77154 | 1109 | nuclear receptor subfamily 4, group A, member 2 | NR4A2 | 4929 | | + | resp | 130 |
| 1162 | 235341_at | HG-U133B | AL119957 | 1110 | DnaJ (Hsp40) homolog, subfamily C, member 3 | DNAJC3 | 5611 | | + | resp | 135 |
| 1163 | 200905_x_at | HG-U133A | NM_005516 | 1111 | major histocompatibility complex, class I, E | HLA-E | 3133 | + | | TTP | 64 |
| 1164 | 218539_at | HG-U133A | NM_017943 | 1112 | F-box protein 34 | FBXO34 | 55030 | + | | TTP | 68 |
| 1165 | 200912_s_at | HG-U133A | NM_001967 | 1113 | eukaryotic translation initiation factor 4A, isoform2 | EIF4A2 | 1974 | + | | TTP | 69 |
| 1166 | 217456_x_at | HG-U133A | M31183 | 1114 | major histocompatibility complex, class I, E | HLA-E | 3133 | + | | TTP | 85 |
| 1167 | 212510_at | HG-U133A | AA135522 | 1115 | glycerol-3-phosphate dehydrogenase 1-like | GPD1L | 23171 | + | | TTP | 98 |
| 1168 | 201334_s_at | HG-U133A | AB002380 | 1116 | Rho guanine nucleotide exchange factor (GEF) 12 | ARHGEF12 | 23365 | + | | TTP | 130 |
| 1169 | 202333_s_at | HG-U133A | AA877765 | 1117 | ubiquitin-conjugating enzyme E2B (RAD6 homolog) | UBE2B | 7320 | + | | TTP | 131 |
| 1170 | 214080_x_at | HG-U133A | AI815793 | 1118 | protein kinase C substrate 80K-H | PRKCSH | 5589 | + | | TTP | 138 |
| 1171 | 223356_s_at | HG-U133B | BG529919 | 1119 | mitochondrial translational initiation factor 3 | MTIF3 | 219402 | + | | TTP | 139 |
| 1172 | 201886_at | HG-U133A | NM_025230 | 1120 | WD repeat domain 23 | WDR23 | 80344 | + | | TTP | 146 |

TABLE 2B-continued

Predictive Markers Upregulated Indicators of Response and/or Long Time to Progression

| No. | ProbeSet ID | chip | Rep Public ID | SEQ ID NO: | Title | Gene Symbol | Entrez Gene ID | TTP marker | Response marker | Type of specificity | Rank |
|---|---|---|---|---|---|---|---|---|---|---|---|
| 1173 | 228831_s_at | HG-U133B | AL039870 | 1121 | guanine nucleotide binding protein (G protein), gamma 7 | GNG7 | 2788 | + | | TTP | 167 |
| 1174 | 201637_s_at | HG-U133A | NM_005087 | 1122 | fragile X mental retardation, autosomal homolog 1 | FXR1 | 8087 | + | | TTP | 170 |
| 1175 | 202812_at | HG-U133A | NM_000152 | 1123 | glucosidase, alpha; acid (Pompe disease, glycogen storage disease type II) | GAA | 2548 | + | | TTP | 174 |
| 1176 | 201871_s_at | HG-U133A | NM_015853 | 1124 | ORF | LOC51035 | 51035 | + | | TTP | 182 |
| 1177 | 225582_at | HG-U133B | AA425726 | 1125 | KIAA1754 | KIAA1754 | 85450 | + | + | resp | 1 |
| 1178 | 208855_s_at | HG-U133A | AF083420 | 1126 | serine/threonine kinase 24 (STE20 homolog, yeast) | STK24 | 8428 | + | + | TTP | 27 |
| 1179 | 212760_at | HG-U133A | AB002347 | 1127 | ubiquitin protein ligase E3 component n-recognin 2 | UBR2 | 23304 | + | + | TTP | 30 |
| 1180 | 203836_s_at | HG-U133A | D84476 | 1128 | mitogen-activated protein kinase kinase kinase 5 | MAP3K5 | 4217 | + | + | TTP | 40 |
| 1181 | 221555_x_at | HG-U133A | AU145941 | 1129 | CDC14 cell division cycle 14 homolog B (*S. cerevisiae*) | CDC14B | 8555 | + | + | TTP | 44 |
| 1182 | 209966_x_at | HG-U133A | AF094518 | 1130 | estrogen-related receptor gamma | ESRRG | 2104 | + | + | TTP/resp | 14 |
| 1183 | 210347_s_at | HG-U133A | AF080216 | 1131 | B-cell CLL/lymphoma 11A (zinc finger protein) | BCL11A | 53335 | + | + | TTP/resp | 23 |
| 1184 | 201466_s_at | HG-U133A | NM_002228 | 1132 | v-jun sarcoma virus 17 oncogene homolog (avian) | JUN | 3725 | + | + | TTP/resp | 34 |
| 1185 | 204710_s_at | HG-U133A | NM_016003 | 1133 | WIPI49-like protein 2 | WIPI-2 | 26100 | + | + | TTP/resp | 80 |
| 1186 | 209054_s_at | HG-U133A | AF083389 | 1134 | Wolf-Hirschhorn syndrome candidate 1 | WHSC1 | 7468 | | + | resp | 33 |
| 1187 | 222891_s_at | HG-U133B | AI912275 | 1135 | B-cell CLL/lymphoma 11A (zinc finger protein) | BCL11A | 53335 | | + | resp | 35 |
| 1188 | 219759_at | HG-U133A | NM_022350 | 1136 | leukocyte-derived arginine aminopeptidase | LRAP | 64167 | | + | resp | 40 |
| 1189 | 202442_at | HG-U133A | NM_001284 | 1137 | adaptor-related protein complex 3, sigma 1 subunit | AP3S1 | 1176 | | + | resp | 83 |
| 1190 | 218191_s_at | HG-U133A | NM_018368 | 1138 | chromosome 6 open reading frame 209 | C6orf209 | 55788 | | + | resp | 15 |
| 1191 | 202643_s_at | HG-U133A | AI738896 | 1139 | tumor necrosis factor, alpha-induced protein 3 | TNFAIP3 | 7128 | | + | resp | 36 |
| 1192 | 221297_at | HG-U133A | NM_018654 | 1140 | G protein-coupled receptor, family C, group 5, member D | GPRC5D | 55507 | | + | resp | 43 |
| 1193 | 211529_x_at | HG-U133A | M90684 | 1141 | HLA-G histocompatibility antigen, class I, G | HLA-G | 3135 | | + | resp | 50 |
| 1194 | 217436_x_at | HG-U133A | M80469 | 1142 | | | | | + | resp | 59 |
| 1195 | 211528_x_at | HG-U133A | M90685 | 1143 | HLA-G histocompatibility antigen, class I, G | HLA-G | 3135 | | + | resp | 83 |
| 1196 | 211911_x_at | HG-U133A | L07950 | 1144 | major histocompatibility complex, class I, B /// major histocompatibility complex, class I, C | HLA-B /// HLA-C | 3106 /// 3107 | | + | resp | 93 |
| 1197 | 222146_s_at | HG-U133A | AK026674 | 1145 | transcription factor 4 | TCF4 | 6925 | | + | resp | 107 |
| 1198 | 224566_at | HG-U133B | AI042152 | 1146 | trophoblast-derived noncoding RNA | TncRNA | 283131 | | + | resp | 113 |
| 1199 | 225282_at | HG-U133B | AL137764 | 1147 | hypothetical protein AL133206 | LOC64744 | 64744 | | + | resp | 118 |
| 1200 | 201951_at | HG-U133A | BF242905 | 1148 | Activated leukocyte cell adhesion molecule | ALCAM | 214 | + | + | resp | 28 |
| 1201 | 203845_at | HG-U133A | AV727449 | 1149 | p300/CBP-associated factor | PCAF | 8850 | + | + | TTP | 14 |
| 1202 | 221778_at | HG-U133A | BE217882 | 1150 | KIAA1718 protein | KIAA1718 | 80853 | + | + | TTP/resp | 59 |

TABLE 3

AGRESSIVENESS PREDICTIVE MARKER IDENTIFICATION

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| 1203 | 210386_s_at | HG-U133A | BC001906 | 1151 | metaxin 1 | MTX1 | 4580 | | | – | – | 1 |
| 1204 | 211639_x_at | HG-U133A | L23518 | 1052 | immunoglobulin heavy constant mu | IGHM | 3507 | | | | – | 2 |
| 1205 | 211637_x_at | HG-U133A | L23516 | 1153 | similar to Ig heavy chain V-I region HG3 precursor | LOC388078 | 388078 | | | | – | 3 |
| 1206 | 211644_x_at | HG-U133A | L14458 | 1154 | HRV Fab 027-VL /// HRV Fab 026-VL /// Ig light chain gene variable domain (CLL-L3B) /// HRV Fab N27-VL /// Immunoglobulin kappa constant | IGKC | 3514 | | | | + | 4 |
| 1207 | 219593_at | HG-U133A | NM_016582 | 1155 | solute carrier family 15, member 3 | SLC15A3 | 51296 | | | | + | 7 |
| 1208 | 208671_at | HG-U133A | AF164794 | 1156 | tumor differentially expressed 2 | TDE2 | 57515 | | | | + | 8 |
| 1209 | 201438_at | HG-U133A | NM_004369 | 1157 | collagen, type VI, alpha 3 | COL6A3 | 1293 | | | | – | 11 |
| 1210 | 201937_s_at | HG-U133A | NM_012100 | 1158 | aspartyl aminopeptidase | DNPEP | 23549 | | | | – | 12 |
| 1211 | 216576_x_at | HG-U133A | AF103529 | 1159 | | | | | | | – | 12 |
| 1212 | 217281_x_at | HG-U133A | AJ239383 | 1160 | immunoglobulin heavy constant gamma 1 (G1m marker) /// immunoglobulin heavy constant mu /// hypothetical protein MGC27165 | IGHG1 /// IGHM /// MGC27165 | 283650 /// 3500 /// 3507 | | | | + | 13 |
| 1213 | 224634_at | HG-U133B | AI911518 | 1161 | G patch domain containing 4 | GPATC4 | 54865 | | | – | | 15 |
| 1214 | 235802_at | HG-U133B | BE676703 | 1162 | chromosome 14 open reading frame 175 | C14orf175 | 122618 | | | | – | 16 |
| 1215 | 203182_s_at | HG-U133A | NM_003138 | 1163 | SFRS protein kinase 2 | SRPK2 | 6733 | | | – | – | 17 |
| 1216 | 211643_x_at | HG-U133A | L14457 | 1164 | | | | | | | + | 18 |
| 1217 | 226646_at | HG-U133B | AI831932 | 1165 | Kruppel-like factor 2 (lung) | KLF2 | 10365 | | | | + | 18 |
| 1218 | 203641_s_at | HG-U133A | BF002844 | 1166 | COBL-like 1 | COBLL1 | 22837 | | | | + | 19 |
| 1219 | 207238_s_at | HG-U133A | NM_002838 | 1167 | protein tyrosine phosphatase, receptor type, C | PTPRC | 5788 | | | | – | 19 |
| 1220 | 220807_at | HG-U133A | NM_005331 | 1168 | hemoglobin, theta 1 | HBQ1 | 3049 | | | | + | 22 |
| 1221 | 205890_s_at | HG-U133A | NM_006398 | 1169 | ubiquitin D | UBD | 10537 | | | | + | 23 |
| 1222 | 208850_s_at | HG-U133A | AL558479 | 1170 | Thy-1 cell surface antigen /// Thy-1 co-transcribed | THY1 /// LOC94105 | 7070 /// 94105 | | | – | | 23 |
| 1223 | 226350_at | HG-U133B | AU155565 | 1171 | choroideremia-like (Rab escort protein 2) | CHML | 1122 | | | – | | 24 |
| 1224 | 225636_at | HG-U133B | H98105 | 1172 | signal transducer and activator of transcription 2, 113 kDa | STAT2 | 6773 | | | | – | 36 |
| 1225 | 208677_s_at | HG-U133A | AL550657 | 1173 | basigin (OK blood group) | BSG | 682 | | | | + | 37 |
| 1226 | 212473_s_at | HG-U133A | BE965029 | 1174 | flavoprotein oxidoreductase MICAL2 | MICAL2 | 9645 | | | | + | 39 |
| 1227 | 212987_at | HG-U133A | AL031178 | 1175 | F-box protein 9 | FBXO9 | 26268 | | | | + | 39 |
| 1228 | 211919_s_at | HG-U133A | AF348491 | 1176 | chemokine (C—X—C motif) receptor 4 | CXCR4 | 7852 | | | | + | 40 |
| 1229 | 212139_at | HG-U133A | D86973 | 1177 | GCN1 general control of amino-acid synthesis 1-like 1 (yeast) | GCN1L1 | 10985 | | | – | | 41 |
| 1230 | 213730_x_at | HG-U133A | BE962186 | 1178 | transcription factor 3 (E2A immunoglobulin enhancer binding factors E12/E47) | TCF3 | 6929 | | | | – | 42 |
| 1231 | 216398_at | HG-U133A | U05255 | | | | | | | | + | 43 |

TABLE 3-continued

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| AGRESSIVENESS PREDICTIVE MARKER IDENTIFICATION | | | | | | | | | | | | |
| 1232 | 211254_x_at | HG-U133A | AF031549 | 1179 | Rhesus blood group-associated glycoprotein | RHAG | 6005 | | | | + | 45 |
| 1233 | 217028_at | HG-U133A | AJ224869 | 1180 | chemokine (C—X—C motif) receptor 4 | CXCR4 | 7852 | | | | + | 46 |
| 1234 | 212226_s_at | HG-U133A | AA628586 | 1181 | phosphatidic acid phosphatase type 2B | PPAP2B | 8613 | | | | + | 47 |
| 1235 | 213457_at | HG-U133A | BF739959 | 1182 | malignant fibrous histiocytoma amplified sequence 1 | MFHAS1 | 9258 | | | | + | 47 |
| 1236 | 202124_s_at | HG-U133A | AV705253 | 1183 | amyotrophic lateral sclerosis 2 (juvenile) chromosome region, candidate 3 | ALS2CR3 | 66008 | | | | + | 48 |
| 1237 | 205859_at | HG-U133A | NM_004271 | 1184 | lymphocyte antigen 86 | LY86 | 9450 | | | | + | 49 |
| 1238 | 214157_at | HG-U133A | AA401492 | 1185 | GNAS complex locus | GNAS | 2778 | | | | – | 51 |
| 1239 | 212956_at | HG-U133A | AI348094 | 1186 | KIAA0882 protein | KIAA0882 | 23158 | | | | + | 52 |
| 1240 | 219371_s_at | HG-U133A | NM_016270 | 1187 | Kruppel-like factor 2 (lung) | KLF2 | 10365 | | | | + | 52 |
| 1241 | 218847_at | HG-U133A | NM_006548 | 1188 | IGF-II mRNA-binding protein 2 | IMP-2 | 10644 | | | | + | 54 |
| 1242 | 222976_s_at | HG-U133B | BC000771 | 1189 | tropomyosin 3 | TPM3 | 7170 | | | – | | 58 |
| 1243 | 203837_at | HG-U133A | NM_005923 | 1190 | mitogen-activated protein kinase kinase kinase 5 | MAP3K5 | 4217 | | | | + | 63 |
| 1244 | 201178_at | HG-U133A | NM_012179 | 1191 | F-box protein 7 | FBXO7 | 25793 | | | | + | 64 |
| 1245 | 210776_x_at | HG-U133A | M31222 | 1192 | transcription factor 3 (E2A immunoglobulin enhancer binding factors E12/E47) | TCF3 | 6929 | | | | – | 64 |
| 1246 | 203697_at | HG-U133A | U91903 | 1193 | frizzled-related protein | FRZB | 2487 | | | | – | 67 |
| 1247 | 229721_x_at | HG-U133B | AI655697 | 1194 | Derl-like domain family, member 3 | DERL3 | 91319 | | | – | | 72 |
| 1248 | 200984_s_at | HG-U133A | X16447 | 1195 | CD59 antigen p18-20 (antigen identified by monoclonal antibodies 16.3A5, EJ16, EJ30, EL32 and G344) | CD59 | 966 | | | | + | 74 |
| 1249 | 223322_at | HG-U133B | BC004270 | 1196 | Ras association (RalGDS/AF-6) domain family 5 | RASSF5 | 83593 | | | – | | 77 |
| 1250 | 201061_s_at | HG-U133A | M81635 | 1197 | stomatin | STOM | 2040 | | | | + | 78 |
| 1251 | 203132_at | HG-U133A | NM_000321 | 1198 | retinoblastoma 1 (including osteosarcoma) | RB1 | 5925 | | | | + | 79 |
| 1252 | 205308_at | HG-U133A | NM_016010 | 1199 | CGI-62 protein | CGI-62 | 51101 | | | | + | 81 |
| 1253 | 221478_at | HG-U133A | AL132665 | 1200 | BCL2/adenovirus E1B 19 kDa interacting protein 3-like | BNIP3L | 665 | | | | + | 82 |
| 1254 | 214170_x_at | HG-U133A | AA669797 | 1201 | fumarate hydratase | FH | 2271 | | | – | | 87 |
| 1255 | 202345_s_at | HG-U133A | NM_001444 | 1202 | fatty acid binding protein 5 (psoriasis-associated) | FABP5 | 2171 | | | – | | 91 |
| 1256 | 210088_x_at | HG-U133A | M36172 | 1203 | myosin, light polypeptide 4, alkali; atrial, embryonic | MYL4 | 4635 | | | | + | 92 |
| 1257 | 200044_at | HG-U133A | NM_003769 | 1204 | splicing factor, arginine/serine-rich 9 | SFRS9 | 8683 | | | – | | 93 |
| 1258 | 205390_s_at | HG-U133A | NM_000037 | 1205 | ankyrin 1, erythrocytic | ANK1 | 286 | | | | + | 95 |
| 1259 | 209160_at | HG-U133A | AB018580 | 1206 | aldo-keto reductase family 1, member C3 (3-alpha hydroxysteroid dehydrogenase, type II) | AKR1C3 | 8644 | | | | + | 97 |
| 1260 | 201561_s_at | HG-U133A | NM_014944 | 1207 | calsyntenin 1 | CLSTN1 | 22883 | | | | – | 101 |

TABLE 3-continued

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| AGRESSIVENESS PREDICTIVE MARKER IDENTIFICATION | | | | | | | | | | | | |
| 1261 | 201803_at | HG-U133A | NM_000938 | 1208 | polymerase (RNA) II (DNA directed) polypeptide B, 140 kDa | POLR2B | 5431 | | | – | | 101 |
| 1262 | 214948_s_at | HG-U133A | AL050136 | 1209 | TATA element modulatory factor 1 /// Similar to family with sequence similarity 9, member C | TMF1 | 441347 /// 7110 | | | – | | 102 |
| 1263 | 204158_s_at | HG-U133A | NM_006019 | 1210 | T-cell, immune regulator 1, ATPase, H+ transporting, lysosomal V0 protein a isoform 3 | TCIRG1 | 10312 | | | | – | 103 |
| 1264 | 200792_at | HG-U133A | NM_001469 | 1211 | thyroid autoantigen 70 kDa (Ku antigen) | G22P1 | 2547 | | | – | | 106 |
| 1265 | 200593_s_at | HG-U133A | BC003621 | 1212 | heterogeneous nuclear ribonucleoprotein U (scaffold attachment factor A) | HNRPU | 3192 | | | – | | 114 |
| 1266 | 200872_at | HG-U133A | NM_002966 | 1213 | S100 calcium binding protein A10 (annexin II ligand, calpactin I, light polypeptide (p11)) | S100A10 | 6281 | | | | + | 114 |
| 1267 | 225532_at | HG-U133B | AI889160 | 1214 | Cdk5 and Abl enzyme substrate 1 | CABLES1 | 91768 | | | – | | 121 |
| 1268 | 210105_s_at | HG-U133A | M14333 | 1215 | FYN oncogene related to SRC, FGR, YES | FYN | 2534 | | | – | | 122 |
| 1269 | 217274_x_at | HG-U133A | X52005 | 1216 | myosin, light polypeptide 4, alkali; atrial, embryonic | MYL4 | 4635 | | | | + | 122 |
| 1270 | 200654_at | HG-U133A | J02783 | 1217 | procollagen-proline, 2-oxoglutarate 4-dioxygenase (proline 4-hydroxylase), beta polypeptide (protein disulfide isomerase; thyroid hormone binding protein p55) | P4HB | 5034 | | | | – | 123 |
| 1271 | 208851_s_at | HG-U133A | AL161958 | 1218 | Thy-1 cell surface antigen /// Thy-1 co-transcribed | THY1 /// LOC94105 | 7070 /// 94105 | | | – | | 137 |
| 1272 | 225716_at | HG-U133B | AI357639 | 1219 | Full-length cDNA clone CS0DK008YI09 of HeLa cells Cot 25-normalized of *Homo sapiens* (human) | | | | | – | | 140 |
| 1273 | 200619_at | HG-U133A | NM_006842 | 1220 | | | | | | – | | 142 |
| 1274 | 200634_at | HG-U133A | NM_005022 | 1221 | profilin 1 | PFN1 | 5216 | | | – | | 149 |
| 1275 | 222584_at | HG-U133B | AL573591 | 1222 | misato | FLJ10504 | 55154 | | | – | | 156 |
| 1276 | 212591_at | HG-U133A | AA887480 | 1223 | KIAA0117 protein | KIAA0117 | 23029 | | | – | | 158 |
| 1277 | 224855_at | HG-U133B | AL561868 | 1224 | pyrroline-5-carboxylate reductase family, member 2 | PYCR2 | 29920 | | | – | | 159 |
| 1278 | 202004_x_at | HG-U133A | NM_003001 | 1225 | succinate dehydrogenase complex, subunit C, integral membrane protein, 15 kDa | SDHC | 6391 | | | – | | 168 |
| 1279 | 218585_s_at | HG-U133A | NM_016448 | 1226 | RA-regulated nuclear matrix-associated protein | RAMP | 51514 | | | – | | 175 |
| 1280 | 210131_x_at | HG-U133A | D49737 | 1227 | | | | | | – | | 178 |

TABLE 3-continued

| AGRESSIVENESS PREDICTIVE MARKER IDENTIFICATION | | | | | | | | | | | | |
|---|---|---|---|---|---|---|---|---|---|---|---|---|
| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
| 1281 | 201275_at | HG-U133A | NM_002004 | 1228 | farnesyl diphosphate synthase (farnesyl pyrophosphate synthetase, dimethylallyltranstransferase, geranyltranstransferase) | FDPS | 2224 | – | | – | – | 4 |
| 1282 | 223531_x_at | HG-U133B | AF151035 | 1229 | G protein-coupled receptor 89 | GPR89 | 51463 | – | | – | – | 5 |
| 1283 | 208694_at | HG-U133A | U47077 | 1230 | protein kinase, DNA-activated, catalytic polypeptide | PRKDC | 5591 | – | | | | 6 |
| 1284 | 225463_x_at | HG-U133B | BF941168 | 1231 | G protein-coupled receptor 89 | GPR89 | 51463 | – | | – | | 10 |
| 1285 | 200090_at | HG-U133A | BG168896 | 398 | farnesyltransferase, CAAX box, alpha | FNTA | 2339 | – | | – | | 11 |
| 1286 | 212165_at | HG-U133A | AF070537 | 1232 | chromosome 1 open reading frame 37 | C1orf37 | 92703 | – | | | – | 11 |
| 1287 | 217978_s_at | HG-U133A | NM_017582 | 1233 | ubiquitin-conjugating enzyme E2Q (putative) | UBE2Q | 55585 | – | | – | – | 11 |
| 1288 | 220642_x_at | HG-U133A | NM_016334 | 1234 | G protein-coupled receptor 89 | GPR89 | 51463 | – | | – | – | 22 |
| 1289 | 201209_at | HG-U133A | NM_004964 | 1235 | histone deacetylase 1 | HDAC1 | 3065 | – | | | – | 24 |
| 1290 | 222140_s_at | HG-U133A | AK021758 | 1236 | G protein-coupled receptor 89 | GPR89 | 51463 | – | | – | – | 27 |
| 1291 | 201764_at | HG-U133A | NM_024056 | 1237 | hypothetical protein MGC5576 | MGC5576 | 79022 | – | | – | – | 33 |
| 1292 | 201698_s_at | HG-U133A | NM_003769 | 1204 | splicing factor, arginine/serine-rich 9 | SFRS9 | 8683 | – | | – | | 40 |
| 1293 | 203362_s_at | HG-U133A | NM_002358 | 1238 | MAD2 mitotic arrest deficient-like 1 (yeast) | MAD2L1 | 4085 | – | | | | 41 |
| 1294 | 225793_at | HG-U133B | AW500180 | 1239 | Lix1 homolog (mouse) like | LIX1L | 128077 | – | | | – | 41 |
| 1295 | 201664_at | HG-U133A | AL136877 | 1240 | SMC4 structural maintenance of chromosomes 4-like 1 (yeast) | SMC4L1 | 10051 | – | | – | | 44 |
| 1296 | 220607_x_at | HG-U133A | NM_016397 | 1241 | TH1-like (*Drosophila*) | TH1L | 51497 | – | | | | 62 |
| 1297 | 226525_at | HG-U133B | N51102 | 1242 | Serine/threonine kinase 17b (apoptosis-inducing) | STK17B | 9262 | – | | | – | 63 |
| 1298 | 222654_at | HG-U133B | AI302253 | 1243 | myo-inositol monophosphatase A3 | IMPA3 | 54928 | – | | | | 68 |
| 1299 | 205367_at | HG-U133A | NM_020979 | 1244 | adaptor protein with pleckstrin homology and src homology 2 domains | APS | 10603 | – | | | – | 74 |
| 1300 | 200080_s_at | HG-U133B | AI955655 | 1245 | H3 histone, family 3A | H3F3A | 3020 | – | | | | 81 |
| 1301 | 208775_at | HG-U133A | D89729 | 1246 | exportin 1 (CRM1 homolog, yeast) | XPO1 | 7514 | – | | | | 93 |
| 1302 | 206102_at | HG-U133A | NM_021067 | 1247 | KIAA0186 gene product | KIAA0186 | 9837 | – | | | | 103 |
| 1303 | 222998_at | HG-U133B | AL136937 | 1248 | homolog of yeast MAF1 | MAF1 | 84232 | – | | | | 114 |
| 1304 | 225644_at | HG-U133B | BF060776 | 1249 | hypothetical protein FLJ33814 | FLJ33814 | 150275 | – | | | | 125 |
| 1305 | 224815_at | HG-U133B | AA148301 | 1250 | COMM domain containing 7 | COMMD7 | 149951 | – | | | | 128 |
| 1306 | 210460_s_at | HG-U133A | AB033605 | 1251 | proteasome (prosome, macropain) 26S subunit, non-ATPase, 4 | PSMD4 | 5710 | – | | | | 137 |
| 1307 | 203316_s_at | HG-U133A | NM_003094 | 1252 | small nuclear ribonucleoprotein polypeptide E | SNRPE | 6635 | – | | | | 141 |
| 1308 | 219010_at | HG-U133A | NM_018265 | 1253 | hypothetical protein FLJ10901 | FLJ10901 | 55765 | – | | – | | 144 |
| 1309 | 211946_s_at | HG-U133A | AL096857 | 1254 | BAT2 domain containing 1 | BAT2D1 | 23215 | – | | | | 154 |
| 1310 | 200080_s_at | HG-U133A | AI955655 | 1245 | H3 histone, family 3A | H3F3A | 3020 | – | | | | 157 |
| 1311 | 222443_s_at | HG-U133B | AF182415 | 1255 | RNA binding motif protein 8A | RBM8A | 9939 | – | | – | | 157 |
| 1312 | 202282_at | HG-U133A | NM_004493 | 1256 | hydroxyacyl-Coenzyme A dehydrogenase, type II | HADH2 | 3028 | – | | | | 158 |
| 1313 | 203344_s_at | HG-U133A | NM_002894 | 1257 | retinoblastoma binding protein 8 | RBBP8 | 5932 | – | | | | 163 |

TABLE 3-continued

AGRESSIVENESS PREDICTIVE MARKER IDENTIFICATION

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| 1314 | 231715_s_at | HG-U133B | NM_013328 | 1258 | pyrroline-5-carboxylate reductase family, member 2 | PYCR2 | 29920 | – | | | | 169 |
| 1315 | 211036_x_at | HG-U133A | BC006301 | 1259 | anaphase promoting complex subunit 5 | ANAPC5 | 51433 | – | | | | 186 |
| 1316 | 200044_at | HG-U133B | NM_003769 | 1204 | splicing factor, arginine/serine-rich 9 | SFRS9 | 8683 | – | | | | 195 |
| 1317 | 208755_x_at | HG-U133A | BF312331 | 1260 | H3 histone, family 3A | H3F3A | 3020 | – | | | | 205 |
| 1318 | 211609_x_at | HG-U133A | U51007 | 1261 | proteasome (prosome, macropain) 26S subunit, non-ATPase, 4 | PSMD4 | 5710 | – | | | | 214 |
| 1319 | 201663_s_at | HG-U133A | NM_005496 | 1262 | SMC4 structural maintenance of chromosomes 4-like 1 (yeast) | SMC4L1 | 10051 | – | | | | 216 |
| 1320 | 212766_s_at | HG-U133A | AW294587 | 1263 | hypothetical protein FLJ12671 | FLJ12671 | 81875 | – | | | | 225 |
| 1321 | 219816_s_at | HG-U133A | NM_018107 | 1264 | RNA binding motif protein 23 | RBM23 | 55147 | – | | | | 236 |
| 1322 | 200614_at | HG-U133A | NM_004859 | 1265 | clathrin, heavy polypeptide (Hc) | CLTC | 1213 | – | | | | 243 |
| 1323 | 200843_s_at | HG-U133A | NM_004446 | 1266 | glutamyl-prolyl-tRNA synthetase | EPRS | 2058 | – | | | | 281 |
| 1324 | 200709_at | HG-U133A | NM_000801 | 1267 | FK506 binding protein 1A, 12 kDa | FKBP1A | 2280 | – | | | | 288 |
| 1325 | 208758_at | HG-U133A | D89976 | 1268 | 5-aminoimidazole-4-carboxamide ribonucleotide formyltransferase/IMP cyclohydrolase | ATIC | 471 | – | | | | 293 |
| 1326 | 212345_s_at | HG-U133A | BE675139 | 1269 | cAMP responsive element binding protein 3-like 2 | CREB3L2 | 64764 | + | | | | 119 |
| 1327 | 212699_at | HG-U133A | BE222801 | 1270 | secretory carrier membrane protein 5 | SCAMP5 | 192683 | + | | | | 171 |
| 1328 | 206626_x_at | HG-U133A | BC001003 | 1271 | synovial sarcoma, X breakpoint 1 | SSX1 | 6756 | | – | – | – | 10 |
| 1329 | 211678_s_at | HG-U133A | AF090934 | 1272 | zinc finger protein 313 | ZNF313 | 55905 | | – | | | 12 |
| 1330 | 208854_s_at | HG-U133A | AA586774 | 1273 | serine/threonine kinase 24 (STE20 homolog, yeast) | STK24 | 8428 | | – | | – | 14 |
| 1331 | 218051_s_at | HG-U133A | NM_022908 | 1274 | hypothetical protein FLJ12442 | FLJ12442 | 64943 | | – | | – | 18 |
| 1332 | 206621_s_at | HG-U133A | NM_022170 | 1275 | Williams-Beuren syndrome chromosome region 1 | WBSCR1 | 7458 | | – | | | 23 |
| 1333 | 216471_x_at | HG-U133A | X79200 | 1276 | synovial sarcoma, X breakpoint 2 | SSX2 | 6757 | | – | – | – | 24 |
| 1334 | 212433_x_at | HG-U133A | AA630314 | 1277 | ribosomal protein S2 | RPS2 | 6187 | | – | | | 26 |
| 1335 | 202929_s_at | HG-U133A | NM_001355 | 1278 | D-dopachrome tautomerase | DDT | 1652 | | – | | | 33 |
| 1336 | 217972_at | HG-U133A | NM_017812 | 1279 | coiled-coil-helix-coiled-coil-helix domain containing 3 | CHCHD3 | 54927 | | – | | | 41 |
| 1337 | 39835_at | HG-U133A | U93181 | 1280 | SET binding factor 1 | SBF1 | 6305 | | – | | – | 42 |
| 1338 | 213166_x_at | HG-U133A | BG332462 | 1281 | | | | | – | | | 63 |
| 1339 | 210006_at | HG-U133A | BC002571 | 1282 | DKFZP564O243 protein | DKFZP564O243 | 25864 | | – | | | 75 |
| 1340 | 232652_x_at | HG-U133B | AF207829 | 1283 | SCAN domain containing 1 | SCAND1 | 51282 | | – | | – | 108 |
| 1341 | 201630_s_at | HG-U133A | NM_004300 | 1284 | acid phosphatase 1, soluble | ACP1 | 52 | | – | | | 144 |
| 1342 | 200966_x_at | HG-U133A | NM_000034 | 1285 | aldolase A, fructose-bisphosphate | ALDOA | 226 | | – | – | | 165 |
| 1343 | 218561_s_at | HG-U133A | NM_020408 | 1286 | chromosome 6 open reading frame 149 | C6orf149 | 57128 | | – | | | 202 |
| 1344 | 200652_at | HG-U133A | NM_003145 | 1287 | signal sequence receptor, beta (translocon-associated protein beta) | SSR2 | 6746 | | – | | | 212 |
| 1345 | 225359_at | HG-U133B | BF666961 | 1288 | homolog of yeast TIM14 | TIM14 | 131118 | | – | | | 225 |
| 1346 | 201486_at | HG-U133A | NM_002902 | 1289 | reticulocalbin 2, EF-hand calcium binding domain | RCN2 | 5955 | | – | | | 242 |
| 1347 | 55093_at | HG-U133A | AA534198 | 1290 | chondroitin sulfate glucuronyltransferase | CSGlcA-T | 54480 | | – | | | 253 |

TABLE 3-continued

AGRESSIVENESS PREDICTIVE MARKER IDENTIFICATION

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| 1348 | 224890_s_at | HG-U133B | BE727643 | 1291 | similar to CG14977-PA | LOC389541 | 389541 | | – | | | 257 |
| 1349 | 203258_at | HG-U133A | NM_006442 | 1292 | DR1-associated protein 1 (negative cofactor 2 alpha) | DRAP1 | 10589 | | – | | | 285 |
| 1350 | 202012_s_at | HG-U133A | AA196245 | 1293 | exostoses (multiple) 2 | EXT2 | 2132 | | – | | | 351 |
| 1351 | 209669_s_at | HG-U133A | BC003049 | 1294 | PAI-1 mRNA-binding protein | PAI-RBP1 | 26135 | | – | | | 361 |
| 1352 | 215096_s_at | HG-U133A | AU145746 | 1295 | esterase D/formylglutathione hydrolase | ESD | 2098 | | – | | | 386 |
| 1353 | 224576_at | HG-U133B | AK000752 | 1296 | endoplasmic reticulum-golgi intermediate compartment 32 kDa protein | KIAA1181 | 57222 | | – | | | 415 |
| 1354 | 224217_s_at | HG-U133B | 1297 | AF094700 | Fas (TNFRSF6) associated factor 1 | FAF1 | 11124 | | – | | | 448 |
| 1355 | 225502_at | HG-U133B | AL161725 | 1298 | dedicator of cytokinesis 8 | DOCK8 | 81704 | | – | | | 467 |
| 1356 | 218802_at | HG-U133A | NM_017918 | 1299 | hypothetical protein FLJ20647 | FLJ20647 | 55013 | | – | | | 487 |
| 1357 | 209609_s_at | HG-U133A | BC004517 | 1300 | mitochondrial ribosomal protein L9 | MRPL9 | 65005 | – | – | | | 19 |
| 1358 | 211060_x_at | HG-U133A | BC006383 | 1301 | GPAA1P anchor attachment protein 1 homolog (yeast) | GPAA1 | 8733 | – | – | | | 28 |
| 1359 | 222997_s_at | HG-U133B | BC004566 | 1302 | mitochondrial ribosomal protein S21 | MRPS21 | 54460 | – | – | – | | 57 |
| 1360 | 201144_s_at | HG-U133A | NM_004094 | 1303 | eukaryotic translation initiation factor 2, subunit 1 alpha, 35 kDa | EIF2S1 | 1965 | – | – | – | – | 59 |
| 1361 | 200910_at | HG-U133A | NM_005998 | 1304 | chaperonin containing TCP1, subunit 3 (gamma) | CCT3 | 7203 | – | – | | | 61 |
| 1362 | 218336_at | HG-U133A | NM_012394 | 1305 | prefoldin 2 | PFDN2 | 5202 | – | – | | – | 61 |
| 1363 | 203832_at | HG-U133A | NM_003095 | 1306 | enolase 1, (alpha) /// small nuclear ribonucleoprotein polypeptide F | ENO1 /// SNRPF | 2023 /// 6636 | – | – | | | 90 |
| 1364 | 208822_s_at | HG-U133A | U18321 | 1307 | death associated protein 3 | DAP3 | 7818 | – | – | | | 99 |
| 1365 | 200057_s_at | HG-U133A | NM_007363 | 201 | non-POU domain containing, octamer-binding | NONO | 4841 | – | – | | | 113 |
| 1366 | 202244_at | HG-U133A | NM_002796 | 1308 | proteasome (prosome, macropain) subunit, beta type, 4 | PSMB4 | 5692 | – | – | – | | 129 |
| 1367 | 203594_at | HG-U133A | NM_003729 | 1309 | RNA terminal phosphate cyclase domain 1 | RTCD1 | 8634 | – | – | | | 171 |
| 1368 | 215450_at | HG-U133A | W87901 | 1310 | | | | – | – | | | 178 |
| 1369 | 223377_x_at | HG-U133B | AF035947 | 1311 | cytokine inducible SH2-containing protein | CISH | 1154 | | + | + | + | 2 |
| 1370 | 209813_x_at | HG-U133A | M16768 | 1312 | T cell receptor gamma variable 9 /// TCR gamma alternate reading frame protein | TRGV9 /// TARP | 445347 /// 6983 | | + | | | 5 |
| 1371 | 216491_x_at | HG-U133A | U80139 | 1313 | Immunoglobulin heavy constant mu /// Immunoglobulin heavy constant gamma 1 (G1m marker) | IGHM /// IGHG1 | 3500 /// 3507 | | + | | – | 9 |
| 1372 | 204891_s_at | HG-U133A | NM_005356 | 1314 | lymphocyte-specific protein tyrosine kinase | LCK | 3932 | | + | | | 13 |
| 1373 | 204141_at | HG-U133A | NM_001069 | 1315 | tubulin, beta 2 | TUBB2 | 7280 | | + | | + | 26 |
| 1374 | 203661_s_at | HG-U133A | BC002660 | 1316 | tropomodulin 1 | TMOD1 | 7111 | | + | | + | 31 |
| 1375 | 221558_s_at | HG-U133A | AF288571 | 1317 | lymphoid enhancer-binding factor 1 | LEF1 | 51176 | | + | | – | 39 |
| 1376 | 200660_at | HG-U133A | NM_005620 | 1318 | S100 calcium binding protein A11 (calgizzarin) | S100A11 | 6282 | | + | | + | 41 |

TABLE 3-continued

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| AGRESSIVENESS PREDICTIVE MARKER IDENTIFICATION | | | | | | | | | | | | |
| 1377 | 206206_at | HG-U133A | NM_005582 | 1319 | lymphocyte antigen 64 homolog, radioprotective 105 kDa (mouse) | LY64 | 4064 | | + | | | 59 |
| 1378 | 211719_x_at | HG-U133A | BC005858 | 1320 | fibronectin 1 | FN1 | 2335 | | + | | | 69 |
| 1379 | 212332_at | HG-U133A | BF110947 | 1321 | retinoblastoma-like 2 (p130) | RBL2 | 5934 | | + | | | 70 |
| 1380 | 214486_x_at | HG-U133A | AF041459 | 1322 | CASP8 and FADD-like apoptosis regulator | CFLAR | 8837 | | + | | | 93 |
| 1381 | 217202_s_at | HG-U133A | U08626 | 1323 | glutamate-ammonia ligase (glutamine synthase) | GLUL | 2752 | | + | | | 115 |
| 1382 | 203567_s_at | HG-U133A | AU157590 | 1324 | tripartite motif-containing 38 | TRIM38 | 10475 | | + | | | 121 |
| 1383 | 205590_at | HG-U133A | NM_005739 | 1325 | RAS guanyl releasing protein 1 (calcium and DAG-regulated) | RASGRP1 | 10125 | | + | | | 142 |
| 1384 | 226505_x_at | HG-U133B | AI148567 | 1326 | ubiquitin specific protease 32 | USP32 | 84669 | | + | | | 143 |
| 1385 | 210972_x_at | HG-U133A | M15565 | 1327 | T cell receptor alpha locus | TRA@ | 6955 | | + | | | 144 |
| 1386 | 209473_at | HG-U133A | AV717590 | 1328 | ectonucleoside triphosphate diphosphohydrolase 1 | ENTPD1 | 953 | | + | | | 158 |
| 1387 | 226085_at | HG-U133B | AA181060 | 1329 | Chromobox homolog 5 (HP1 alpha homolog, *Drosophila*) | CBX5 | 23468 | | + | | | 167 |
| 1388 | 37831_at | HG-U133A | AB011117 | 1330 | signal-induced proliferation-associated 1 like 3 | SIPA1L3 | 23094 | | + | | | 170 |
| 1389 | 210426_x_at | HG-U133A | U04897 | 1331 | RAR-related orphan receptor A | RORA | 6095 | | + | | | 176 |
| 1390 | 210987_x_at | HG-U133A | M19267 | 1332 | Tropomyosin 1 (alpha) | TPM1 | 7168 | | + | | | 182 |
| 1391 | 217878_s_at | HG-U133A | AI203880 | 1333 | cell division cycle 27 | CDC27 | 996 | | + | | | 192 |
| 1392 | 220169_at | HG-U133A | NM_024943 | 1334 | hypothetical protein FLJ23235 | FLJ23235 | 80008 | | + | | | 197 |
| 1393 | 210681_s_at | HG-U133A | AF153604 | 1335 | ubiquitin specific protease 15 | USP15 | 9958 | | + | | | 199 |
| 1394 | 213327_s_at | HG-U133A | AI820101 | 1336 | | | | | + | | | 199 |
| 1395 | 211994_at | HG-U133A | AI742553 | 1337 | Clone A9A2BRB5 (CAC)n/(GTG)n repeat-containing mRNA. | | | | + | | | 205 |
| 1396 | 216557_x_at | HG-U133A | U92706 | 1338 | immunoglobulin heavy constant gamma 1 (G1m marker) | IGHG1 | 3500 | | + | | | 222 |
| 1397 | 202096_s_at | HG-U133A | NM_000714 | 1339 | benzodiazapine receptor (peripheral) | BZRP | 706 | | + | | | 233 |
| 1398 | 212660_at | HG-U133A | AI735639 | 1340 | PHD finger protein 15 | PHF15 | 23338 | | + | | | 246 |
| 1399 | 243699_at | HG-U133B | BG432887 | 1341 | Full-length cDNA clone CS0DI020YI19 of Placenta Cot 25-normalized of *Homo sapiens* (human) | | | | + | | | 249 |
| 1400 | 45749_at | HG-U133A | AA400206 | 1342 | hypothetical protein FLJ13725 | FLJ13725 | 79567 | | + | | | 273 |
| 1401 | 207571_x_at | HG-U133A | NM_004848 | 1343 | chromosome 1 open reading frame 38 | C1orf38 | 9473 | | + | | | 281 |
| 1402 | 211993_at | HG-U133A | AI768512 | 1344 | WNK lysine deficient protein kinase 1 | WNK1 | 65125 | | + | | | 286 |
| 1403 | 226682_at | HG-U133B | AW006185 | 1345 | hypothetical protein LOC283666 | LOC283666 | 283666 | | + | | | 299 |
| 1404 | 205464_at | HG-U133A | NM_000336 | 1346 | sodium channel, nonvoltage-gated 1, beta (Liddle syndrome) | SCNN1B | 6338 | | + | | | 306 |
| 1405 | 202748_at | HG-U133A | NM_004120 | 1347 | guanylate binding protein 2, interferon-inducible | GBP2 | 2634 | | + | | | 309 |
| 1406 | 204151_x_at | HG-U133A | NM_001353 | 1348 | aldo-keto reductase family 1, member C1 (dihydrodiol dehydrogenase 1; 20-alpha (3-alpha)-hydroxysteroid dehydrogenase) | AKR1C1 | 1645 | | + | | | 315 |

TABLE 3-continued

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| AGRESSIVENESS PREDICTIVE MARKER IDENTIFICATION | | | | | | | | | | | | |
| 1407 | 205442_at | HG-U133A | NM_021647 | 1349 | Microfibrillar-associated protein 3-like | MFAP3L | 9848 | | + | | | 329 |
| 1408 | 218559_s_at | HG-U133A | NM_005461 | 1349 | v-maf musculoaponeurotic fibrosarcoma oncogene homolog B (avian) | MAFB | 9935 | | + | | | 329 |
| 1409 | 210479_s_at | HG-U133A | L14611 | 1350 | RAR-related orphan receptor A | RORA | 6095 | | + | | | 333 |
| 1410 | 228157_at | HG-U133B | AI125646 | 1352 | Zinc finger protein 207 | ZNF207 | 7756 | | + | | | 340 |
| 1411 | 216449_x_at | HG-U133A | AK025862 | 1353 | tumor rejection antigen (gp96) 1 | TRA1 | 7184 | | + | | | 357 |
| 1412 | 204416_x_at | HG-U133A | NM_001645 | 1354 | apolipoprotein C-I | APOC1 | 341 | | + | | | 368 |
| 1413 | 219229_at | HG-U133A | NM_013272 | 1355 | solute carrier organic anion transporter family, member 3A1 | SLCO3A1 | 28232 | | + | | | 377 |
| 1414 | 201853_s_at | HG-U133A | NM_021873 | 1356 | cell division cycle 25B | CDC25B | 994 | | + | | | 382 |
| 1415 | 201039_s_at | HG-U133A | BF572938 | 1357 | RAD23 homolog A (*S. cerevisiae*) | RAD23A | 5886 | | + | | | 406 |
| 1416 | 212607_at | HG-U133A | N32526 | 1358 | v-akt murine thymoma viral oncogene homolog 3 (protein kinase B, gamma) | AKT3 | 10000 | | + | | | 433 |
| 1417 | 209901_x_at | HG-U133A | U19713 | 1359 | allograft inflammatory factor 1 | AIF1 | 199 | | + | | | 522 |
| 1418 | 205896_at | HG-U133A | NM_003059 | 1360 | solute carrier family 22 (organic cation transporter), member 4 | SLC22A4 | 6583 | | + | | | 525 |
| 1419 | 213566_at | HG-U133A | NM_005615 | 1361 | ribonuclease, RNase A family, k6 | RNASE6 | 6039 | | + | | | 535 |
| 1420 | 211986_at | HG-U133A | BG287862 | 1362 | AHNAK nucleoprotein (desmoyokin) | AHNAK | 195 | | + | | | 547 |
| 1421 | 201220_x_at | HG-U133A | NM_001329 | 1363 | C-terminal binding protein 2 | CTBP2 | 1488 | | + | | | 627 |
| 1422 | 202201_at | HG-U133A | NM_000713 | 1364 | biliverdin reductase B (flavin reductase (NADPH)) | BLVRB | 645 | | + | | | 664 |
| 1423 | 224920_x_at | HG-U133B | AA909044 | 1365 | myeloid-associated differentiation marker | MYADM | 91663 | | + | | | 686 |
| 1424 | 209340_at | HG-U133A | S73498 | 1366 | UDP-N-acteylglucosamine pyrophosphorylase 1 | UAP1 | 6675 | | | – | – | 1 |
| 1425 | 208642_s_at | HG-U133A | AA205834 | 1367 | X-ray repair complementing defective repair in Chinese hamster cells 5 (double-strand-break rejoining; Ku autoantigen, 80 kDa) | XRCC5 | 7520 | | | – | | 38 |
| 1426 | 206632_s_at | HG-U133A | NM_004900 | 1368 | apolipoprotein B mRNA editing enzyme, catalytic polypeptide-like 3B | APOBEC3B | 9582 | | | – | | 59 |
| 1427 | 206218_at | HG-U133A | NM_002364 | 1369 | melanoma antigen family B, 2 | MAGEB2 | 4113 | | | – | | 63 |
| 1428 | 214612_x_at | HG-U133A | U10691 | 1370 | melanoma antigen family A, 6 | MAGEA6 | 4105 | | | | – | 65 |
| 1429 | 232231_at | HG-U133B | AL353944 | 1371 | Runt-related transcription factor 2 | RUNX2 | 860 | | | | – | 87 |
| 1430 | 220057_at | HG-U133A | NM_020411 | 1372 | X antigen family, member 1 | XAGE1 | 9503 | – | | – | – | 15 |
| 1431 | 220565_at | HG-U133A | NM_016602 | 1373 | chemokine (C—C motif) receptor 10 | CCR10 | 2826 | – | | | | 177 |
| 1432 | 224518_s_at | HG-U133B | BC006436 | 1374 | zinc finger protein 559 | ZNF559 | 84527 | – | | | | 200 |
| 1433 | 200713_s_at | HG-U133A | NM_012325 | 1375 | microtubule-associated protein, RP/EB family, member 1 | MAPRE1 | 22919 | – | | | | 289 |
| 1434 | 210497_x_at | HG-U133A | BC002818 | 1376 | synovial sarcoma, X breakpoint 2 | SSX2 | 6757 | | – | – | – | 2 |
| 1435 | 209486_at | HG-U133A | BC004546 | 1377 | disrupter of silencing 10 | SAS10 | 57050 | | – | | | 104 |
| 1436 | 217466_x_at | HG-U133A | L48784 | 1378 | ribosomal protein S2 | RPS2 | 6187 | | – | | | 135 |

TABLE 3-continued

AGRESSIVENESS PREDICTIVE MARKER IDENTIFICATION

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| 1437 | 204836_at | HG-U133A | NM_000170 | 1379 | glycine dehydrogenase (decarboxylating; glycine decarboxylase, glycine cleavage system protein P) | GLDC | 2731 | – | – | | | 14 |
| 1438 | 212750_at | HG-U133A | AB020630 | 472 | protein phosphatase 1, regulatory (inhibitor) subunit 16B | PPP1R16B | 26051 | – | – | | | 32 |
| 1439 | 225239_at | HG-U133B | AI355441 | 1380 | CDNA FLJ26120 fis, clone SYN00419 | | | | + | | + | 45 |
| 1440 | 211474_s_at | HG-U133A | BC004948 | 1381 | serine (or cysteine) proteinase inhibitor, clade B (ovalbumin), member 6 | SERPINB6 | 5269 | | + | | | 343 |
| 1441 | 53987_at | HG-U133A | AL041852 | 1382 | RAN binding protein 10 | RANBP10 | 57610 | | + | | | 364 |
| 1442 | 203642_s_at | HG-U133A | NM_014900 | 1383 | COBL-like 1 | COBLL1 | 22837 | | | | + | 6 |
| 1443 | 208908_s_at | HG-U133A | AF327443 | 1384 | calpastatin | CAST | 831 | | | + | + | 21 |
| 1444 | 207467_x_at | HG-U133A | NM_001750 | 1385 | calpastatin | CAST | 831 | | | + | + | 32 |
| 1445 | 213011_s_at | HG-U133A | BF116254 | 1385 | triosephosphate isomerase 1 | TPI1 | 7167 | | | – | | 35 |
| 1446 | 200953_s_at | HG-U133A | NM_001759 | 1387 | cyclin D2 | CCND2 | 894 | | | | + | 36 |
| 1447 | 216526_x_at | HG-U133A | AK024836 | 1388 | major histocompatibility complex, class I, C | HLA-C | 3107 | | | | + | 89 |
| 1448 | 201952_at | HG-U133A | AA156721 | 1389 | | | | | | + | | 184 |
| 1449 | 222680_s_at | HG-U133B | AK001261 | 1390 | RA-regulated nuclear matrix-associated protein | RAMP | 51514 | – | | – | | 5 |
| 1450 | 201697_s_at | HG-U133A | NM_001379 | 1391 | DNA (cytosine-5-)-methyltransferase 1 | DNMT1 | 1786 | – | | | | 7 |
| 1451 | 209644_x_at | HG-U133A | U38945 | 1392 | cyclin-dependent kinase inhibitor 2A (melanoma, p16, inhibits CDK4) | CDKN2A | 1029 | – | | – | – | 25 |
| 1452 | 215690_x_at | HG-U133A | AL157437 | 1393 | GPAA1P anchor attachment protein 1 homolog (yeast) | GPAA1 | 8733 | – | | | – | 35 |
| 1453 | 200822_x_at | HG-U133A | NM_000365 | 1394 | triosephosphate isomerase 1 | TPI1 | 7167 | – | | – | | 100 |
| 1454 | 213828_x_at | HG-U133A | AA477655 | 1395 | H3 histone, family 3A | H3F3A | 3020 | – | | | | 287 |
| 1455 | 218603_at | HG-U133A | NM_016217 | 1396 | headcase homolog (*Drosophila*) | HECA | 51696 | + | | + | + | 43 |
| 1456 | 218795_at | HG-U133A | NM_016361 | 1397 | acid phosphatase 6, lysophosphatidic | ACP6 | 51205 | | – | | | 158 |
| 1457 | 215823_x_at | HG-U133A | U64661 | 1398 | poly(A) binding protein, cytoplasmic 3 /// poly(A) binding protein, cytoplasmic 1 | PABPC3 /// PABPC1 | 26986 /// 5042 | | – | | | 339 |
| 1458 | 213160_at | HG-U133A | D86964 | 1399 | dedicator of cytokinesis 2 | DOCK2 | 1794 | | – | | | 460 |
| 1459 | 213811_x_at | HG-U133A | AW062341 | 1400 | transcription factor 3 (E2A immunoglobulin enhancer binding factors E12/E47) | TCF3 | 6929 | – | – | | – | 12 |
| 1460 | 201618_x_at | HG-U133A | NM_003801 | 1401 | GPAA1P anchor attachment protein 1 homolog (yeast) | GPAA1 | 8733 | – | – | – | – | 39 |
| 1461 | 203560_at | HG-U133A | NM_003878 | 1402 | gamma-glutamyl hydrolase (conjugase, folylpolygammaglutamyl hydrolase) | GGH | 8836 | – | – | | | 76 |
| 1462 | 225317_at | HG-U133B | AL574669 | 1403 | acyl-Coenzyme A binding domain containing 6 | ACBD6 | 84320 | – | – | | | 95 |
| 1463 | 215001_s_at | HG-U133A | AL161952 | 1404 | glutamate-ammonia ligase (glutamine synthase) | GLUL | 2752 | | + | | + | 52 |

TABLE 3-continued

| No. | ProbeSet ID | chip | Rep Public ID | SEQ ID NO: | Title | Gene Symbol | Entrez Gene ID | proteasome inhibitor TTP marker | proteasome inhibitor Response marker | glucocorticoid TTP marker | glucocorticoid Response marker | Rank |
|---|---|---|---|---|---|---|---|---|---|---|---|---|
| AGRESSIVENESS PREDICTIVE MARKER IDENTIFICATION | | | | | | | | | | | | |
| 1464 | 220547_s_at | HG-U133A | NM_019054 | 1405 | family with sequence similarity 35, member A | FAM35A | 54537 | | + | | | 77 |
| 1465 | 213415_at | HG-U133A | AI768628 | 1406 | chloride intracellular channel 2 | CLIC2 | 1193 | | + | | + | 78 |
| 1466 | 203038_at | HG-U133A | NM_002844 | 1407 | protein tyrosine phosphatase, receptor type, K | PTPRK | 5796 | | + | | + | 111 |
| 1467 | 210564_x_at | HG-U133A | AF009619 | 1408 | CASP8 and FADD-like apoptosis regulator | CFLAR | 8837 | | + | | | 149 |
| 1468 | 209508_x_at | HG-U133A | AF005774 | 1409 | CASP8 and FADD-like apoptosis regulator | CFLAR | 8837 | | + | | | 234 |
| 1469 | 208485_x_at | HG-U133A | NM_003879 | 1410 | CASP8 and FADD-like apoptosis regulator | CFLAR | 8837 | | + | | | 254 |
| 1470 | 37986_at | HG-U133A | M60459 | 1411 | erythropoietin receptor | EPOR | 2057 | | + | | | 354 |
| 1471 | 232213_at | HG-U133B | AU147506 | 1412 | Pellino homolog 1 (*Drosophila*) | PELI1 | 57162 | | | | + | 32 |
| 1472 | 232304_at | HG-U133B | AK026714 | 1413 | Pellino homolog 1 (*Drosophila*) | PELI1 | 57162 | | | | + | 37 |
| 1473 | 218319_at | HG-U133A | NM_020651 | 1414 | pellino homolog 1 (*Drosophila*) | PELI1 | 57162 | | | | + | 85 |
| 1474 | 204173_at | HG-U133A | NM_002475 | 1415 | myosin light chain 1 slow a | MLC1SA | 140465 | – | – | | – | 25 |

Classification Methods

Various algorithms are currently available that can be used to classify patient samples using a given set of features. Therefore, the combination of markers selected through the feature selection process may be used in any of the available algorithms in order to derive a prediction equation as to whether the patient sample is sensitive or resistant. The classification methods used to illustrate the use of multiple markers for patient sample classification in the present invention were: 1) Linear Predictive Score ("LPS"); and 2) k-nearest neighbors.

The Linear Predictive Score was implemented as described by Wright et al., "A gene-expression based method to diagnose clinically distinct groups of diffuse large B cell lymphoma." PNAS 100(17):9991-9996 (2003), the contents of which are incorporated herein by reference. As described by Wright et al., the LPS score for a vector X is computed as:

$$LPS(X) = \sum_j a_j X_j$$

where $X_j$ represents the log expression value for the $j^{th}$ feature in the set, and $a_j$ is a scaling factor representing the degree to which the $j^{th}$ feature is associated with the outcome to be predicted. As in Wright et al., we used the t-statistics of the features for the scaling factors. Given the LPS score, the likelihood that a sample is in the first of the two classes is determined using this formula:

$$P(X \in S_1) = \frac{\phi(LPS(X); \hat{\mu}_1, \hat{\sigma}_1^2)}{\phi(LPS(X); \hat{\mu}_1, \hat{\sigma}_1^2) + \phi(LPS(X); \hat{\mu}_2, \hat{\sigma}_2^2)},$$

where $\phi(x; \mu, \sigma^2)$ represents the normal density function with mean $\mu$ and variance $\sigma^2$, and $\hat{\mu}_1$, $\hat{\sigma}_1^2$, $\hat{\mu}_2$ and $\hat{\sigma}_2^2$ are the observed means and variances of the LPS scores for category 1 and category 2. In our case, for example, category 1 would be responders, and category 2 would be non-responders. Then the prediction for a new sample would be that it would be in the first class with probability $P(X \epsilon S_1)$ and in the second class with probability $P(X \epsilon S_2) = 1 - P(X \epsilon S_1)$.

The k-nearest neighbor classification method computes the similarity between a query profile and each of the profiles in the training set [Introduction to Machine Learning by Ethem ALPAYDIN, The MIT Press, October 2004, ISBN 0-262-01211-11. The k most similar profiles are selected, and a vote is taken amongst their class labels to determine the prediction for the query profile. Here, we used k=1.

Feature Selection

Feature selection is the process of determining a subset of the thousands of available features in the dataset, resulting in a combination of features that form a marker set or model, to classify patients by treatment outcome. There are many approaches to selecting features. Here we report two approaches to generate example marker sets: (1) top N most significant features, and (2) a standard feature selection method, sequential forward feature selection (See, Dash and Liu, "Feature Selection for Classification," Intelligent Data Analysis 1:131-156, 1997). We now describe how feature selection is applied to our dataset.

As a first step, only features associated with the outcome variable are considered as candidates for a feature set. For the LPS models models, all features with multiple-test-adjusted p-values less than 0.05 were determined. For the k-nearest-neighbor models, the top 100 PFC markers were determined. In either case, sequential forward selection starts with no markers in the set. At each iteration, a new feature set is formed by adding a feature selected by an evaluation function. Iteration terminates when no feature can be added that improves the evaluation function. The evaluation function is the number of samples correctly predicted either (1) by the model built on all of the samples, or (2) in leave-one-out cross-validation (Dash and Liu, 1997). Ties are broken by using the feature that has a higher univariate association with the outcome variable. Multiple marker sets can be generated by repeated rounds of feature selection, each time removing the features already selected.

Specific Application of Class Prediction

Linear Predictor Score (LPS)

Using the 162 bortezomib-treated patients classified into Responsive or Nonresponsive groups, the table below shows the markers in the first LPS predictive set we built from our data set. Also indicated is whether the marker is more highly expressed in Responsive (R) or in Non-responsive (N) patients. The probe set annotations are those provided by Affymetrix.

TABLE 4

| | LPS Predictive Marker Set | | | | | | |
|---|---|---|---|---|---|---|---|
| Subset | Order | Probe Set | Chip | Gene Symbol | Description | SEQ ID NO: | Direction |
| 1 | 1 | 210532_s_at | A | C14orf2 | chromosome 14 open reading frame 2 | 608 | N |
| 1 | 2 | 206790_s_at | A | NDUFB1 | NADH dehydrogenase (ubiquinone) 1 beta subcomplex, 1, 7 kDa | 516 | N |
| 1 | 3 | 200082_s_at | A | RPS7 | ribosomal protein S7 | 514 | N |
| 2 | 4 | 217988_at | A | CCNB1IP1 | cyclin B1 interacting protein 1 | 459 | N |
| 2 | 5 | 200937_s_at | A | RPL5 | ribosomal protein L5 | 520 | N |
| 2 | 6 | 213941_x_at | A | RPS7 | ribosomal protein S7 | 2 | N |
| 2 | 7 | 224616_at | A | DNCLI2 | dynein, cytoplasmic, light intermediate polypeptide 2 | 621 | R |
| 2 | 8 | 224985_at | A | SS18 | synovial sarcoma translocation, chromosome 18 | 578 | N |

It will be appreciated that additional marker sets may be obtained by employing the methods described herein, and methods standard in the field, for identifying models. There are many highly correlated features that could be substituted for each other in the models; these are not all listed. Similar methods may be employed utilizing one or more markers from the identified marker sets of the present invention in order to generate Predictive Marker Sets.

The present invention is not to be limited in scope by the specific embodiments described that are intended as illustrations of aspects of the invention. Functionally equivalent methods and components are within the scope of the invention, in addition to those shown and described herein and will become apparent to those skilled in the art from the foregoing description, using no more than routine experimentation. Such equivalents are intended to be encompassed by the following claims.

All references cited herein, including journal articles, patents, and databases are expressly incorporated by reference.

SEQUENCE LISTING (1415 sequences)

SEQ ID NO: 1 - DNA, 2099 bp, Homo sapiens
gcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgtaaaaaaaaaaaaaaa

SEQ ID NO: 2 - DNA, 615 bp, Homo sapiens
  misc_feature 401, 413, 433, 448, 480, 481, 519, 560, 561, 574, 575: n = A,T,C or G
actgtgaatatatactttttatttagtcatttttgtttacaattgaaactctgggaattcaaaattaacatccttgcccgtgagcttcttatagacaccagaaaaagtttcaaccttgtgttccacattgttctgctgtgctttgtccaaatgaacctttatgagccggctgccatctagtttgacgcggattctcttgcccacaatttcgcttgggaagaccaagtcctcaaggatggcatcgtgcacagctgtcagagtacggctcctgggacgcttttgcttattttttgtacggctttttcgagttggcttaggcagaattctcctctgagcgataaagacgacatgcttcccactgaactttttctccaattcgcgtactagccggacttggattntctggaaagatntcagttgaggaacgggacanagattatgatagctntccgaccaccaccaacttcaaatttcttagcnntgccgtatattcagctccctgagctgagccttgaggtnccgagttcatctccagctccagagagccctgggagatgccnngactcgactcgtnncgcttctcgcattggcttaacgatctttgcgctcgactga

SEQ ID NO: 3 - DNA, 567 bp, Homo sapiens
  misc_feature 457, 486, 496: n = A,T,C or G
tctgctggggtttgatccttctttgggtcatagtctggatcattttcctcatctccttcttcttccccttcctcatccgcttcttcaccttcttcatcataatcatcatcatcatcttcaatagcttctccagtaaaatataacactgatcttgggattatacgctcacgtaaaaagtgaccaatttcgaagtctgcagcaaggatagcttcagcatcatcatccagatctccactctcaggaacttcaggaggggcaaaaaagttaaagaaagagtcattggaaactgttttagtcacagtacgaactgtcccacgtcccttgtgtttctgcttcttcttaatagttttcaaagtgacattctttccttttttccaatctatctggcaccctgtacaacccataatttctggtccatcacaagaaaagggatcagaatcatctggttctgacctcnatcctgtatgtcttgtcagcacttcattngtaaaatatntcattgggttcaaagtgaaattctaagacaaaactcataggctggccagcatctgagaacttcacttttat

SEQ ID NO: 4 - DNA, 541 bp, Homo sapiens
cttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaaca

SEQ ID NO: 5 - DNA, 2097 bp, Homo sapiens
tccctctgctatggctcttcctcagtagaaacaactggcaacaaaattcaagtttatgattcattcatcagcaaacatgtgagaatcatctacaaagaaccaagaattgtgagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagttaaaaaaaaaaa

SEQ ID NO: 6 - DNA, 2488 bp, Homo sapiens
cttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaattagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgaaaaaaaaaaaaaaaaaaaaaaaa

SEQ ID NO: 7 - DNA, 302 bp, Homo sapiens
cttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttcaaaaaaa

SEQ ID NO: 8 - DNA, 1145 bp, Homo sapiens
cttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaaaaaaaaaaaaaaaaaaaaaaaaaaaaaaa

SEQ ID NO: 9 - DNA, 2145 bp, Homo sapiens
atgaggtttatgtggcaatggaggcaataggtttggagtcagtgatatgctcttagacacttttttctactcaggtgctacatgttatagaatcagccatctgcagggtgttgtcagagaagagagcatgagagtgtgtgtgtgcaagagtgtgtgtgtcagcatgccccaggctgggtgtgcatccacacagaagggaaaggcccttcctgtattgccagttttggcattagtcctctacatgagcctcagaccttcgcattgtgcattttctcttcatgcatctgctttgccatttttgtttggatgaaaattgtgttcctaaaacactgctaaactgaaccttcatctgatttcgtaactgtggacataagtagaaagtgaatagtttgaccactttgcccattaaaatagtttatatcctagaaagatgtgaagctacaagggtcacactttcggagcaaattttcttttaggcaaagtgcagagcctggagctacatcctttatatcctctggcacactcgggtgtggtcaaggcttccccatattttgaactgagccgtatgggtaactaggaattggagactaatgcaataataagcttacgcaggtttccttctaaattcaaactctctagttcctttgggtttgggtttggccatttgcttttaactactcagctggctcctgggtctcctgaccatctcatcctctctgtgacttaggtctggtccatttatccaagtacattttggctcactagactcactgtactatgtcttgtataagtgccaaaacatctgccgcttggggcagatatttaaatctgtgcctttcttttagacatacagtaagtttcagattcttcagtaaaggtttgctagagctcgatttttcctttgaaaatactttaatatctagattctaagttacattcatgtttttccttggtctttttttctctcttgttcctccctttcctcctttaacattatactttcaccctgtgccctctgagcccccacatcagaaagctcctctcttccacgtgccatataactgacttccaaagctggtgaaatttgatgcccccatttttcacataaaagatttggtttttaaatgttactgtgatgcaaacctactaaaacgatgctttattttggctgtaaggtaaatatgtcttttggcctttgtaaagctgttgcatgtggggtaatttccctctgatcatctggtgctcttgaatacctgctgttgctgctttgtgatttctccataggttaaatattagcataggaagaggagcagatttcaaatcatgctcgactatgcagaagtctgtgaggccacaagaacgtattaattacaaattcagaaagtaattaatctttccagatttgccatgccaatattggccatagccattaagaagttaagtaaacgcctggccatggctccagctggagctgaggtctgcatggaaagctatgctttgaaccttgacaacccgtttctcctggaatatgtgatatgccacactgagaaccaatatggatttctacagtcgattagaacatgattcaatagcattgcttttgattttcagaattcatggtagctcactcaatgaaattgcttcctagatgtagccatcctgattttgagagtggaaaatattatttatcaaaatattaagagcaatttcaaaatagatctgtgagcgatttatgggcctcttgcaaaatggtatacatgttgactgactgatctggaaaaggttaatgataattactgtcagatatttttttacctgaaatttttattggagtattaaaacttatttggagtcctctccgtttcttttctctgtaggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaaaaaaa

SEQ ID NO: 10 - DNA, 1021 bp, Homo sapiens
tgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacaaaaaaaaaaaaa

SEQ ID NO: 11 - DNA, 857 bp, Homo sapiens
cttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagattaataaagttctttgcctagt

SEQ ID NO: 12 - DNA, 1286 bp, Homo sapiens
ctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatgatcccataaaaactgcccaaggatctctctcactaaaggcatacagactgactcctaaactgatggaagtttgtaaagaaaaggatttttcccctgaagcattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcagcaatcatttggggaagaatctacagttgctgatggacagagtggatgaaatgagccaagatatagttaaatacaacacatacatgaggaatactagtaaacaacagcagcagaaacatcagtatcagcagcgtcgccagcaggagaatatgcagcgccagagccgaggagaacccccgctccctgaggaggacctgtccaaactcttcaaaccaccacagccgcctgccaggatggactcgctgctcattgcaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttgaaaaaaaaaaaa

SEQ ID NO: 13 - DNA, 529 bp, Homo sapiens
cgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaacta

SEQ ID NO: 14 - DNA, 1316 bp, Homo sapiens
cactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttaaaaaaaaaaaaaaaaaa

SEQ ID NO: 15 - DNA, 701 bp, Homo sapiens
gccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgaaaaaaaaaa

SEQ ID NO: 16 - DNA, 1273 bp, Homo sapiens
gcgggcggcgggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcactgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagc

SEQ ID NO: 17 - DNA, 477 bp, Homo sapiens
ggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaaacagtggcatggttcgtgccaaattccgaagcaatcttcctgctaaggccattggacacagaatccgagtgatgctgtacccctcaaggatttaaactaacgaacaaatcaataaataaatgtggatttgtgctcttgtatttttaagctgggcattaacaaaacttactaccgaaataaaaaaaatgaacac

SEQ ID NO: 18 - DNA, 554 bp, Homo sapiens
ctctttccgccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccaaaaaaaaaaaa

SEQ ID NO: 19 - DNA, 680 bp, Homo sapiens
ctatgtcgggacactcattagcaagaactttgctgcgctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgaaaaaaaaaaaaaaaaaacaaaaacaaagaaaaaaaaaaaaaaaaaaaaaaaaaagaaaaaaaaattcacgggccgacgttttacacagtcgtgacggggaaaaccctggcgttacccaacttattcgccttgcagcagatccccctttcgccagcgggcgtaataccgaagaggcccgaacgattgcccttccaagagttcccagcctgaaggggaaggggcacggtaggggtatattcgtaacatccggtaattctggtcagccgctctttctaccaatgccagacgccctataaccagaatacggaaggtgctttcccctggccctttaagggccccctggc

SEQ ID NO: 20 - DNA, 719 bp, Homo sapiens
agtctcttttccggttagcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttc

SEQ ID NO: 21 - DNA, 192 bp, Homo sapiens
atgttgggccagagcatccggaggttcacaacctctgtggtccgtaggagccactgtgaggagggccctgggaagaatttgccattttcagtggaaaacaagtggtcgttactagctaagatgtgtttgtactttggatctgcatttgctacaccctttcttgtagtaagacaacaactacttaaaacataa

SEQ ID NO: 22 - DNA, 1099 bp, Homo sapiens
tcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatttgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaaaaaaaaaaaaaaaaaaaaaaa

SEQ ID NO: 23 - DNA, 405 bp, Homo sapiens
gcggccgcctactactactactactgctcgaattcaagcttctaacgatgtacggggacatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaaa

SEQ ID NO: 24 - DNA, 477 bp, Homo sapiens
  misc_feature 361: n = A,T,C or G
tttttttttttttgattatataaagttttatatgtccaaatgtacagctggttggacctattcatgcatcttcaccagcagctggagcatctccacccttggtatttctggtgtaaattacttgagctctgtgctttgaaaccagtttgataagtcctttactaaggagctcctgaagggctgccctggccagggagcctcgaatcttcagtctctcagagaccacagctggggttataagtttatagttgggaacttccttacagagtttatcataggtagctttgtcaaacaagactaagttattgagcttgtcccgaactttgcctttggaccacttcttctttttggccttgccccnggatttgttcactgggtctttgtctttcttggccgactttccagcgtccttcttcttcttgtcgtcatttagcggcattggacgtcggagaatagcagcagacaccgcacctcgtc

SEQ ID NO: 25 - DNA, 3597 bp, Homo sapiens
gagacagggtctcgcttttcccttaggctggaatgcagtgctgtgatcactactcactgcagccttgacctcctgggctcaagtaatcctctcagctcagcctcctgagtagctaggactacaggtctgcaccaccatgcctgcaatttttttttttgtagagatggggtctcactttgttgtccaggctggtctcgaactcctggactcaagtgatccttccaccttggcctcccaaagtgctcggattacaggtgggagtcaccatgcccggccagcttcatttttgtgtcatagaaggtttctttcaaagtaagcatagtggcagatttgagtagttgcaacagatatgataacactcacaaagccaaaaatatttattctttgactttttataggaaaaatttggtaacctcctgatttagagcatgcaagagtaggcaaattaaaatgacaggatataagttactgtaatatttgaaaatttatgttatgtttttgaagtagagaagtatggagttaaatattaatacctttttaaatgtccaaatcctttttctgtgaggtagttttacatttacttttaagtacaaataaggaaattagcaatatttttattattggtgttctttagggaggttccacagtattaaagggttattaccaacttttttccctgccctaacatgtaatgttagtgtttgacccttcatttattcagtacaattatttgtcatactgtggagaatatatccagggcttaatgtcactttgaccatgaagtctggaacaagctgttggaggcagggcatcacagtaaggcagtcagaattggtgactttcagaaaatgaggtaaatctgttgtctgagtctgatcctaaactctcagtcagctattggactggattcttctaaagcagagtatctagaataggagggatgagcagactacatttggataaagaatttataaggtactctttaacaatttatatcagagttagttgctatctttagcaccattgtcctgatggcctccacttctagctatacattgcctctttgaaatgagccatttgggagaaagcaaatatatcaattagaatgcctttaagaataaaaaacttaaaaagcaaagaaaaacagaatgcctttaggaaaaaatttaataaaaccaactcaaaattgtgcaaacaaggaaattttagtgtttcccataataaaaatcctgaggtatggtagtttcagatagtttagcatcatcagcgccaacttttttttctgtattttcactctgccattctgagtattttggctttggctagttcctctcatggtcacaaatgcctaacgcagtttaggcatcataggcagatccaacagtatcgcagaaataagtgaggctgttaatccattgtgtcctttcttaagagtgagaaactctttctcataagttctcctcactctccagaactgggtcatataccaacccctagaccagtcacctggaatgggcatgaaatatagggcagagatggacacttgaatgaaataaaggttctgctagcaaataaaaagagggaatgactatcaggtgggcaacgaataacatctgctacactgtgatgggtttaacataaaaccaaagaccctgtgcattctgtcattttatgacatttaaactcctctccaacttgtgatacactggtattttaaggcagcatactggtattttaaggccttcttttttgaagttcttttgtgttaacagtcccccttctcccctgccatgttgtgtaaacaaaaaaaccctcatatttggggaaattttatcaaaatgccatgttctaacctatgagcaaatctttattatgcaagtatctatttagaatagtggtatgtaaatattgttcttccatcagacaactataactcttccagtaggtgagcttaaggtatgagttacaccaaaaagctttaaggagctgtattttactattagagggactgtgtccctctcattattttaagtgtaagaagaaaacttaattttgcattttggtctgattgaaataagggttgtagctatagtttcccccactttttttgcttaacaacttaattcttactctaatttaccttataatagctaatttaaaactcgttatttttgtttttaaattaactggtatgtactccaatagataagaattttaaaagaaaaatatgttttgcttaggaatgtgccctcattagtgtttgttttacttcgtttattataatctaaaatgatttgatacattttctttttacatgtcttagaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaaggtaagtcaacaacttaagaagtagatttaagtcaacttaagaagtagatttaagtacataacaaaatattgcagtcaagatccatgtatatagccagttactctcagtcacagaaagatttctgtttgctcagaaagtcttatattatttccaagaggaaaaactgagtacctattagggtatgccattaaaactgtcctcatgctgggactcattccacatgtaaaacttctaatagctaacatctgcccaaaaaggcacttgctttccagagcccaaacccagtcttaagaatcaaattgctctcggctttcggctcggaggaggccaaggtgcaactttcttcggtcgtcccgaatccgggttcatccaacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaggttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagatcgtcaacattgttcgacagatgcggcaccgatccttagccagagaactctctggaaccattaaagagatcctggggactgcccagtctgtgggctgtaatgttgatggccgccatcctcatgacatcatcgatgacatcaacagtggtgctgtggaatgcccagccagttaagcacaaaggaaaatatttcaataaaggatcatttgacaactgaaaaaaaaaaaaaaaaaa

SEQ ID NO: 26 - DNA, 462 bp, Homo sapiens
cttttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaacc

SEQ ID NO: 27 - DNA, 609 bp, Homo sapiens
ttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaatgtgcaa

SEQ ID NO: 28 - DNA, 311 bp, Homo sapiens
  misc_feature 110, 143: n = A,T,C or G
gtcttggtgaggtgccgccatttcatctgtcctcattctctgcgcctttcgcagagcttccagcagcgaatttgccattttcagtggaaaacaagtggtcgttactagcnaagatgtgttgtgtactttggatctgcatttgntacacccttccttgtagtaagacaccaactgcttaaaacataaggatgtttcagttcctccatttaacagatatgaagagcattttaagaggtgcagcctctggaagtgggatcaaactagaactcatatgccatactagatatgtttgtcaataaacttatgacgtg

SEQ ID NO: 29 - DNA, 972 bp, Homo sapiens
gattgcttatagaccggaagccgggaccttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactacaaaaaaaaaaaaaaaaaaa

SEQ ID NO: 30 - DNA, 961 bp, Homo sapiens
  misc_feature 333, 707: n = A,T,C or G
ggatggccagtagctaagtgggcttttaaagagtatgaagattgaaagggtttttctttcttttttaaaaaaagaaaaacaaactattgatgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttngttttgtggggtttttggttttctcccaaataaaatctgatcttccaaaaaaaaaaaaaaaaaaaaaaaaaaacatttgttggggccctcgggcctggaaaaaggttttcaaaaccaatttcgtgtgggggcgcggcggcccccggatgggttagttgaacctgtggcccaaggggtgttcccaaaggaaaaccccggctccggacatcaaggggctgtggcgttttctccccccaattaaaaaaaaagcccccggggggacacccggggtgtctctggcaccccaaacccgagatggagggtcgggagggcccaatggggcgcatctatacaccggggggctccaggcgaacccccgaaattcatgaccgccncgccggcggagcgggcagaaacacaggaatgatgacgaagagagcagcgcaagacagtacacacaagagagacgacggtagacgcacatacagaccgacagagaaaatcacaaggaatagacgagcagacaaacgacaacgaaagaagcagaacagaacgacgagcgaagacaaggaaacgcaagcaaggcagtaaaaagacagaggacaacagcaacaaacacgaatcaacaagtgaacagtacaagaacaga

SEQ ID NO: 31 - DNA, 542 bp, Homo sapiens
tttttttttttttttttcaaacatctttgatttattaagcaggtgcttctgggagaaactggtaaaaaagtagggataactatagcatttcaggtgaagtcgtaggataagccgggtactgctgagagcttagatgacaactgcacatcctctgggcaacaaagttatagtttgaagctctgcacttgtcattactggcttatgaatggctgatacactcaacaaactaaaatactcttatgaagagcagctttataaaacctactagaaacattacggccaagacacatcagaaccaaagcttagtaatcttcagggaagatggtaacattgattcctagatcatcatcatcatcattttcaagttcttcatcactttctttagtaatacactgggcacgtgttttttctgggtttctttttttcttatgaatatatgatgagttatttttctctttgatcttgggatgtaagttagtcatcgtttccctttccaaagcatgctgtaggcagttgtaaaacctctcaattcttttcttgtt

SEQ ID NO: 32 - DNA, 577 bp, Homo sapiens
tttatgatatcatagtcttttgactttattttctgagatggaaaagtataggcataggtgtttttaatagtcttcttgatgatatcctttagaataatctatcaaatggcttctttcatgtttcctgattatcagcattcatcagtgttactgtcagccttgattaagtggttgaaaatttcagagaagaataagcaacttctgtgaacctttccccaatccctgagaatcataatcattacagaaatattttatcctttcatcaaatatctctggaaagtagccgtgttcgttcattgttaatagggcaaggtgcagtgtcatagagggttaatccatgtaaattggcttccacccgtaaagaaattttctgaaaatcacgaatgtaagtcaggaaaaaaccaaagaaggaaaatgacatagaccattctgctgcagtagtgatcatgtgaagcacataacctttgtcctcggggttccaatggagtttctgttctaaatcagtcccaaaattgccactgtgcaaaactgatgagcaagtcagcatccacaccagataaccaacaacagtctgatc

SEQ ID NO: 33 - DNA, 1372 bp, Homo sapiens
caagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaaaaaaaaaaaaaaaa

SEQ ID NO: 34 - DNA, 1949 bp, Homo sapiens
gggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttccctca

SEQ ID NO: 35 - DNA, 636 bp, Homo sapiens
  misc_feature 23: n = A,T,C or G
ggcacgagccggacggacgcttngtttttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaacctccccagcccattcctgctgtcaaacaaacaaa

SEQ ID NO: 36 - DNA, 448 bp, Homo sapiens
caaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaaaaaaaaaaaaaaaaaaaaaaaaaaaaaaaaaaaaaaaaaaa

SEQ ID NO: 37 - DNA, 792 bp, Homo sapiens
  misc_feature 11, 22, 24, 27, 37, 38, 44: n = A,T,C or G
agggtactgtnatgccatcgancnccnttgtttgaanntccttngtctcgggacgcgcgccattgtgttggtacccgggaattcggccattatggccgggaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatacgtatgacctcttgaaatgttaatttttaataaaatttgtaacacttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttttgggcccctttgccccaatgattttttaacttggaaaattttttttttggggcccaaattagggcttttttggccaattcccccttttgggggggctttaaaaatcaacgtgccgggttttaaaaactttggtcgggaaaaaccctgggtttccccaatttaactccctttgaaaaaaatcctcttgttccaacgtggggattactcaaaaggagcccccacttctgccctttcaaaaatttggccaccttgatctggaaatggaaatctggaggcttattttttgttaaaaattccggtattttgtttacccttttttttaacccgg

SEQ ID NO: 38 - DNA, 100167 bp, Homo sapiens
gatcatcacccctgaaaactataaaacattgatgaaataacaggaagatagcccatattcatgaactggaagaattaatagtgttaaaatgtgcatacttacccaaagcattctgaagatttattgcaatctctatcaaaatttcaatgctattttttattaaaatagaaaaaacaattctaaaatttgtatgggaccacaaaaaaaacttgaaaagccaaagcaatcttgagcaagaacaaagctggaggcatcagacaaaatgtcctataaagttatggtagccaaaacagcatagtattgtaataaaagcatacatacagatcaatggaacagaatagagagcccagaaataaatccatgaatttacagtcaattaatctttgacaaaagtgccgggaatatacagtggggaaaagaaagtctctttaacaaatggtgttggaaaaactggatatcataatcagaaatactaatttgcaccctatcttataccatatacaaaaaatcactcaaaataagtttaatacctgaaactataagattcctagaagaaaacaaaagaaaagacattggtctggatggtgactttgagcacaggcaacaaaagtaaaaataaactaatgaaatgacatcaaactgaaaagcttctgtgcagcaaagaaaacaattcctaaagtaaagagacaacttgtggaatgggacaaaatatttgcaaatcatatatctgataaggggttaatataaaaaatatataaggaactcaaacaactcaatagcaagaaaacaaacagacatttctctgaagaaaacatacaaataaccaacaggtatatcaaaaaatgctaaattgctgatcaccagggaaatacaaatcaagaccacaaagagataacacttcatacctgttaaaatggctattgtaaaaaagacaaaagcgaagtgttgatgaggatgtggagaaaaaggaaccctcatgcactgttggaggaaatgtgcattggtacagccactatggagaactctacggtggttccttaataaattgaaaacagaactactatatgatccagcaatcccacttctgggcatatatccacagggaaatgaactcagtatctcaaagagttatctgcaatgttccttgcaacattatgtacaacagccaagatatgaaaccaacctaagtatccattgatggaaaaatgaattttaaaaactgtggggtaattaattatagatatatctctatctatgcctctctctcttttcctccctccctctctctctctctatctctttctctctctctctccctctctctctcacacacacacacacacacacacacacacacacacacacacatatacacatacacacatactggaatattattcagcctttaaatagaggaaaaatctgccatttgtgacaacaaaggttaaactggaggacattatgctaagtgcagccagttagacacagaaaggcaagttttggatgatgtcacttagatgtagaatcttaaaaagttaaactcataaaagcagagtggaaaattggttaccaggagctggagagtcgggggatggcgagatgttggtcaaaggttgcaaagttcagttatgcaggatgaatgaggactagagttctattgcacagcatgcaaactataattaatgtattgtagacttgaaatttattaagataacagatctaaatgttcctatcataaaaaataaaactggtaactctgggagatgatggactgtggtaatcacttcacaatgtatatgtacatcaacacattacattgtacatcataaatacatacaatttttatttgtcaattttacctaaaatttacctttcaaaattcacaaaatgagtaaaacagaaatttgaatattttaaatttcaagtttttttaaagttaatagcattcatacttctcaagttattgaagattaaaactctactaacagccgggcatggtggctcatgcctgtaatcccagtactttgggaggctgaggcaggtggatcacctgagtttgagaccagcctagacaacgtggtgaaaccccacctctactaaaaataccaaaaatagccaggtgtggtggggcatgcctgtaatcccagctactcaagaggttgaggcaggagaatcacttgaacccaggaggcagaggttgcagtaagccaagattgcaccactgcaccccagcctgggcgacagagtgagactccatctcaaaacaaacaaacaaacaaacaaacaaacaaacaactccactaagacttttgggacaacctgtacctacctgacctgcctttccatctttaatgctcttctgtgctccccagccccacttcaattgcgtactggacaaagtcatgactgccaagtagggaaccccaggatctccaggatctggcatctaaccacatctccaaccctacctcctagaactctttgcctctactctccctccactgccattggagccccacagattctgagttgcttattgaatctgcatctttgccagtgctatgctttttaacaaaacgcaggctccctgttccttccatcctcttctttgcaagtttcaactcacatatctcttccttcaaatgagccttccctaaaaaacaatcttccctacccttccagctgtgctccctcaggatcctgtgcacgtgtctgtcctgggcttaactcacaatgtcactgccctatgattctgtctttatgagaaagtttctccttctccactgtgagatttcaagaaacgggctcagaagtgagagaataagtgaaggaggaaaaaaaaaaaaaagactcatgaatttaagaagcaaacatcaagggtcttagtaattgctattatttgtgtcttataattggcttgaccaactgagtagctggtcaccgttcttccatttattagttgtgacattgggaaaaccctcttacttctcagtgtgtttcttgtctctcaaataacaaaacattcagcccctgttggcatggtaaatttggatctgcaatcaaatgaaattaaggatgtgaatatgctttcacatctaagctctacacttgcaagatgtttttactgcaagcttctgaatcacagtataaaaacatgaaatttggaaacagaaaaggctaggagataacaaagttgaaatacttcattttcaatggcaaatacatgggatcaacccaaatgcccatcagtgttaggctagataaagaaaatgtggtacatatacaccatggaatactatgcagccataaagaagaactagatcatgtccttttcagaaatgtagatttctgaaatctggagctggaggccattttccttagcaaactcatgcaggaacagaaaaccaaataccacgtgttctcacttataagtgggaggtaaatgatgagaacacatggatacatagaagggaacaacacacactgggggctacctgagggtggagggttgggggaggcagaggatcaggaaaaataactaatgggtagtaggcttaacacctgggtgataaaataatctgtacaacaaactcccatgacacaaagtttacctatgtaataaacctgcacatgtaccctgaacttaaaaagcaaaaagaaatccttcattttattaataaggaaatgaaatatgagtgaaaagagacttatccaagatcacgcaatgaggcagatttagagctttctcaaacctggggctactggctctttccaaaacctcattcttattttttgtcttatttttcttctttctttctttttttactttcttattctttcttcagcacagcccttcagctctttctttcccccaaatagaagaatcactctttttcccaccaaatagaagaatagccgtagttaagtgccgttgatctttgttgactgaaaatctaactttgtgcatgcctacaccatgtccccagctgccgtgtacttgttagcatggatacttactgggccaagaggcacacaggaagcccctgaaagtatttactccaaccagacccagggaaaaatgaaactgggttgtcttttagggatattgtctttcagggactaagttaccatggcaagcagagatctactgccttggcttacaaactgttcccctgtgaggtcttccacaggcaaattgctctataaatctatgttgtttaattttgagtaaagggatagaaaggttccctacgagaaaatgccggggaaagaaagaaacccaaaactgagttttccaaaagactagatttaaatctccttagaacattgttacttcttcgttgctcaaagagtgtctttgtaagtcaggtcagcggcggctgtcacacgctgtgggggaagatgtgtggcatttcatcagaggggcagctcaagcagcagactcagatcaggaaattagaaatgtttccctgcctgcccaagaaaggctagattcacagttttggttcagacgtgtcccagaattttagccaaccatggaagtctttggagctgaaaatcaagctgtcaaaatgtcttttctaagcatctgctgtgtctagtcctgtgtcaaatgatgacagcgatgttatcatctccactcacatgctttcctgtgccagtcatcccactgcgcactttgcgtacatttgctaatattataatgaccctttgagataaatattattattctcatttttcatacaaagaaagttagcatcctcaaaccaaacagcttgccatcgttcatatatggtcttttgtacctggcttctttcaatcagaatgttttcactgttgtagcatgcatcagtagttcattccttcttattgccaaataatatccaattgtgtaacccatttttaaaatctattcatcagttggggaacacatgggttgtttctactttttggctatcatagttaattctgctaggaatattcatgtacagtttttgtatggacatgtgtttttatttattttaagcatatgactaggagtggaatcactgggccacatggaaattctataacattttcaggaactttcaaacatatttccaaagtggttgtaccattttacaatctcaccagcaatatattagcgttttaagtttttcacgtctttgctaatatttgttattgtttgattcattgataatagccattccagaggatataaagtgatatctcattgtaattttgtttgtttgtttagagacagtgtctcactctgttgcccaggctagagtatagtggagcaatcatagctcactgtaacctcaaactcctgggcccaagcaatcctcccacctcagcctcccaagtagctaggactacaggcatatgccaccatgcctagctaattttttaattttttgtagagatagggtctcactatgtgcccagggtaacctcaagctcctggtgtcaagtgatccatccacttcaacctcccaaagtgctaggattacaggtgtaagccactgtgcctggccaatttgagcatttttaaatgttctcattgatcagttaaatttcttctttggggaatgtctattcaaatcctttgcccattttaaaattgggttatttgtatttttattgttaagataactcttaaattttatttattttttgagatggagcctcactctgttgcccaggctggagtgcagtagcatgatatcagctcactgaaacccccacctcctgggttcaagcgattctcctgcctcaacctcccgagtagctgggctttcaggtgcatgccaccactcctggctaatttttgtattttagttgagacagggtttcaccatgttggccaggctggtcttgaactcctgacctcaagtgatctgcatgcctcagcctccaaagtgctgggattacaggcgtgagccaccgtgcccagcctaagataactcttgagaagtcttacatattttggatatagaccctttattatatgtataatttgcaaatattcttttctccattctgtaggtaaatccacagagacagaaagtactaatgagtttcaggaggtaggagggaaagaggagtatctgctaatgggtatagggcttcttttagtactgataaaaaaatttctaaaattagtggtgaagtttgcacaactctttaaatatatttttaaaacatagaattgtgtactttaagatggtaaattttgtggtgtgtgagttatatctgcataaagttgttacttttttttaattgaacagcttggaagtggtaggacttggactggaatttaagtctaccaaactctaaagtctaactatgttacacagccatggggagagggaacaatgttggacagaaaaagtacagagaagaagaggtggaatacacagacatcaagctactcacaaaactaattgtggagatggatctagatgatgcactgcatttacatatataccctccttcctgaatgacaggaagagattatttttaataaaaataaatttaatgtaatttaagtaatgtcagaaaggtaggaagcattcaacaaagaaaagcccaggactagaagccttcatgagtgaattctgctaaacacttaaagtaaaattaacaccaacatttattaaatgctccagaaaaatagaagaagaaacacacctaacctcatattatgaggccagcatcaccctgatactaaagccagaaaaaggcaacacaagaaaagagactacaggccaatatccttgatgaacacacatgcaaaaatcttcaataaaatactagcaaactgaattcaacagcacattaaaaggatcatacaccatgatggggtgaaatttatccttgagatcaatcatggtttgatgtacaaaaatcaatcattgtgatacaacagatactacattaacagaatgagagacaaaaaccacatgattatttcaatagatgcaggaaaagtattttgacaaattcaatatcctttcatgataaaagaaactctcaacagaataggtatagaaataacttatttcatcacaatagaggcatatatgaaaaacctacctctagcatcataatcaatggagaaagactaaaagcttttcctctaagatccagaacaaggcaagggtgcccagtcttgccactgctattcaacatagtactggaagtcctagacagagtaatcagacaagaaaaagaaattaaaagtatccaaattggaaaggaagaagtaaacttatctctgtttccagacggtatgatcatatatgtagaaaatcctaaagattcactaaaacaaaagttgttagaactaataaacaaattcaataaaggatttgcaggatacaaaatcaacatacaaaatcagtggtatttttatacaccaacaaactatctgaagggaaattaagaaaacaattccatttattaatacattagcaatggcagcagcaacaaataaaatatttgggaattaagcaaagagatgaaagacctatataccaaaaattataaaacattgatgaaggaaatctaaaaagacacaaataaaggaatagttatcccatgttcatgaattggaagaattaatattgtcaaaatcttcttactacccaaagtgatatacagatttaatgcaatccctatcaaaatcccaatggtatgttttacagaaataaaaaaaaatcttaaaattaatatgataccacaaaaagccctaaatagtcaaagcaatcttgagtaagaaaaataaaattgaaggcatcacaccacctaattacaaaatatactacaaagctatagtaatcaaaagagtttagtactggcataaaaacacatagaccaatggaacagaatagagaacccagaaataaacccacatatatatgattaattggcctttgtcaggagtgtcagtaacacaaaatggaaaagaacagtctcttcaacaaatggtgatttttaaaaatctggatatccacatgcaagaaaaaaatttaattagacccctatttcacaccatatacaaaaattaactcaaaatggattaaagacttaaatgtaaacttgaaactgtaaacctcctagaagaaaacataggaaaaaccaatcttgacattggtcttggcaataatttttggttatgaccccaaaagttcaggcaacaaaagcaaaaatagacaagtgggataacatgaaacccaaaaacttctgcatagcaagagaaacaatcaacaaaatgaaaagacaacatatgatataagaaaagtatttgcaaacctacatccaataagggattagtatccaaaatatagaaggagccactacaactcaatagcaaaaataagcaaaaagcatgattttaaaatgggcaaaggacctcaatagacactccatgaaagaacaaatttaaatggccagcaggcgtatgaaaatgtgtccaacatcaattatcagggaaatggaaatcaaaaccacaatgaaaccctacctcacagctgttaagatggttacttatcaaagaggcaaaagatggttggtcaggatgtggagaagaaggaaaccttatacattgttagtgggaatgtaaattactacagccattatggaaaacagtatggaggttcctcaaaaaaattaaaaatggaactagtatatggtacagcaatcctacttctgcgtgtatatccaaaggaattgaaagcaggtttgtaggccaggtacagtggctcatgactgtaatcccagcactttgggaggcagaggcaggtggatcacttgaggtcaggagttcgagaccagcctggccaacatgatgaaaccccgtctctactaaaaatacaaaaattagccaggtgtggtggcacactcctgtaatcccagctactagggaggctgaggcgggagaatcacttgaacatgggaggcagaggctgccatgggctgagatcgtgccactgcactcccacctgggcgacagagggaaactcagtctcaaaaaaaaaaaaaaaaaaggccaggcatggtggctcatgcctgtaatcccggcgatttgggaggctgaggtggttggatcatttgaggtcacgagtttgagaccagcctggccaacatggtgaaaccccatctctactaaaaatatgaaaattagctgggcatggtggtgcacacctgtagtcgcagctactcaggaggctgaggcaggagaatcactggaacccgggaggcagaggttgcaatgagccaagatcgggccactgcactccagtctgggcagcagagccagactccatctcaaaaaacaaacaaaacaaaaaacaaaaaaacccatgtttgcaaagagatatctgtactcccatgttcattgcacattattcacaatagccaagatatggaaacaacttaaatgtcctttgatggatgaatgcataaagaaaatatggtgtatgtgtacaacagaatattattcagccttaaaaaggaaggaaaccctgccaattgtgacaataagaatggagctggaaggcattatgctaagtgaaataagcaagacacagaaacagaaatactacatgatctctcttatagatggaatctgaaacagtcaaacttacagaagtggagagcagaattgtggttgccaaggactgtgggggaaggggaatgaagtgatgttggtcaaagggtacagagtttcttttatgcaaaatgagttatttctagagatcttaggctctgcttctggggcaatccaaactaagacaggtattaaatacaaatttaaaaggtttatctttaaagtcttgcaattgaattgggaagatatttacaattttacacaatattaggactcttaaatcagccatatcttaaagtgtttaattaagttttaccctctcattagccattgacaataaatcagtgtagattggtacatcatgggccatttaacattccttggcatttatttgcaacagctcattattatccaaaagtcagctgctgccaaatttcctctccaataggcaaagaaattcccagttggaaggtgagctgactaccaactcaggctgcctgcttattgggtttcatgcatccctctcctcccgcccttcctcaactgggcaatctacaggacctccaaagtgccttctccttggggaaggatgtatatttctcctaagagtggttcagaaagattaatgctaaagaaacttccccagtttctccctctttatcgatttccatcttctaaagatttcagcactttgaagcttaatcaatttgtatcacagttagttccatgtccatgttttggtcttttagttctttaacgaattcctctccttttgaacatgaaagaggcagatacttagctttaagtttccatctgccttcaagtcccattttgttcagagaaattaatataatctggggaaaataaacctaaaattatttggaaataggactcatgtaatttcttatacaggcaattttttgctttgacatccagggaactttgaatgtttgcctgagttcagcttgtttggaggtaaggcatctaaactgaccctaatttaagcaaaagaggggtttattgaaaatatgcttggtagtttatagaactaaagagcttaataaaccagtctctggaagtatgtagtcaggaaagattcagggatctcacagacagaaattcccagacttcatcattacactgttaccttcatacaactccagaaccaaccatcttacctccctgtgcattcccactcagatgctcccaagagaaggaatttggcctagtttgggcatgtgctcaacacctgtggtcagtagagcaggagtgtgggttatcctctgatgagtttctctaccagaagagaatattggtggcagggcatgaaggaaagggaggggggcctgcaattctcccaaagaaagagatgctgggcagatggaagccatagatatccactacatttattcctcagctatccatttgtccatatctccattcacagaattttacaaatgctgccatctaacattacaaaatcataccacgtaaaccttcaactgtactccttcctgaaagtctcagccagctattgcacctagaatcaaggcctccaggcccctgttctcccaggatagaatctctaagtgcatctcatatctctttaccatgtactatttcagtacatgctggccctgacttccaactgccagcactctttgcctgtaggctctctctggccactggagacttctttgaccatttttggggtagggaaggaaatgtctaaaagttatcaccactttgggagcagccctcaaccaatgactaaaggaactaatagacaaatatatgtttttcctcaccctttctggaactattggaagaactcttaggtgtatattctacagttttccagagtgcttaatcctttgggattatgctccagttgctcacactgataatatgcacagtagtgtatcctttattgcctgcactttctcttcctcaatctcatgttcccactgtcctactgatacttcctagagtcacctcttaaatggcatgaacccaaattcttgcctcagtgtttgcttctatgttattgggtattttttattcatcctctaggtctgccataataccatctcacaattttgtaacctatggactaaaagatagatttcaccatgactaactggtctttatgcagctggtcactatgccgtagctattatgtgtgaatcctgcccatttgatgttgttttgcccttattcagtctttcagtcagtaggattccttccaagtggagtaaccaatgtttcactcctgaaagcctctaattcctcagaagtccttcttttgctttttctgtgtctttaacaggacattccaccattttatgaggtcagctacttctgggttatagggaacataatgtgataagaccagtgtatcccatcagctcattgtcttccattttgcacactgaggtgagtccctatttaggataagtgtagtatggaatagaagccataatagtgaacaaggctctcagtacatccgtgtgtaagaacagaaaactcagctcccagacgtgtttattaatagtttgataagaaaaataatgactgcatgttctgtgatgaaaagggtccagtggaattactggctaccaggtattcagtatggcttcatgtaagggtcttgaggataattgttttgctgccacattggggtgtcagcagtggtggcaagggaaagtttatttcgctatagcttccctggtcatgggcaatgtgagcaacaccacaggtggctggggcaggtggatgactgacatccagaggagataagaccatccttgtttggttattaaagtattcttctgaagtgagggatttctagtactatgtatgcaggatagaaatatgctcatattttggacccacatatgtttcctgaacttccttatagttcatgtttgaatcattctctgagttcctaaccttcacccaaaaaattagctactgcccaactgtctgtgtaaatccttacaattgtttgtctctatgtccaggacaagtgggaaataatatatactgtaatcattaaagttctgcccacagaaaaatttcccattttttattatgcttcaaagctacatctgagtagggctctaataccactgtaatccatggtatattgtacatagtcacctgcatagtcacctgtacacaaagctctaattttttcctcattagttagccaatcataaggagctcctcatgtgtccaggtgcagattaagggaggggagcagagagacaggaataggggttctgagcgggtttgcaacccacaacttctgaaactaacctgcacgttcaggacctgttgaggcttgatctggcatgtatctcttccccttgatgacagagcacgctgaagatgcctccctttatgatggattgaataaaattgcatccagatataatggactgctcggaactcatggccacatgatctttcagatgtttaatctcaaacacagcacaatatcagggccaaagctgttacttaagggaaaattgtcacttactggaagtctaattgccttgatccaaaatcctatgggtgcactatagttttcatattggaacttaccaaactctctatatgacctccgtaactgctacaaacattttgaagactattggatccatcaaataatataggtcaggtgaatccagcctatattacctggagccactgaagatacatcctcatgggtgctgggtgccacccagaactggcatctatgttcacaggagagattgttctcttttctttctctccataatgtctttgtcttcttttgtatcaaaacaattttttcatcatattttcttattcatattaaaattgaaactatattttactcattgaagagtaaacaatttcaatctatgaaaaaatcttacacatttatttaaattatatatctgttataaaaaatataaagtcaacaatttattaggttcactaatgtttaatttacaatacaattttgctttaatgctctattttcctaaatataatgaactaaagtaatgatgatagaaaattaagtagacctgcttaaaatttataaaaagttaaaaaataggaagaattcaagagtaaagaaagccatctggactggacctgaaattttctttttggaagatttttaaaatcacacattcaccttctttaaacagatgtatgatactgagatttttttctattttttatcaattttcataaattgtggttttcttggatttatccatgtcatctctattttcaaatttattagcataaagttgctcataatatcctcttatctttttacagctttattgaggtataattgatatacacaaaaactgcatatacttaatgtatacaatttgatgagtttggacacatatacgcacccataccaccatcaccacaatcaaggtaataaatatacccatcaacccctgaagttccttgtgtctctgtgctttagtgtgtgtgtgtgtgtgtgtgtgtgtgtgtgtgtgatcatgtatcatgagatctactctcctcaatgtttaagtgaaaacactgtattattaaccacaggcacaatgttgtacagcagatctctagaatttattcatcttgtataatggtgactttatacccactgagcaacaactctccatctcccccttctctccttccctggcaaccaccattctattttcggcttctaaaagtttgactattttagatttctcatataaataaaattatgcaatatttgttattttttgactagcttattttactttgcataatgtcttccaggtctacccatgttgttaacaaatttccttcgtgtttaaggctgaataatattccattatatatacagtgccacattttctttatccatttatctgtcagtagacaattgggtagtttcccaacacaaatgccttggctgttgtacataatgctacaatgaacatgagaatgcagatatgtctttgagattctgactccaattattatggatgtatacccgggaatgggattgctggataacatgctagttccatttttaatttctttgtgaaggctccatactgttttccatagtgactgcatttcacatttctaccaacagtgtacaagagttctgatttctccatatccttgccaacacgtgttatctttaatttaaataagagccattctaacattgattaagatgttacctgggggattgtcataagtggcctttattatgttgaaatacattcctgctaaacctagttggttgagtgtctttatcatgaaggatgtggaattttatcaaatgctttctctgtatctattgagatgatcatgtgatttttatctttcattctgttaatctggtgtgtcacatgtattgatttgcgtatgttaaaatatccctgcatctcagggataaaccacacttgatcacggcatgtgatcttttcactgtgttgttgcatttaatttgctaatattttgttgggaatttttgtatctttactcatcggaaatagtgacctgtagttttcttttcttgtagtgtctttgtctggccttggtatctgggtaataccaacctcataaaatgaagttggaagtatttgctcctcttcaatttttcggaagagtttgagaaaaaatggcattaattcctctttaagtgcttgatagaattcaccaatgacatcatctagtcctgggcttttctttcttgggaagtttttgattgctgattcaatctccttactcattattggtctgtttagattttctgtttctccatgattcagtcttggtaggttgtatgtttataggaatttctccatttctactacgttatgcaatttcttgatgtataattgttcatagtagtctcttatgatcctttttattcatgtggtgtcaactgtagtgtttccattttcattcctaattttatttatctgagtcttctttccttttttgttagttaagtcagtcaagggttttgccaattctatttatcatttcagaaaactaattcttagttttgttgatttttttctattgtttttctagttcccattttatttatttctgctctaatctttactaactttcactaactttgggtttagtttgttcgtctttctcgaattccctgaggtgtaaagttaggttgtttatttgagacctttcttcttttttaaggcaggcatttttcactatgaacttccctctcattactgtttttgctgtactccatagttttagtatgtattgttttcattttgtttctctcaaggtatgtcttgatttctcctctgactcatcgaatgttcaggagtgcattgttaaatttccacatttttgtgaattttctaatttaccttctgttgttaatttctgatttcataccattgtggtcagagaagatatttgatatgatttaaatcttaaatatgtgaagacttattttgtggtctcatatgtgatctatcccaaagaatgttccgtatgtgcttgagaagaatgtgtattcctctgcagtttggtagaatgtactacatcaagggagtccaatcttttggcttcgctgtgccacattgaaagaataattgtcttgggccacacataaaatacactaacaataacaatagctgttgagctaagaaaaaaattgtgacagatctcataatgttttaagaaagtttatgaatttgtgttgggctgcattcaaagccatcctgggctgcatgtggcctgtgggccacgggttggacaagcttgctctacatatatccattaggtccatttggtgtatagtgtggttcaagtctgatgtttcctcattgattttctgtctggatgttctatccattgttgatttgatgtgttgtaaaatgtccattagatttgttttaatcatgtgtgataaaatacatgggcacagaaatgactatcatgaaggaagatttttgtattaatatctacagttccatagaagcagaaggcacagcatgccacagagaaatacatggggaagcagcagggtcagtcaggagcagagggagtgagggggaaacatgggcaagagtattgtgttggttgtgtgtgtgtgtgtgtatgtgtttgtgtgtgtgtatgtgtgtgtgcatgtgtgtgtatgtggaaagagatgccaaggcagggtaagtgtgctaagtaggtttatgattggctaattggaataatttcagcaggctctagggagaagggccgcccctggttgtcagaaacctggacctggggtgattggagcagggaaataatggcaaggcatgtgagagctcaacaaagggggttgttgaactggtttatttgcatatgaaaggaacccttgcaggtaagttcttcactatgtctaggaattgggtagccctaagaggaaaagtctattcaggatcagccctaagagagggaagtctctgagatgggaaggctctctaagatcagcaaggccccagatgccaaaatgttagaaaataaaaaggcatgattaatacatatctgatagatttgtagcagcatcaaatttttttaactcctaatattggtatttgtgccgtctctctttttttcttgcttattattgctattgcttagcgtttatcaattttattgctcttttaaaagaacaaacatttgtctgtgtactaatacattcccaactttttatggcataaattaatggctacttgaattccatctggtggagtatgaactctagcacagtgagtaataatgagtcacttttattggataccactgaatgcaggactttactgtgatcactgtgtgggcagtgataacaactcagaaataacatgcagagataacaacctcatcctccgctcttctcatagacacacagaacctttagaaattcatcactgtggcaatgtcttcacagagtggtccttggagaaccagcataagaatcacctgaggaccttgttaaaaactcaaattctacatccccacctcagacctaccaaatcaaacatacagctagtaatatgcatttttggaaaaataccttagtgaatcttttgtaagataaaagttttagaatcataaaaatttcagaataagaaatctaatggaaaaggcacagacctcacaatttgagtttgccttatttaaatgagaaagatatgacatggccatataggaaaatgcacataagtgtttgcagaaatcccattgctaggaactacatcatggttctgaatctattgccaatcctctgaccttggccaccttgctggcctccacatccctggggtgcttggtacaaatcttatttgtcaagttcaaatggctgaagctttaaaaactgcaatcagaaagctgaggctgctggatctgcttcaagttccccaatcaagagtctcaattttaatcctggaagcaattgattataaagaagcctaacgagatctgagttttagtggcctccattaattacctaaatggagggtgagacttcacttggacaaggactggcaccaaatcctgcttcagccttttagagctggctcataaatcagaggataagaccaaaaagaattttaaaattggacagaatcatgatcccatccaagagccatttttatataatcctatccctgcttggtaattactaggctatgacaattaattacttgctttggattaaaacccattcagtgctagatggatcatattttagtctggtaagataaattgtactacattttacctgtgcagaggtatcagtagatggagaatgataagctgaacaaaaatggtttattaaaaatagtccagggacaattagtacctaaacagcctgcagattcttttttaaaaggggtttttactgactcatagagagctggagtttctaaagtctttacaaaagaacagcttcattcagcttctatattgagaacatagaaatagtagttagtgcaggcaagtccagttttcagaaaacttgaaatgtagaaactcagatttgcaaactttgtaaataaggggatactcattacaaagctgggctggcttcctacccagctcctgttccctgtagatatattcactaagccattttcctgctgaatcttgaaataatgcatgtggggggatttcaagagccctcttatgtctccaaaccatatcctataaccacccttatgcctcaatctagtaataatagcaacaacatttattaagcccttagtagttaccaaataatattttcaataattttaggctttatttcattacatcctcacaataactctatgaagtaggcactattatcatctgcatttcacctaggagaaactgaggctcaaaatagctagttaaccttcccaggatcactgtatcagttctattgctgtgtagcaaactaccccaaacctactagattaaaagaataaacatgtatttggctcataattctgtggatcagcaattttggctgggctcagctgggtggttctagacttgcatgaggtctctgtggcatgtgtagtcagatgcacatcagatgtgctcatcttgactgggttcttacacaagtccggagccttaggtggaacagctgagctgacttgtctctgcccctgtaggctagtgcaagcatgctcacatggcagctaaacaggattccaagagaggaagctgaggtatgcaagtcctcttgggctgtaggttagaactggcaccgcatcacaattctgcccctttcttttgcccacagcatgtcacaggctagcccagattcaaaagatagaaaaatagattcctcctcttgatagaaagaactgcaaaattacattgcaaagaatgagaatatagggaggtgtggagaattgaggctatttgggttttttttttttttttttttttttggccatccatctacctggttatataatcggtcaattgtagagccaacattcaggggatcccttgactgcacagccagcaccccgaccactttgccatactgccttcataacaatggtttatcttctttctgtaactgggccttggttttactatttgaataaaccctctactttagttaacctgctgctattccaatttttccaggtctttagatctgcctgcttttgacctttgccccaatgccattctgcattagagcgctgctggactctgctaaaagacctacccaaagatgacggtcttcctgccaagggctatgccctgtgattggcccagacaacctactttgccatgtgtcaccaaattccttgcatatactgctctgtcacctcccagcacctccacaatttggcctagcacttcaatgcacttgttcacttatccatggattcgaccctgtctaccactgagcagctcctatagtctttcacttcgaaaagtgatccattgtaacaatcttctaaatgactagtgccaccccctgtttaaaacaggattgtatttcctaaaactcaatatgcaaagtttctgaaacatagctactgcattgagtaagacccactgttaactgtgaattcaactcgaaatttttctctcctctttggagtcaggcattgtagccagccatagctccctatccctgaccttaccctagttgctccttttataccttttataccacaccaggactgcctctacattcttccctgaaccctgctgtggctaagaatcacgcggctgtaaccactggacaagggatctcattatcctcaagatagtgtattaaaaccagatatttatctgtagttggtgtatttgcttttttgcagacactgttagttttggaaactttaaaaagtaaattgttagacacattgagacagagcagagccatggtaggtcaaccacttcactgagtatgtcacctttgacaaattgtttctctgttcagcacttcagttttctcatctacacacggaaattattagattagatgattgctcaagtctcaccaagttttaacattttctttctttttccctcccttcctccctttctctccctctccctctctttctttctctctctctctttctccccttctttctttctttctctctctctttttctttctttctttctttctttctctctctccctctctttctttctctctctccctctctttctctctttctctctttctctctttctctctttctctctctctctctctctttctttctttctttctttctttctttctttctttctttctttctttctttctttctttcacttctttctttctttctgtcacccaggcaactccagtgcacaccactggagtatagccatatgaactcactgcaacctctgcctcccaggttcaagccttcctcccacctcagcctacccagtaacagggactataggcatgaaccaccacacccagctaatttttgtttgtttgtttggtagagacagggtttcaccctgctgcccaggctggtcttgaactcctgggctcaagtgatccacctgcttcagcttcccaaagtgctgggattgcaggagtgagccacgatgcccagcagttttaacattttctgatttgaaatatttgttcagcacctactatatacatggaaggatcagagtcagcagcagaggagctacttgagtacaacacaggacatcaggtcaccctagcaggaatgttcataaagccattagcctgcagcatgtctgaggccatactatgcacccttgctcatatcctgattaatcatccacatcctgtgataatgccccacaacatctgcagtattgcaggtaatatttctgaattcttcccattgcagattccagttgcaaataacagaatcctctctgtctcagcatttttaagccagggtatgtctaccactcttcccaagacatgaatagttttaagggaatcaattggtataatctcattttccatatgtactttcataaaactgttctacttggagttggggtgttttgttggttttctatttctaccttctcattgaaaactgttaattacttttcaaaagaaaatcataacattttattaattttatttgagcataaaaatacataacattaattaattaattaaatgttatacaccaatcctatggtgcattgatctaggatttagaaatttccagggtatcaatcaaagtacagtttccaatatttgtgtcaaggaatctccttgatccaaggaatatcaaggctggtacttcttatattgcatgtacatctattaaggaatgactatggcattagaaacaggcttttggcctgtgttgaggtgccctcttacatcgtagactggggagaaatgttataatgacctcaccacctgtaactcttcactcttggtaaagaatgtatcaatacttatggaaagtgcatatattatagactagggagaagtgttataatgatctcaccacgtgtatttcctgactcttggtaaaggatgtatcaatttttatggaaagcaacctaaggacaaaacaaaaagcctatacataagagctggggaagctggaggcatctgatttcacccaggtggcaagctctcagcgaggatgcatgctttatcctatctgcccttctatcttggacatagaattcagaagttaaatggctgtcgtaggaatgcataataacatgcttatttgaattgaaaaatggagtcagagtatttctgacagaaattaggtctgacttggctcattaatttgaccgtgaacactggctttgtcaattaggatatatggcaggcatttttcataaattgaatgagcttaatctgcagctctaagattttgaataaaaacattatgtaaattacatcataaaagtattttaccacaaaaaatgcattggtaaaagtgtattgaaattaagaatattttttattcctccaaacctttctgaattatgaggttaaatacagtttctttaagtgaaagagaaacagctataattaatagtcatttgtaagtctggaaatgattgcccagcaattgagaaagtggatgaatctgatgactcggcaacaattttcttttttacccccctttacagattaggagattcttacttttttgtttaaaaaactgaaggaaaaccagtagaatttttcaatagtcattaaaataattttaagagccattttattttaggaaggcattcagagaattgaatgacactgctatgacaaaattcctttcattcccatctacttatttatgtaaataaagttttttagtggttacatatataaaaattaaaaatgaaatagaattgatgatgaaactctctcattctagtagcagtaacattcattcatgtgaacataacctaaatggaaaaaactagcttcattcatctcattgagagaaatgtttccaatagcatcaatttttatgtttaataattacttatttaatgtgtaatgtatttatactcttttgattaattatatatactaataattgtaataataacaatatataggtaaattctagaacttgaggatttttatgatcacagaaaatatcaaacaattaaaatttcattttataaactttttttggcaatgaaatatattagggctaacaatacaaatatttgagcataaaatacatacttatgaggacataatttatggtagatatgaaatggaaatataaactcaaggaggaaatataaacattataccatttctaactgttaaggaggactttgtgtacttttaaaagtgaacaattaaggataataaatcaccatggtagctagattccattggatacatttaaaagaatgatggggctattatattttgaaatctcaatgcaacatttacaatatgctagaaattacatcctttttattttatttattctattaaaatttataataaaaaatgtagttgtccacttaaagatatgcaactgggtccatgttctcttcaaatccaaccaggtcagattgccaaatccagattctcattgccttggaaatctgttgtctgcagccatttctggtgcccaaaccagaactgatccgggtttgggtgcatgcaagagatccacattaggtagtgtcaccagcaagggacttgaagcaggggatttggtgctcccaaaattgtttgaaaggtcaagagaaaatactctagactgagcatccagttgtttctgcagagccactttatcctgttgcagcaactgatagatcagaaaactcctaacactgtcacttattgaatgagcatctaacctgacatgaccaggaaagctatactactgctctaaaattatgccacttctaccacaatccccaccagcaaaagagactccccacacccttccttttctttccatgtctctgggttgcacaaattcacctaattggtggagcctaaacatagctggaactctaactctaaggtggtgcagaaattattgtttctagcttttcagcatttatgtaatgggaagggttgtaatggaggcaagtgaaccaccatactatcttccataagtaaggactttcttatgcatagaagaaaaggggactcctgatatgttattcaggggattccagatgggatcagggaattcccaaatctgtctgctgcttgtcacactgcctgtcagcccataatggagcactattattgatgctttccataagccccttattaacatgtaaacattcctataagattgaacagataaaggtctaatccattattaacacctacacaaatgtcagttaccagttgattgagagagaggtatgtggtggggagtggggaagaaccctagaagatggtaggatgtctaagtaggaggcaaaagactatcaaaggcaaattgctcacctacacaaatgagctcctggacatttctgacttcttttcgaacagaaaggccagttgtgctgtgacaaggatgtacataacagagaggcaagatagcaagcacaacgaaagtttctcctgtctcccagcaagccctggctctccagctctctcccagcaaacaaatgcaaggcagaattcagaatacaaatgtcttctgatgtatccttctccaagggcaggaggactgtagagattcacatatcgattgggagcataataatgcaataaaaaattcaaagacaagccaatttctcagtgtttgcaaggactggcaagtccagcaaggttattgatgaagaaattaagcagaatgcaacgcagcctgctccagcctcaactctctcataaaaaaatctacaccagaagcatttctcacatgacgtcagcatgctccagtaaaggtgtacactcctggtggtttttgctagacggatactgattgcattccaagggatgctgtggtgacaaggaacacgaagtctaggttctggtctaaaatctgacactacattgctgtgttacctaaaacaagtcacttgacaactctgggtttccgtttcttcattggtaaggcagaaataataatattaatcttgcttgcctcctaaagaaaatggccttaactcgaggtccaaggataagtttcaggcattgttggagccccctgaaattatagacaaacttttacatttagatggatatactgaagataatttcccacataattctaaactggataatcatatgcaggaggaaaaggggtccatggctcttttaaaaaagttaacaactaatggccaagagaatcaatggaaataagttaatcggtgagaactgctccacaaactcttgaagaaaataagaatatttcattcaagtttacaaataatagccaagacccacttgccttattagtacagtatgtaccatctcccttctgggtttttctgtcctatttgtgtcccaaatttgcagtttttacttgctaagatttttcagttcatatatacaaccacctctcagatcaccaaatgattttaagaatccagactgggttatcccactttatgggcccctcacagttccaaggatccacaccactggtcaggcaagtttccttttagaccttaaagtccattttcactcccttttcttggttattctaactaatcacctgcaactctaagggaggctactcttatgacactagagaactctaaactggtctttggaggaagcttacgcttgatgtaatttctctttgctgttagatctgacataattacataattgaagctgcctctcccttctaaaccagaccaattatgatttctttatttgcaataagatgcaatttagggcatcaagaaagggaattatccaagaatctcatcttccctttaccctcagttagacgcagagttcatgcagtctctggatgctgctcatgattctttcggccctgtctaggcgtggatggattcactcggtcaccgaggtcgcctttctactctggtgattataaacaggaaatgatagcagaattactcataagctttagccaaagctttgttgggcttaggctgctgttccagcaaattcaatgtatgtcttgaccctttggtaagactatttctgggataaaactttttggctcatggcaaaatttgctcaacatttactccttgaccaagtcaatgtacgcctctatccaggataattgccattaaaatagacatttcatttatttggaacacagagacaagtctctacctaaatgaattttggatatatacctctcaacaagagacctagaaaggttcttaagcaaagactatattattaagtatattgaaatttatacagcagtgtaaacatactgatatcagtgagcttggttagcttctaaagagccaaagccacaattagccaataacagcagagaaaataaatatatgtcaacttccaggaagtttagtactcatgtgaagattctttctatgacccctcttttaatcccctttctggtttgtagcctgctttagtgattttaaggtgagttcatgtcacacctcttatcagttattttacgtatatatacaacacacacatactatatatacatgtaaaatagataaaaactttatgtgtgtgtatgtttgtgtgtgatccttggaaataaactttttatctttttaggtacccatagaatatttataaaataactctatattagaacagttgattcaaataagacacaattagagctgtaatcaaataccattctctgatactaatgcaatacatctagaaatgtacaataaaataaaaaatttaatttttttcatttaaataattctgaactaaaaaagaaaatttcagaactgacaattgtgtagaatatgaagatatatgataacatatgagacatagctaaagcagtgttcagaggaaacttttagccttcaatatattaataattgagatcaaatgaaaataaataaaggtcccagtcacaagtattgaaaaatatcaaaataaacctaaacattacatattgaaagaaaaatttaatataaaacagaaacataaatttaaaatagaaaaacaaaaaataataaaattaataaattactttattaactaattgtttgaaaaaatgcgaaattaaataaactgtcagctatcttagtccaaaaaagtgggggtaggcacaaatatggaaacaaatcacagtatgaaacggtcactgtaaagaggcagcccaatgcactatatttccaagcagtaccatctttgtatctaggggtaaccacatgactaattctagccaatggcacatgagcagaagcgatatgtgtgtgtaaaaggatttgcaccagcaattcacaaaaaagaagtgcaaatggttttaaaacaattgaaacaacgcctaatctcacttaatataaatgttaatttaaactactacaacaaaatgtactacttttcaccacccacattgtcagatatcaaaacatttgacaattgtaagaataattactagtaattatagaacatgtactatgtgcccggcactgatgcaaatacttaacacatctttagtgctcacagtaactccatgaggtgaatctcattattacccccttttacagatgaaggaactaaagtacagataatttagtaacttgcctatgggctcatatgatattggcaagtgtgtggaaaatggtcattttcatgcactgcagtggaaatgcacattgcaaaaggcaacttggctatatctactgaaattacaaatgtgtatattttcgacccagcaattctgttatgaggaccataccttacagatctacttactgattgggcaatgttcagtgtacaagacattaactgcaatgttgtttttagaagaaaagccttcaaataagaacattgagaagagttgggatggctactcagggctgcagctggtataaagctgtctctgttctatggctggaggacacagaggagagcacacagcaacacctgcactgcagtatctcctgctaatatcatacttcataatgagaaaccacatactttctccttaagatggaaaacaaagaaaggatgtcttctctcatcagtcctattcagcatgtactaaaagtcctactttgtgcaaaaaaaaaaaaaaaaagtaacaaaatgtatacagattgggaaagaagaaataaaatggtctttgaaaaaaacacctataatcaggagctttttgttgattcccaaaaaaccaacaaaaaaaattattgattacagcaaagtcacagcatacaaagttaatatataaaaatcaattaccttcctgtacaccagcaatgaaccaattgaaatttaatattaaaaatgcaatatcacaataccaccctaaaaatgaaatacttaggtaaatatgtgtataatctatttgcagaaaactataaaactctgatgaaagaaatacaagatctaactaaatggagagatattccatgttcatggattggaagattcaatatagttaagatgtcaattcttgataacacctgacttgatctatagatccaatacagtcccaatcaaaattccagcaacttatttggtatatattgtcagactaattctacagtttatagagaaagacaaaagacccagaatagacaccatgatactaaagaagaacaaagttggaagactgacactaccagaattcaaaacttactataaatccacagtaatcaagacagcgtggtattggttaaagaacagacccatagatcaatggaacaaaatagagacccctaaaatagattcacacaaatttagtcaactaatctttgaaaaaggagcaaaggcaattcaatggaaaaaggataattttttcaacaaattgttttgcaacaattgaacttctaaatggaaaaaacaaaaaaagtctaagcactgattataccttttacaacaattaacccaaaatgaatgatagaactaaatatgaaatgtaatactttaaaacatctagaagaaaacataggacaaaaatctatgtggccttgagtttgctaatgagtttttagactcactaaaagcataattcattgaaagaaagagtttaaattagactttattaaaattaaaggcttttactctaaaaacgacactgtgaagagatcaaagataagccatagactggaaggacttatttttaagccatatacctaatatgggatttgtatccaaaatacattaaaaactcttaaaattcaacagtaagaaaacaatcccatatttaaaatgggcaaaagatctgaacagacatctcaccaaaaaagatggcaaataaacatatgaaaaggtgtttaatattatttgtcattagagaattgcaaagtaaaccaacatgaaatgacactgcgtgcctattagagtggctaaaatagaaaatattgacaatattaagtgctagtaaggttgtagagcaacatgaactctcattcattgttggtggaaatacaaaatagtaccacccctttagaagagagttttgcaggtttttctgtagagctaaacatagtcttattatacaatacaacagtcacaatcctaggcattcatccaactgatttgaaaacttatgtccacataaaagcctgtatgtgaatgtttacagcagctttactcataatcactgaaaactgaaagcaacccaaatgtccttcaataggtaaatagataaactgtggtacatcaatacaatagcaataaacaggaataaacaagccaagcaaaacatgtatggattaaaagcacattgttaagcttataaagccaattttaaaagcctacataatatatgattccatttatatgacattctggaaaaggcaaaactatagagatggtaaacaggtctgtggttaccagggttcagatgagaggaaggatttgaataggtggagctcagggaattattttgggagtgactattatgtatgatgctgtaatgacagataaatagaacttgatacaaagagtgaacattaatatacacaaattaaaagaaaattacttaagaggttgggagatcccatgatgaaatgcagactatgaggaaaaaaagtctaattgtattacaaatgtgtgaaatacccttattgaagggtgcgtttgggcagggggagatgctgacctaagtaaccttggaaatgagtggagactgtaagactaaaggcaaaagggattctatataagcatggtactgtagtcgataaagttgtttcccaaggggttatgggttcacaattctgatactggttgacatgtatactggtactgaaccattaagtaattagagggtggatattgggagtcagatttcttcctgttagtgtaggagattgctgacatataaaggaggaagaatagaatgattcatgtggtgttaaagttggcaaaatgagcaaaaagccacattaagtcaaagggacacaggagccaactgaagggctcccaatggctggaatatttttagcttcttttttaaaattaaactctttgttttgagaaaacggtaggttcagatgcagttctaagaaataaggcagagtgatcccatgggtcctttgtctgtttcccccagtgtaacatcttacaaaactatagtacaacagtacaatcagcatattgacattgacacagtcaagatacggaacatttttatcacaagtgtctttcatgttgcccttttatagccacgtctatttccctcctactcccattctctccttaattcccagctacctactaatttgttctccacttctataattttgtcatttcaagaatgctgtataaatggagtaatatagtatgtaaacttctgaggttggctttttatcgctcagcataactgtctggatattaatccaggttgctggatgtatcagttgccatccctttttatcactgagtagtattacatggtatggatgcactacagcttgtttaatcctcatcattgaaggacatctgagttgttttcagtttggagttgctataaccatttatgtacaggttttcatgtaaaccaaagtcttcatttctccgggataaatgcccagaattgaaattgctgggttatatgacagctgcatgtttagtttttaaataaattgtcaagttatttcccacagcagctgtattattttatattcccaccagcaaaatatgagtcatccagttctctgcatcctcaagctagaacaatttgagcaacaaattcaccccaaactgtaaccagagagtccaagagctgattgtggtagtcgatactggtgggcctcccagagcaaagagcaaggtggaaaaggatagtaggtatccaagtagcacacaaaaaatatccagcacagagaagttgtgtcaatcacctgaaatgttcatcacaatccactgcatccctggacatcagacatggcttttaacttcaagaagtttacagtttcaggttagggataagatatatgcgtgaatataaccatcatcaaggcaggaggtaatcagagtcacaagagaaccccatgaatcaaaaagtggcagattagaggagacatcatgatgaacatatcagatgaatcaaaccttgaagaatcactagactctgccttgcctatcaggaagggaacacattcacatacttatggttagcttacaagaataattccctaaatctgctttgcatgtatggtttataaatattttcacactcatatcttatttgatcaccattttatgtagatagtgtgtatcagtcagatattgatatataacaaaccacctgaatgcaattcttatgctaacgacccagagttacatcaaatttcacagataaagagcatagtcttccaaaagactacttcacttcagacaccatcagcaaactccagggttcccagaccattcacacttctgatcaactggctacaaattcagggattccccctaccctctcaagtgcaagaatttgctagaataactcataaaactcaggaaaacactatacttataactataattttattataaacaatacaattttgggaccagccaaaggaagagactgatagggtaaggtctggaagggttccaaccatgtaacttctgtgtcctcaagatgttactctcctgtcacattgatgtgtatcaccagccagggaagctcaccagacctttggtgtccagagttttcctcggaatttcattacataggcataattgattgactcattggccacatgattaaacttgatttccagaccctctcttttatcagaagatcaggcagatatcaccaaagctccaaccctttgattacatgcttggtctttctggtatgaccagaccccatcctgagtcatctcattagcataaatttacctgggatccaagggacccaccatgaataacaaagacactcctatcactcaggaaattccaaaaatttagagattctctcccagaaatgggaaataaactagctaaattttcagttataaaacgtcacttcaatactcagtagtttaaaacaggagttatttattctcacacacctatagcttagctgatctaggataagcatgactgggcccagcttcaagctatggtagggtccaggtcaactctatatgtctcttacctttgaaccaggagatgagataggacctattcatagaagaatcaaaagaggacaagcccaaagcttcaagcacagtacaagcctctgcttgcatcatgttcactaacatcccactggcccataaagttatctagcttaactcaacatcaaaggaggtggggaagtatgttccacttataattggaggtgcaaaggggcaaatatttcctgaaaaataatctgaactatcatataagagaaatattatgtactcttttagcccctttgtggcagaagctgtgtgctaaagatgatttctaaatatccaggaccaccatactatgcccctaaccactggctgtttatatcttaagtgtcctccatagactagtatcccttgggcttgaggctttgatgaaaccaaaatgggtcatatattagtctgttaccaagtcttcacaaataaatgtttaccaaagtaattaaactctcagcttatcagcaaataaaaaacagccatcattggaaaaaagagcccactgatcttcaacttgtggtctctctttgactttctcccttccttttttcactctccttttcacagtttgcccttaaaatccttctgctctcttgatctccagacatgaatcatgctatgtaatatgaatgataatgagtgatggtaataattgaaaagatgaaaaatctgcatttgtttcttatctagaaagataccaaaacagctgccagggagtgttcagagactctacagcccattccataatttatgaatgtgagaatgctccccatgaacagcctggatgagtcagatgttttaattgggctgccttaaatttagaaccaaaggagcttgattcctactccactgggtagtctcatgaagggtgttccagccagagaggagccagagttgacacttacatacacaagtgggtagaataaagtacaaatgttgttaatgtttgtaagacactacattctggttttgttctttgattttaaggttgaagaattttcagagaagccttattagggaagacttctcttttatatgaaagttacctcattgtgtcctctcctaggcaacaataacttgagtgtgaaaatcagctgggatcccacattgctaagcatttctgaaaagggatctttaatgtggcactccgtaaaagagttaaaagatttgttgaaaaatgaccacatccatgctctgtgaaaaagaaatataggcaatttatgaattttatattcatgacataatgtataacaggtttattcacattgattcattaagtaagtgtggagtgaggcatgtgtctggtactgtccttggtgctgatgccagcgacacgagcaagaagagtttgtgtctcacggaactacagcctagtggaggagacagacattactcaagtgtaactggatattaaaattgaagtttcaaataaggtatcataatacattccaaaatgagttgtcagatcaacatttgagttttaaaagtttctgacaagccccttccctaaaggagaccaaaaaatgggcattgaatagttggagaaaaggagaggatttgaaaggaggatttcttacaagcgagcattgtcataagcttccccacaataaggaaggatgaaggtgcttttctcttcatccaagccccaaaaatgagacctttaatgtgaccacttggagatctgatgtgtattcctgcaattatagggaacagtaatgtatttcacaggtctgaggactctaaaggtagcctaagctagaagagggagggaaaagagagaattgtgctatttttgaaactaattgctctccctttcaaaaatatgtcaaatgtacaagaattcaaggcatacaaatttcatgtgtatcaattatctattgcacaaaaatgctgcataaaaaacagccacaaaacttctgtggtgtagaacataaaggatttattttgatcaaaagtttattggccacctaggatgttcttcttgtctttgctgggattggctgatcttggctgatcttggctgggtttgctcccgcatctacagtcagctggcgggtttgctgtaggctggatagtccagaatggccccagttaaacaactcatctttcttccgtatggtcttattctttagcaggttagcatgggcttctttatgggagtcagatccagtttccaagagaaactgtgaagaaattgcaagcaccatgaacagactattggtggaaatcttgactttaagaatgttgatggtgagtgctgaatagaaagtgagaaacatgttactgaaaatgggagaaagggagatccctgttatgtactggcaaatgcttatcaaaattgtattctgtagtcatgtagaaaacataacatgtaagtgataaatttggacgtgtagctaaggaaattcccaagcaaagtgttgaaggtgttacctggcttctttgtattccttatagcaaaatacaagatcagatagataaattgagggaagaactattaaacaaaaaggaattggaaagactttggaaattctcagcctctccagatgtcaaaagatgctaaaagtccaaaatggttgctgaaagtgtgaagtagagaaaagtctgagtttgtgactgtatgaccctttgctgaaacctcagatctcatctaaatatttctagttgagaaggacaatatcaaaaggtcaaagtactcgactacacagtaactttccaagcgataaagagtgttcttcacagatattctcaatcaaaccaaagggcctcaagaagtttaaaatcattgtccttcatccatctcagcagaagccaaaattacattatcttgaaaatatttgtgatgtggctcaagcataatggaataaacccttaagacatccacaagagattcacaaagttcttgagaacattatatcagcagaaacactaccaacttgattgaagtggacagagacaatgcaacacaaaggaaggctttcaaacctccaaatttccactggttcaaagcaggctgataaaactactatgcttcaaccacttgctatcttttatgaaaaatgaatcacttatagggcagaaccaagaaccagaatgcagagccaagggcccacagagcaaagccaagagccatggaggattattcccagggcttgaaacctaaacaaggaattttggctaaggttttcctggctaaatttcaaagctgctttgtaccagtgacttcatttttgccttccattccccatctaccaacccttttgaaccagaatgtccataactattaatctacgcatggtcttgccatcatatgttgagacagttgggagcagatgacttgtccctttagtttcacaggtccacagatggaggagaattgtaacccatgaatttgcatactccatgaaatttcataaatcatcatcatttgatttaaattttgagaatttagactttgaccaaatgagatttatttttttattgtggcaagaatccttaacatgagatccaccctcttaaatgtttaagtacacaactcaatattgctaatgatagacatgatgttgtacagcagatttctaaaatgtattcatccaaagaagacatacaaatggccaagaggtatataaaaaatgctcagtatcactaatcatcagaaatgtgcaaatcaaaaccacaatgagatatcatctctcacttgttgggatggttgttataaaaacaacaacagaccaggcgctgtggctcatgcctgtaatcccagcactttgggaggctgaggtgggtggatcacctgaggtcaggagttcaagaccagcctggccaacatggtgaaaccccatctctactaaaaataaaaaaattagccaggtgcggtggcatgcacctgtaatcccagctactcaggaggctgagacaggaggatcacttgaacctgagaggtggaggtcacagtgagccaagatggggccactgcactccagcctgggtgacagagtgagtctccatctccttatagagagagaaaaaaaaacgacaaaatgtggagaagttgtaaccattatacactgttggtgggaatgtaaaatggtgcagctgcagccactgtggaaaacaataggtaggttcctcaaaaaattaaaaatataaatactatgttatctagcaatcccactccttctgggtatttattcaaaataatgtatatcaatatcttcttcaagagatatctacacttacacgtttattgcagcattattaatattgtagccaagatgtggaaagaatctaagtgtctatcaatggataaagaaaatgtagtacacaaatatacatggcatattattcagcctttaaaaaataacaaaattcagccatttgcgacaacatgggtgaatctggaagacattacactaagtgaaataagccagccataggacaaatactgaatgattccacttacatgaagtgtctgaaatagtcaaactcacagaaagagagtagaatagtggtcatctggggccagagaggagaggaatatagaaagttgctgagctaatttggatgtaatttttaatttgagttgatgctgcagtggattgagactcctgaagaccttgggaaagagtaagtgaatttagcacatggaagagatgtgaatttgggggaccagaggtggactgtggtagatagaatcctgaaataaccccctaagatatttcatcctattatccttggtattgtgactatgatgagatagcatacccataattatgtaataatacatagccaaagggattttttgatgtaattcggttactgattagttgactttgagtaataacaaaagagattatatgggtgagcctaatataatcatatgaacactaaaagcagagagttttcttcagctggtagcaaaagaggaagtcagtttcaaagcatgagaacttgacacacaactgctgatgtgaagatggaggtcacatgacaaggaatacagcggtctctggaagcagagaacagctcctggctgataaccattaaggaaacaaggacctcagtcctacaactgcaaggaattaaatttgtctaaaaaaacaaataagcttggaataagcttcttccccagataacagcccagcctggctgacaccttaactctagctttgtgagtcccaaagcagatgaacaagccaagcccacacttctgacctaaagaagtgtgagataataaatggctcctgttttaagccactatgtgtgtggcaatttgttacacagcaataagaaaccaggacagcctctgaaggcctaggctcagaactgacacactgtcatttctggagtattttactggtcaaacaagtcagaaggccaggccagattcaaaaggtgggaagatagaactcaccccaggaacattgcaaagggcttagattcatgtaggtaaaaacagctggggacagcctgccacacaaaataggaatgttgacttggggttattttgaaaggaaacctgcttaataagagagtttctgccagagagtaaggagaccctaccagtggggtgaaaagctgggaaaccagaagccaagggagtggtgggagaaaacagttaaaggagggtcatgagatgggtccacctgctgcaaatatccaccaggcccagagaggccaaagccatttgacagtagtgccagtaccagtagaactttttggtcttcccccgctacatggtcatatccaaaagggtgggctaatccctggacaggcccactgagcttaggctctcctaggtctttaattcatttgcttgtttatggattggtcatttttatataagagcaattgaactgggcttgtttgatttttgccaatattgtgtaacccagatggcaccagtgacatagtaaaacattgtgcccagaacttggaaattacagctaggtggtttaggttgctagatgcagtttttcaaccatatcagataaagtggaagttctgctggagtttgagggtggcatgattgaagcatgaggggcttgctaaaccccacccccttgacttctgcttctcccacagtctggcagtactctgaactggaggagaagagcaccgtaccaacaaagtgcatttctcaagaattcacaagcccaaataaacacatcagggactatccttcagtctaatgtttcctgttgataacataggcctagagaaaactgttacttcgataatattcgtgtgtcagagctctgtatttgccaagtctttatcaccttcctctgtaggacaacatcaaaggatcagaaacagcttctacctactagagaaggtgagctgttccctgaaaatacgtcacaaatcatgcttattcagcccaacagttacatgtttgataggtatgaactcctctgcacactcaaggtagaagttttttatttcttaaactggttggaaccagctcccctaaactggtagagagactagtaccacattttggaggcttcactgacatcactcattaaagaacccttgagcttacacagtgcaaaatggcagaaccatcgaattccacttcaggctggaagagctctgtctggtgtctgttgaactgatgttatctttactgccattggtttgtgctgcctgtattaggctgctcttgcgttactataaagaaatacctgaggctgggtaatttataaagaaaagagatttaattggctcacagttctgcaggctgaacaagcattgtgccagcatctggttggcttctagggaagcctcagtgagcttttacttatggcagaaggtggagccggagaagtacctcacatggccagaggaggagcaagagagagagtggagggggtagggtatatatttttacacaaccagatctcacaagaactcactcactcactcaccaagccataagggatctgcttccatgacccatatacttactaccaggccccatcttcaacaatggggattacatcaacatgggatttgggaggtgggacatccaaactatgtcactgccacgtgctggtcctccaccacatattcagtgcactgctcagctatagaagcaactgcagccatcagtggtaagctcagcaacagatgcactttactgagacttccaggccactgctaccattttccatccctcacagacacccacagagcattctccagaactttgccatctcagaggtgatggctatgctagagtgcattaggcatctgcctttcaaagaatctacttccaagtcttgatttcagccccatgcacatacacttgtaggttgggctattttattttctaactctccaaattcaaaggttaattccccctctcagtcaactcaataagattcattgccctgataagccaagaacgggatcttaaacttgaaaataaaaatgtttgaacctccttttaaagaaaaaaaatttcccagacttccaggattcaattatggaatctacacaaaagacatgctataaactgtcagccattcggctgaaatgaaattattgctcccactacgattgtaatgaagactgccacaagatctttttaaatttagcataaccttgctttgcaatcaaattcttctaccactttgctccattgttgagcaaactgccaccacgcagtgcaccagaatactcaccagcttacccctgctgtgaaggatcacttataaattaaatccacctcattctttagttggcctgataccagcaggatcataaacacaatgaataaggacattgaaaaatcacaaggcaggactcagttatcttaaaaatccataaaatgtttgcattaatatatttagctactgtctaaatgaaaacctccaaatttttcatttccaaagaatcgtatatatcacagaaattatcatagttaaatctttagcagttacctccattctatgtttgataattttctctttttttgatggagtctcactctgtcacccaggctggagtgcaatggcgcaatctctgctcactgcaacctccgcctcccgggttcaagtgattctcctgcctcagccccctgagtagctgggattacagccacacactaccacacctgactaacttttgtattgatcattttctaataatatcaagaaagggaagtacaggatgtgctatgatgtgttcttactgtgcagcagccacccaacttcagtggtatataatgataagcagtcattttgctcacacatctgcaggttggctgggttttacctgatctaggttggactcaattgggtgtctctaagcagcaggttggatccagttctgctccatgtctattttatcctctttggaccagtggaccagccatggcatgttctcatgaaaatggcagaagcaaaaaggaacaagaagaggcatattaggcttcttaaatccttttgggaaccagcatcctgccacttccactggccaaaagcaagccgcatagtcaaatccaaagctaatgggctgggatgcacatttcaccttaaaggcaagagttgtgaagtcacatggtgtgttagtccatttggattactataaagtaatacctaagactgggtaatttataatggaaaatggtttatttggctcatagttctgtaggctgtacagaaagtgtaccacctgcatctgctcagcttctggtgagggcctcaggaagtttacaatcatggtggaaggcaaaaggagagcctgtgtatcatatggccagagggagcaagagagaggggagaagccagtctcctttaaacaagcagctcttgcatgaactcaccaagcaagaactcactcattaacatgaggaaggcatcaagccattcatgaaggatccatctccatgacccaaacacctcccaccaggccccacctccaacactgggaatgacatttcagtgtaagatgtggagggaacgaacatccaaaccacgtcacatggcaatgggtcaggatacagggaagggtgaagagctgagacggacaattccatctgccacctatgaccagggaacttcatctattctggggtggcaagaaagcctttcctgaggaaatgaaattttggctgaaaagtgggaggcgggcagggagcaagggttaccatgtaaagtagaaggaatagcattcttccatagggaatagcatctgccacagtcttgaggcaagaggaccatggcacattaaaaaagggtggcaaggatgatgagaaacaaggcacaggagaggaagcaggaaggcagtcaggagcccgagggggtggggccttacaggccatgccagtggcttttgacctttatgggcatagggaaatcattgagaagttttaaccagagaagtgaaattttgcatttgaaaactattttcagctttatacagcagaaacatcaactcagaatggcttagacaataagaaaatgtattacatgactaacacaaaattggagcccctccaagtcggtaattcagtaactctgaaacaacgcaagggacaaagcattccccagttgcatgtcatcatttacaatagatcagctctgtcctctccttaattcttttaagtcccaagatgaatacataggttccagacgtcacatgcagaaatgacagtgtccaggtgaagaaatgatcctcttctccctccttttcaggattaacaaaaaactttcccagaaacctccaggggaagtgacatctcattggtcaaaactaggttacaagcccacccttgaaccaatcccaagtaagaagaatgagactgccatgactgacttggaccaatcaagacctatcagctagagtcgttacgtaacaaagacaaaactgtgagggggaacggcttctttcagcaaaactgtgatgtccactaggaaagagggacttggcacatggccaagcccagaattaagggtagaaaaatacaccccaacttcagtgggaaggaatgcagagctacatagcaaagagtgaatacagggaggggtaaacatttggacccattaattcaatatgccaccatacttctaaacattcccatcgactggacacacatacacacacacccccacacacacggcaaaattatcccattctgtggcattgaacacatagcaaattgtgtatatttctcacatgaaacatgattgcataccaccttgtctttattattgcattagtctctactgctactataaaaagttatcacaaaccaagcgtcttaaaaaacatatatttattatccaacaattctgcatgtcagaagtctgacatgggtctcactaaggtaaaatcaacgcgccagcaggactgtgttcctttttggatcctctagagcaaaatccatttccttgcttattctgattgttcaaagccaggttgagctcctctcacattttgtatttttccttccttttttctggttctcacatctctccaatcttgtgtgccttcctcttctttttttttttttttgtttttgtttttgtttttgttttgttttgttttgagacggagcctgtagcccaggctggatgcagtggcgtaatcttggctcaccgcaacctctgcctctcgggttcaagcaattctgcctgcctcagcctcccaagtacaagtagctgggattacaggcgcatgccaccacacccggctaatttttttttttttttttttttttttttttttttttttttttttttttttttttttttagtagagacggggttttgtcatgttggccaggccagtcttgaactcctgacctcaggtgatctgcccacctcagcctcccaaagtgctgggattatagccacctcgcccggcccctcttcacttttaagaacccatataatgacatcaggctcacctcggttattgaaaataatctccctgtttcagagtctcttgccttaattccttttgttttgtaacccagcatttcacagctttcacggattaggatgtgcacatctttgggggccattattgtacttacttcaaatttattaagcaactattaaatgattattcagcttcgagtgtgtctctccgagtcttttgagagcactgtgagtttagagactgagtgtaaatgttcctgtgctctccacctaaccactcagtaacaatgtggaaaaaaatgaacctggtatacaggaaagctctaatatcatttaaaagggagagttttatctaagtggtctattcctaacacaagagataaatcctactgtttaacacgtgacatggttctgtcttttacctggataactgtaccagcaatagcccaaaaggtatctgtggtagaagatactacactaaggaggaacacaaaaacatgaacattttatttgctgtcccctgtaagtacttacaaaacattttggcagagaccaaggggaaaatataacatcttaatgaaaaaggctcagtgggaacccctgaaatctatcaatgccacctagggggatttataacagagggtgaaaaaggctctaggccagtttctgggatgctagcatatatttgctttgtggtgaatgagctaatgcagggtttccaagtgcgccaaacagatgacgcacacactgtgagcttacttaccatgtcctcaggggactttgtccaagaattctccaagtctccttcacctagacgtctaaatctgctgggaaagaggggagaaccaagtgacagatggagagaaactccaggatagcacaaagcaaaggatgcagagtcagaaatacacccacggagagagggagcagaggaagaaaacgacagggaggcactgagacctcgagaggtggggaggggaagggaaaacctcatcaacacaggaaacagaaataagtaacccctaatctgctcagtcatcggttctggtaaagcccctttaaatgctgagaatcattttaaaggaaggtaaaagctgctacggttcatggagtacttagtcattccatttgaaacattttaaggagagtaatcaaaagccactgcagtgggagatacaagaattgggttcctgctccaggtcagccatagagtatgtgtgcagtcctgacagtttgcatcccaaggctcggtctcctcatctttatatgatagagggattggcccgggtcagggtccccaacttgtgatctacagccccagaattgagggaattggtaaaatttgcatagaaaaaaattttatttttgtcagcatccaactgaaattcaacatgtccttcaatgatgaatgtaggcaattagtattaataccatccatgactgtcgccaatagaaatcacagacgttttatgtcacattaaggattctgcaaatattttataatatcttttattctcattactacttaaaaactgaagattggctgggtacagtggctcgtgcctgtaatcccagcactttggaaggcaggaggactgtttgagtccaggagttcgagaccagcctaggcaacatagggagagcgtgtctctataaaaaaaatttttttaaatacaaaaatttcaaaaactgaagtttttaaacctgtgtctagatcttatttttaatgtgcattcatgaaacacatatatgactatattacaaatttattttctcttaacattttaataaatagagtttagtcaattttctttgcaattcaatgtattttattctgtttatttagtgataattttctggcacaaacatacacaaacacagagttaacaaaataaatattggactaggctgggcatggtggctcatgcctgtaatcccagcactttgggacgtcgaggcggacggatcacctgaggtcaggagttcaagaccagcctgaccaacatggtgaaagcctgtctctactaaaaatacaaaagtgagccgggcgtagtggtggatgcctataatcccagctacttgggaggctggggcaggagaatcgcttgaacccgggaggcagaggttgcagtgagctaagattgcaccactgcactccagcctcggtaacagagcaagactctgtttcaaaacaaaacaaacaaacaaaaagaaatcttggactagatgtcctctaacatcccttgaatcctgtgaattgattgacagtacaaatgtttgcagatgtcctacatatcaagccctgaagaggttaataatttgcccagcatcttacaggtagcacagagcagagacagaactggaactcaggtctcccccacagaatgtgggcacttaattacatgctacactgagaggtaagtcctctcaaccacttttttctcccaccaccacgtctaaccatctacctgcatcttaccacctgctactatagaaaaattgcctaaaatcaggtcaacttcttcactggtaaatcaagttgcatcttctcttacctacagaagaacatccctctggaaattctcctctctctctcctacatcaacttttccctcattactaaattctacccatcaacccacaaatatactattctttgtcccatctcaaaaaaaatcaatattagttatattgctgcataacaaattatcccccaaagtagcagcttaaaaccagcaaatgtttattctctcacagaatttataaagctcaggatgctgggagtggcttatcctggtggttctgatgcagggccctccatgtagtcatctcaagactcagctggggctggagaatctgcactaggctccctcacctggttactggcaggcctcggctcctcatgggttgttggctagaggcttcagtttctcatcatgtggacctacccatagggctactcaaaatatgacatattttctcacagaatgaaagatccaagagagcagaaaagcaaaagagcatctaaaatggaagctgccatcttttataacctaacttttgaagtgatataccacgacttctgtcatatgctattggccacatgcaccaacccaggtacaacacgagaggggactacacaagggtgttgatagggtttggctgtgtccccactcaaattccatcttgaattcccatgtgttgtaggaaggacctggtgggaggtaattgaatcatgggggcaggtctttcccatgctgttcttgtgatagtgaataattctcatgagacccgatggtattataagggggagtttccctgcccaatctctctctttgcctgctgccatccacgtaagacatgacttgctcctccttgccttctgccatgattgtgaggcctcctcagccatatggaactgtaagtcattaaacctctttctttggtaaattgctcagtcttgtgtacgtctttatcagcagcatgaaaatggactaatacaggtgtgaaaacaaggaggtggggatcactgggagccgtcttggaggctgattgccacaaatcctttccttgcacctacattcttctccatatttctctactccctttagagcaaaactccttaaaaagttgtctatgtcactgtctgtaatttttcttcctccattctcacttgaatcccttctattcagacatttgtctctcatgttctactcttgtcaaggtcactcaggacttccacatggccaaatccattggtcagttctcagtcctcatttcatttgacccattactagcacgtaacacaactgatcactcccttttccttgaaataccttctgcattagacctccgggatatgacattcttctgattctactcctgcctcaccggctgcttaccaggcatttcacagatacgtcaaggcgtggagggggaaatacttagcagtcacagcaaaaactaaataaaccttaaaatgagctcaacaacgatcaatttcagaaaaacattaaaatttgtaaaagagagaaaacattattaaagtttattatttggtcaaacaatgaataatgtctgaacaggcagaatactctctgaacagtttgatcgattttttgcataactatattgagaagattgaataaggaaatttggaagggaaggttgtgcaagaaagatgggatataattttgtaaaatcttaaaagtgatatacacatattatttagaaacatggaagttcttgccagaagcaacagttaaaaagttgaaagtggttacctcacccgtatgctaggtaaattggacaaaccatcacactgaaagttactagaaaatctggagaagaattaactgatgaaaggcattggcgagctaacaaactagtgaagaattgtggagtcaaaatacaggagaaaaaaaaactgagttttttctctggagaggagtgccaattctggaaaaggtgactgagagacatttaaactgtgttttcagctccaaggaattgaaaagacaacaattgaagttcaaatcccaataagcggtgaaactccaactttggttagaaccttaaaaggctataccttaagagaaaaggccagctagaagtaaacccaccctccctcttacagactaaacttagctgtaaatcatctcaatccctaaaattaaactaacgtgatctcagattactggggtcctcattcctttgccagaaaatattataaatccctcagaatgaaggtaacattatcctagtcctcaaattatttctgtaatttttcatgaacaaggacaggctgtcaataaaaaaataaccatctaaatgagggaacataacaacgtgaatgaaaaaccacagacagtagaaacatacccaaagaagttctagataacaaagatttcagatacacatttctaaataactacacttgggatatacaaggagagaaaatgtcataaattttgtcagagagttaaaaactacgaagaaatggaaattttagaaatgagaagcaaagtaactggtattcagaactcaatgcacatagatttaactgcagattagactcaaacaataaaaaatgagggaactgcatagaagtcataaagaaaaaaattcagaataaatcatagagagacaaaggaatgaaatagaggagtgggtgtaaaagatgtaagatatacaatgagaaggtttaacctacgtgtattggaagagaagagagaggacacagaaatagctgaagagatgatagctgacaattttcaaaactgatgaaagacattaagtctcagattcaagagtatctacaaaccccaagcagaataaacaaaaatgagcccacacatattaaagcacattgtagtaaaattgatacaaaccaaagagaaaataacagattaccttgaaaggagcaacaattagactgatatctcactgttgaacagaaataatggaaagcaaaacaaagtggcatctttaagtactaaaagaaaataacttccaatatagaatactatatctagtgaaaatattcaaggatgaagctgaagcgaagatatttacagacacaaaaaaaattgacagaatttgtcatcaactgaaatgatgaaagaaaatgctacaaattactatatcctaaaatagaaggaaatgatcccagattaaaagccagaaagtaacgaatggggaaaaattaattttaaactcttctcttttcacttaatgcctttattactagttcttatttttttgtattaaagttgttacctctaccttcttttttttcatttgtttggcatatttttctcattctcttatatttaaatttttggggtttttgtggcttttttctgataagcaatattattggatttctaatgcaatctgagagtttttatgtttaactatgggattttatcttaatttaatttatttaacactgatatttatgatttgtcttctttcatttttttctgtactttctcattaaaaccacacactaggcagtctcctcatctctgtgaaccatgaaatttgataccttcggtggtctgacacaattgccacaatcttaactcaatgtgcaataggttgaactacccaagtcccaatctaagatccaacctgaggtgacactgatgaacaaaggaatagagacggtaaagcagagttaatctactaacagattatcccaaatgtgtgcaaattagtgtatggtttaggctaagcatttaaaaatgcttctgtgaaccaaatcatgcaaaatgccaaatgtttactctcctttaatctcttaaagttgccaatttttatttctactttgaattctgttttatggtgcaagcatagtctctttttttgtacaaatatttatgatcaattttacccttcatgattttgtttctcaatatttttattcctctattagtcatctaaagtttttcaaaggcactctttaacttctatgcctctaattgccaaagtcaaaaaggaaattttattatttgagtgttgctttttgaaaccaccaatttagccacacttttgcttgtcttcctcccatctttgttaatataatctgggttttaaaagcaaatgactgttatgacatggttattttcatgttatataccttttagagaatggttttttatatttgcatttagctttataatcaaacataccataattgcttgacatctctattttaactattttttaacagtttcagtctttttctttgctatgattaccccaattttagctctttattttgtgcttttctgccaataagaacacatctttagatagacacattgattctgcatctttgaatccctgaaatttaggaagtattttgcgttattttcattcataaaatacacatgacctaccttccttccttccttctttccttccctccttccttcctgtctgcctgcctgccttccttccttccttctttccttccttccttccctcttttctttcttttttgagacagagtctggctctgttgcccagggtggagtgcagtggtgcaatctcagctcactgcaacctctacctcctgggttcaagggattcttatgcctcagcctcccgagtagtagctggcattataggtgcacaccaccatacccggctaatttttgtatttttagtagagacaaggtttcaccatgttgggcaggctggtctcgaactcctggcctgaagagatccaccctccttggcctcccaaagtgctgggattgcaggctttagccaccacaccaggcccaaattacatcatttatttctgacatttagagttgacagtgaaaatttagatcagcttgatgtttttcttcccttaaagacaactttttaaatttgggagtgagtggcctattggggtatttatttttcctttatcctaaaaattcaaaattgttggccggatgcggtggctcatgcctgtaatcccagcactttgggaggctgagacaggtggatcatgaggtcaaaagctcgagaccatcctggctaacatggtgaaaccccatctttaccaaaaatacaaaaaattagctgggcgtggtggtgggcgcctgtagtcctagctactcaggaggctgaggcaggagagtagcataaacccaggaggtagagcttgcagtgagccgagatcgtgccactgcactctagcctgggtgacagagcgagactccgtctcaaaaaaaaaaaaattcaaaattgtttacaatctacatttagttataggtcccttattgaatgattccaatctgcatgaaatatatctttcttcacatcaggaaaaatgaatccattatctccttaatagaacagaaatattagtgcataggaatgctcttcccactgtcacgtctccatttctgtatgtatcttactctttcacagctgccccctttgcttgtcattttcctccacattttcaagcttgtggtccatatcactaatttggctttaagctgtattatttaggcgtcatgctgcctctgaagtggggtttaaatctgcagttgtgtgtttagtttcctaataattcttccttatctcacttcaaagtttatctttttatcttgtaatcacagtctatttcttcgatgtggttctcattgcatagaaccaggcacttttcctggaagagtccacagtccttgctcctccatggaactttaagacatttgtactaactgctcagcaaggccaccagctgctgtaacaattcctgacgccctagacacagactctacatgaaaacaggagcctgatttaaatggaacttggaagtctttagcactacttatttcctagtttgctttgaatgtaccaagacctaatcaatagatcattcattaacaaatgtttattgaacacctgctatgtgcttggtattgaagatagtgagcaaaaaagcctgatctctccctcaagaagctttcatctttattcattattcaatactcacaaaaacaaatacacctcccaagacctactctctcacatcctctctgccaattcatttcatcagctattgctgcagcaaccaactgcacacaggtgggatgacagcaccttgcctcagctattaatatatcaagcaccgcttgtcttctgctccagcgtttctctggagcagttacagtgaaagaacaggaatccattcacccattctgatgcatatgtcaacctgaagaatgtggaagttagtaccctacttcaccgatagggtacaggagccaatgtaaatgctcctttcttttgtcccgcaggtggacatttttgaggttcattctacatggctctttggagagtccttagcaggacaagcctactgcagtgaccaactcattaacacactttcgattgactttccctcctgtcatgtctcagtctttccagtctccacctcctgttccctgggatcactcccccaaactatctaagctctgcttctggggaaccacagtctaaaatttagttacaaatagcaagtgtttttaaggaaaattatgaggtgttaagatagcttctgcaatggacttgatcttgtctggggaatcagtgaaggattctccaagaaaataacattgaggccaggtgcagtggctcacgcctgtaattccagcactttgggaggccgaggcgggcagatcacctgaagtcaggagttcaagatgcacctggccaccatggtgaaaccccatctctactaaaaatatgaaaattagcagggtgtggtggtgggcacctgtaatcccagctactcgggaggctaaggcatgagaatcgcttgaactcaggaggcggaggttgcagtgagccaagatcgtgccactgaactccagcctgggggacagagcgagactctgtctccaaacaaaaagaaaagaaaagaatattgaaacagatatttggataataagatgatacgcactggcagtagagggatgaggaggacattccagatggggaaatcagtattttcaaaacctttgggttagaaaggatgctggaacatttgagagactgtaagaaagtcagtgtcacatgcatccaaacacagaagggaaggtaggtgggaggggaggtggagaaaggccaatccatgtaggcattggcgcaggaacatgactaaggctttgttctaagagcaatgagaaacctctgaggcatttagacaagtgaattgatgtgattagggttggttttcaaaggtcacttctgctgctttgtggagaacctattgggaagaagtgatgctggatgtagggatgatgattacggagctagcacagtgatccaggcaagagatgaaggagctgagctgggtggttgcttagagatggggaaaagtggacagatttaagagatggaagaggttgatggaacttggtgatggcttgactatgaatcagatgggaagggatggtaattaattgaacatctcaaccaaaaatgatgaagttcccttaaagcttccatccttaggctaggcagggtggaaaaacaagaagtaatagacacagtctgacattcagagaggtaatgattcagtcataaaggtagaatgcatgaaatatctgaaaacctgctgctggcttcacgaaagtgtgttctgggtggatagaacatgaaataggagatcctcccagtcagagatacgagtattccacctaatgctctgtgatgatgatgacggtgatgatgccgatgatgacaataacaatgacaataatgatacaaaagttaatgttcaccaaatggtttcgatatgacaggtgtggtgctagtgaagaatgtggactccatccttagggaacagggaaatgtgtcgtgtgttaagaaatatggccatcatccttagcaaactaatacaggaacagaaaatcaaatattgcatgttctcccttataagtttgggagctaaatgatgggaacacatggagacatagagggaaacaacacacactggggcctatcggagggcggtgggtggagggtagaaggaggaagaagatcaagaaaaatcagtaatgggtactagggcttaatacctgtgggatgagataatctgtacaaaacaaccccatgacacaagtttacctatgtaacaaacctgcatttgtactccttaccttaaaataaaagttaattttttttttttgagacagagtctggctctgttgcccaggctggagtgcagcagcctgatcttggctcactgcaacctccacctaacgggttcaagagattctcctgcctcagcctcccgagtagctgggattacaggtgcccgctgccatgcccagctgatttttgtatttttactagagatgaagtttcaccatgttggccgggctggtctcaaactcctgacctcaagagatccacctgccttggcctctcaaagtgctgggattacaggcgtgagccaccatgcctggccaaaaaattttaatttaattcaaaaaaagaaattagtgatttgatcagatttgcactctgggtttctatgtagacaagagatcagagggtccaagttaaaaaacaaagaggagtagaccagttgagaggctgctgcaatcattcagatataggatggagctctgtagcagatgtggtcagtaacctgctcatgcccaccggctctcactgttgctgtatatacccagggcatctcactgtctgagggctttctctgactgttgaaccatgctagggttatgtgcggggcagaccagaagtcttaaggagttaatagccccaggcatgaccctcaacaagagaggggcagagatgataaatactccaggttcctcatctctcaggtgggcaccaccaagttcccagcatgactgagcctcagctgcccactaatctgctccttagtcatcctgtagggctgccttcccttccctgtctcacttccccactcccccaccagaaacttctaagatcatctcccaaataaactacttatactcagattcttatctcagggtttgcttataggagatcccaacctaagataagtccttgaccaggtggcagtggggctacagagaagcctccaatgtaagacatatcagaggttggtgatgtttcttatgggaagccatgagacagctgggactatggtttcttgtactttcaaccagcgaaggggccacccaagatccacaagagatctaggttgatggacactcaaggaaaatgagcctggtttgttaccaagacaccctagtcccaaattccattgtggagtccccagcccttgtaaattaggctagatcatagcagccacaggaactcatcttgtttctttactcaaacacacacactaaaggcatagtggttgttgtagtagttatttagttctgagtaacatattactgcaaacttagtggcttaaaacaacagtaagctttattattttcacagtttctgtgactcagaattctgaagcaacttagatgggtggttctgtctcagggtattttatgaggttacatcagatttcagctggggctgactcatctgaaggctcaactggagggtccatttccaaggtggctcactcactggatggcaagttggtgctgactcttgctggagagcctcagcccctctctatgtggactcctcccagggatacttgagtgcccttacgacatggcagctggcttacctccgaatgagtgatgagagagagctaggttgaaactatccttttgatgacctagccacaggagtcacatagcagcatttccatcacattccatagttagaggccagtcactaaaacaagctcactttcaagggaaagataattagtttacgccttttgaagggaagattgtcaaagaatttgggggcatactttaagatcaccacagttgcctaattgatccatttccctagattctcaccctaatcttgaacgtgatgatctttccaatcctatgacaagaaagaagctggaagccgaggcagggggattgctcgagcctgggagctcgaggctgcagtgaactatgatggcatgactgcactccagcctgggtgacagagcaagatcccatgttaaaagaagaagtggagaaggaaggaaggaaggaaggaaggaaggaaggaaggaaggaaggagagagagaaaagaaaagagaaaaaagaagagaagagaaggaagctggctggaaaagatgaacacagggaaatgagtgtcgaagtgaagacagaagttcctctttgaaccaagaacagatctggtccaaactgcccctccctggctttctgaggcacttcttaccacaccttagagcccaagagatcatgtttgtgaggccctccatggcaagcagcaagaatggaatcttcataattcagaaagaaaatgagtgtattggaaagttgcagggatgttaacaaaatcaaagagaaagattcttttttcttcttctctctgcttatctgttttctcaatagtgaacttacattcctgttacaagaaaaaaacaataaaaatgtttttaaagaaggactctgaaattattaggttaaaatagaaactcgaattatatggtgctgtcaagagacaaactaaaacaaaacccatttttaactttgaaaagttaaaaataaatatttaaaaaaagtcaagatttatcaggcaaacgcaaaatggcaagaataacaaaattagtttcagactacatagaattcaaggcattaaaagggaacaaagagattcattttatattgaagaaaagtagagtccttaatgaagatagaagagatatagcagctggtcccatagccattaaacatgttttatctctactctagtgacaggtgtcagagaatccctggggttcctttaaaaggataattcctattgagttataaaaagtgatgggataaaataaaattataagtggacttcatagtctcttagtaaaattcagacttgagttaaaaatgtatgtaagaaatataggcctctgaaaagagggaacaaaataggattattcctattgaatcataaaaagtgatggggtaaaataaaattataagtaggtttcatagtcttttagtaaaatgcagacttgagttaaaaagctacataagaaaaacaggcctctgagaactggggacaaaacaggacagtgaagaaaaaacatggaatcggcagttggctatctgcaaagggcacctcccactcccatgtcatgatggcctgggaatggaaggaaccagaagcaccaactgaacaggcctggagtgggctgcagctacaaccgccctgagggaggatctgactgtgtactggggtggtaagaaggaattcaggttttggacaaatgtgtccatccaggtccgtgtctcagaccttccagcattctacagcgtcctgatgcttctcccattcttgtcaggccagagaaggccaaggaaggcatggaccgcagcacagcaaatccacattatgcggctgtttctttctccaggagtcagggacacaacttgctgcatggcttcctgcaggcaggaaaacaaaagcagaaaaaggctcagtctcctagtgccctggaggagccagaataggacaccggaattcaggggtcacaacagttagagatgcttcatctgggacccagggatagaatttgggtaaacatggatggaaaaactatacccttttgttttcacttttctgtaactgaaattgggcatttccttcatttgacgatggaagcaacaagccacaggagtgatggcagaattcatggctataactaaaagaaatcccggagtttcaagtcacatgacagctggcgcagatacctcagaatgccacctccattcagatgggacttaaaaatcacagccacctggctgctagatctggttatttagtacttaaataaacatgaacatttattattatgtcatcaattttttttgagacagggtcttgctccgttgcccaggctggagtgcaatggcgcaagtttggctcactgcaacctccacctcccgggttcaagcgattctcccactcacctcagcctcccgagtagctaggattacaggtgtgagccaccactcccggctcatttttgtatttttagtagaggtggggtttcattatgttggccaggttggtcttgaactcctagcctcaagtgatctgcccgccttggcctcccaaagtgctaagattacaggcgtgagccaccacgccctgcccatcaatttggtttttgtaaaagtattttgagaactgtttttcagtgtaattgatttcctttgcagttctaaatgttttattttttaaaggtaaaattctgaaaaggtttcataagcttcaccagattgtcaaaggggtctgtggtccaaaggaggctgagacccctgatgattagatgccttgccctctccccactgcccctcaagccccttaaagaggggagtagagccagagggcaccagaacatctcaccccacccctctgcacccccaggaggagtgaaggaactacagaatacggagttttgtggaatttgttaattcagtctttttttcttttcttctccctctcctttcctgctcccacttccctcatatcacagccctccaaagtgacccatgctgagactacctaatatgtaatcatccacatttggatccgtgctcttattttaatattcaaacatgaatttgcatatatgcatatacttatgtattgacatatatgcatatacatagcgattttccagccttttcccatgcataagagaagcatcataaataaatggagaagagatggattttctgagataatatatactcaataattttatatgtaatatattgccaaaaactggaatcacaagacatatgccattcaaaatgctgttttcttctcattaatgtcgtattttttctgtagtgttgaattctatttaaaaactgtaggccgggtgcagtggctcacacctgtaatcccagcactttgggaggccaaggcgggtggatcacgagttcaggagatcaagaccatcctggctaacacagtgaaaccccgtctctactaaaaatacaaaaaaacaattagctgggcgggcgcctgtagtcccagctacttgggaggctgaggcaggagaatggcatgaacccaggaggaggagctcgcagtgagcccagatagtgccactgcactccagcctgggcgacagaacgagactccatctcaaaaaaaaaaaaaaaactgtttctaatgactgcatatatgtcacataaaaatgcaaccaaacatatttaatcatctccccattagacattaacattttccaattttttcttaaaaatgctatgatgggacaggtgcagtggctcacacctgtaatccctgcactttgggaggctgaggtgggcagatcacttgaggtcaggaattcgagaccagcctggccaacatggtgaaacctcatctctactaaaaatacaaaaattagccgggcatggttgtgcatgtctttaatcccagctactcaggaggctgaggcaagagaatcacttgaacctgggaggcagaagttgcagtgggccgagatcacaccattgcactcgagcctgggcaacaaagtgagactccatctcaaaaaaaaaaaaaaaagtacctattatgaactacgtgaaataatccttgcattatatattaggttgaactccatcaaattgatgtcttcatggctcaaaactatattatcaatttcatatgagtcaattaattaatattaacattattcctggagttatgttttctctaccacttttccatcagcccctagtccagattcatactgttctatttagtacagctttgtgatatgttttaatctggtataagtttgccctcattttaaataaaatgttcttacttatttttttcttccagggtaacacaagagaaatttagaattatttcactgatttcccatgaaagtcccattaagacttttcattaaaactattttaaaattacaaatgatatataaaagaatttgtagaatgttattttttgcggtttcctaaccaggaccataatttgatgttgtacttattaaagttttttttttcaagctagtttctcagtgaaacttttcattaaaaaagaattggagttcctactcatttttggttacatttttgcttaggcttttcatactttgttattgttacaaatgaagattttcctttctactttccaggttataattgttggcacatagaaaaacacttttctaagatattgcttttgtatccaaccacctaatttacaatctcatttttaacacggcatttgcaattgatttttttcgtttcttgtgttaaattataacatcttcaaataatgacagtgttttttaaaaaatcctcttcttttccaagtgttaaaaaatattattcctaacatttcttattaaaatgaccagaactcccaaattttcaaattaaaagagtactctgccttctggtttttgttttagtgagaatgcctgctgtgatctaaatgttgaaatcctaacccccaaggtgatagtattaggagatggggcctttgggagatacttaggtcatgaggagccctcatgattgggataagtgctcttataaaagagaccccagagagccggctatcccctgccacatgagaggacacagcaagaaggtaccatccatggggaaggaggagacttccttgtcagacaccgaatctgccagtgccttgatcttggactttgcaggcttcagaactgaaagaaataaatttctgttgtttacaagctacccagttgatggtatttcattatcgcagcccgaagggactaaagcaatgcctttattgtttaaatgtcaggaatggcattcactgtgattatagtagaatgctgttataatagtcagtataagtacattgatggtcctaggcagtggtcctctgctcctggtttacaatgagtttcctctcagtaatgatgactgagttgtaattgattatgctcaggatttattgagatgaccatatattttctttttttaaggaaaatttctattattttaattatttttatgtacagaaaactcaacagcgtacatttaacccagtttagtcgcaagttctttagccttcgccttttttagcttggtgatgcgagccacagacttgggacccaggacattacctccccagtgacagcagatctcatcgtatctgtcgctgtaattggtcctgatagtttccaccagcttagccaaagctcctttgtcttccaagttaacctgtgcgaaggcagcagtggtgcctctcttcttgtggactagaagtcccagtcttgacttccccttgataaagcagtaagggccccccattttttatgacacagggcaggcaggaagacaaccagctagaagaaagcactagctgaagagcatattttgaccaaaagcagtaaatttcaaagctagctgggtagcaactgctctgggttaaaaagttcacgtatctgcccttcaaggcagatgactatatattttctaatgtttcctatgggtttgatgtgtgatatttagatttctccatagcaagcaattctcccattcttgggttagatgctgttaggggaagggtcactctggcagaggcaggtctgcacacctgggttgttgcttttgcacacacacacccgccccattttacactgcacaccgcagaacttcaccgtttcacacattcagaaatgaaggcctccgtggtgtaaacaagttgcccaaagcaacacagcttccaggacggaaacctttggattgttggtccagtcgatttaactgtatctgaatggtgtttgattgcttgtgtgatcctggctgggaatattctcctttctggacttcagtttccccataagaccatatactcttctgtagacattcattctacagtccaggagagtacctggaagggacattaatttctctctcccttttccccacggcctatgcattattgtttcaagcccatctcccccatggcccatctacccgcagccagctctgacctgaaggccgggtcaaaggggtgctaggaattccaggtcggtgattggccttcttctcttactctatgtagactccagcctacaattcctagtagggaaagaataaccatctctaatttgcaagagctcagggtctcgggtacagacaggaactggcccctgccaggggcattcccagggcgttgctcctgggatgggcagagggaccagtgggcaggccagtaatgccaacattcagagggtcctcctgcgggcgggggcttcctggaggaggtggccctcaagaggggcttgctttcgatagtgggggtgttgtattccgtgcggaaggaccctcccgttgtgtggaggaaccgcacagtccctttaatgtggtatgctggtacagtcactccatcttgacgcctagccccacccccaaacgttttcaagccaaagcaaacagaagcaaggcccaggtttaaacttaagaggctgccttcagattttgtttacttatccagatttgcaatctttcaggacccaccaaggccagtttctttttcagactttgcactaggctatgagggcagggggtggcgggcagggcaacgtcccataccgtctaaatcgcgcccatacgctgccacctgggaaagggggcagaaaggggcggcggtgctctaaagtgaggcggagctggagggctctgaggaaatgccccggggcaccccctccccaaggcagcctggagtggacgcgcggctgccaggcttcccgcggaggacgcgaccccggcggtgcccgaggctggcgcgccctctcgcggccacgccgggaacgccgccggctgagaccctcgcgtcctcggagaagcctgtggttggttccagcctaggcccggcgggcagcagcccacgctgggtgtttgagggcagtgaggaaaaggacctgtctgcagagatcgtctctgctgcagtccttctgcagtccacgctggggaatgccctggtcagcgcgacagagtcctccgctctccccggcatcccctgtccaagcatttctcctctgcccccagctgtcagctacccctccccttgcctcttttgctcgactccttgaattaactcagcctcgtaggggtgttgatgactgcttattcctccctttacctctagcccagcaggatatttcacaactttcctccaaagcagcggtcaagatctgagttagctccacggcttgctgactctcctcatgctcgggttcctcatctatgaaacggggataactgtagtatctgcgtcctgatttggtgtaaggttagtgagttactacgtgtgtagcagacccgtgcctccacacattccctcggtgcccctccttcttcctgtgcccctgtcctctgcgtgccttctctgtggggagacagccagcatcttcttgcttctctgttgcagggctgtcccaggctgctggagcctccctggaccacatgcagcagcctggaagtgccagggatcaggggacgtatttacctatattagagttccccagagaaacagaacttatgggattacatatatacatgtatacatatgcgtgtgtgtatatatacgtatatgtatgtatgcatgtgtgtgtatacatatatatgtgtgtgtacatatatatatatgagagagagaaatcgatttattataagggattgcctcatgatcatgaaggctgacaagtcccaagatctgcattggcaagccaggagatcccatggttggttccagtcctaaagctgccaggctcaagagccaatgtttcagtccaagtccaaaggcaagaagcaagttgatgtcccaacttgaaggtagtcgggaaggagaaattccctcttaattggaggacgttccacattattgttctattcaggccttgagcggattggacaaggcccacccacattgcagaggtcaatcagccttactgatttaaatgttaatctcatctaaaaacaccctatcacagaaacactcagaatgtttgactaaacatccagacaacctgcgacccagccaagttggcacataaaagtaaccatcacagcccccgagggcagatcttcatcatgacaggtggttggggaagcaggagccacactgcagctccactctgcactctcgcctggcctccttcccttcccagtcccaattcctcactccctgggttttcctgaggcctaccccttagtaaattactttcaagtgaatcttccttcaagggtaggaatctgctccttgacattccttattcaccatccttctgcccgggttggacggatcccctcctggtgctggaacagtctgttccttccacaggatgctcagaatgtaaaccatcattgcaaagactgaggcttcacaaggaagattccttcaaactcatggtaaaacataaactgaaaacatgagaaattgcatatttttctgcccatctcctgggcacacagaaggacacaaagagcttggctcctcacatcaccttcatgggcactttatcaacgataacatgagaacaagtctggctgataacaggattacgtgattgtaattagatggataattattcacacgtggaagggtttgatgactgggtcttgagaataggagctataaatacacatattagaaaaggattccattaaaagtgaacctaaagcaattgaaaagcttctgatggatcattagccatttaaagagatttttgttgctaatgtgtcactcttttcaccttttactaaaaagcttcaaaaaggaaatcaaagcatctgacattgtaatgtaaatcaatggggagaaggcattaaatttataaaagttcagtttttatgcagcttctcctaaacccagctgtgatacaaattgaagtctactttgtgtacattggcataaaatgaggtccattataaacatatattttagtaaattcaatgtgatgtagatgcaggttgaatacagcagccagttacttaaattgaatgggctgaatttcccagaagaaaatctgaaatgaacatgaaatgctgttactctgcttcaactaaccagacactctttagacgaaagtgtgccaggtggaatatcatttcatatagtgttttcagatatccaactgatcttccacatttgcccagccctgccctggtaagcaattacacaaaaatgaaacacccaatgtttgcttattaatttatgccacggacagctatcagttgcatttaataggcttctagtccaggaatcagccaagaacaagactcttgagcataaaaggataaatttaaaacacagacttcttttaagaaggcagatttgttatggcacacatatatatgtgatgtctgtgtattttacactgtaaagacatacatcaaatgtagtagtgattatctgtggtataattgttaaaattatagaatagcataaataataattttatctacactcatgtatccaccatcaagcttaaaaatgtaacaccttaaagcaatgcagttgaaaccccctgtgaatgcctccaggaccatgtctgcctgctcatgttccctagagctgaacattatcttgaatctgctattcaccgttcccatgcattcatttcaacattcaccacaaatgtatgcatcctcaaacactgtctagtatgtttaaactttaataaatgaatgcatcataacacatgaaatcctctgcaagttggctttctgcttgtgtttgtgacattcttctggttttgtttttgagaaggagtctcgctctgtcgcccaggctggagtgcagtggtgccatgtctgctcactgcactgcaacctctgcctcccaggttcaagctattctcctgcctcagcctcccgagtagctgagattacagacatgtgccaccatgcctggctaatttttgtatttttagtagggacggagtttcaccatgttggccaagctggtctcgaactcctgacctcaggtgatccacccaccttggccttacaaagtgctgggattacaggcatgagccaccgtgcctgggctgtttgtgagattcttctgtggggatctgtatagctgtaactcactcatgtttatagctgttattttatattgtgtaagtaatcactgttcatttactcatcatattctcctgtgggtggatatttaagttatttctaattgtttgcccttgtcaacactgagactatgaaaaatctttatttatgtatatgaaccatttgaaaataagttgcagaatgtcctataattctttcctcattgttagattcagattatactttttaaatgtacatttgggctataaatttacctctaatgctcattttaccttcattcaacaagttttcattttttaaatattattttttaaagccgtttaacatgttcagagtgcttttctttctctcccatgcatattttggatgttattaaagctcataacaaatagtttaatttatttttagtctttcttttctaacaagtttatcttagaataaaaaatttacctctaaggaccactttagtttcatctcacaaatttggcgaagtaaaattggtattattgcctaagataaatacttcagattttctattatgttttccttattaatccctgaattatttcaattttatttcattgagatcagaaaaatgtggtctgtaaacgaattctttagaatctgttgaaatttcttctgtagctcaatatatggtcaattttgggaaaggttttatgtggtcttgtgagaaaaaaactgtatgctttcaataattgacaaatggaatctaattaaacttaagagcttctgcacagcaaaagaaactatcaacagagtaaacagacaacctaaagaatgggagaaaatatttgcaaactatgcatctgacaaaggtctaatatccagcatctataaggaacttaaacaaatttacaagggaaaaacaacccccattaaaaattgggcaaaggacatgaacagaccattttcaaaagaagacatacacacagccaacaagcatatgaaaaaaaggtcaatatcactgatcattagagaaatccaaatcgaaaccacagtgagataccatctcacactagtcagaatggctattattaaaagtcaaaaaataacagatgccggtgaggttgcagagagaagggaatgcttatacactgggagtatgtgttggtggaagtgtaaattagttcaaccattgtggaaagcagtgtggtgactccacaaagagctaaaaacagagctaccattcaacccagcaatctcattactgggtatataccctccaaaacataaatcactctatcataaagacacatgcacgcatatgttcactgaagcactattcacaatagcaaagacatagaatcagcctaaatgcccaataatgacagattggataacgaaaatgtggtacacatacactgcggaatactatacagccataaaaaagaataagataatgtcttttgtgggaacgtggatggagctggaggcagttatccttagcaaactaaggcatgtggccccaaatctctaattctgattctgtgtctatttcttttgtgactgtataatttatttatcgttctcacttataagtggaagctaaatgatgagaactcaaggacacaaacaggagaacaaaacacactggggcctacttgaggtgggaggatgggaggaggaagaggagcagaaaatataactattgggtactaggcttagtacctgagttcgatgaaataatatgtacagcaaaccaccatgacatgggtttacctgtaaaacaaacctgcacatgtacccctgaacctaaaagtttaaaaaacatgtatgctttctatggggtcaaagatttctgttctctctctccatttctcttcccctcctccctccctctctctcctctcttccccctttcagcccctccctttatgctcaggtgtattaatcctgattttcttattcattcattcattggccatcctgattctatttcttttcctttcaatctactttttttctttccttctttttttttttttttttttttttttttttttgtctgagacagagtctcgctctgttgcccaggctacagtgcagtggcacaatctcagctcacaacctccacctgctcggttcaagtaattctctgccttaacttcctgagtagctgggattacaggcatgcaccaccgcaccagctaatttttatatttttagtagagatggggtttcaccatgttggccaggctggtctctaactcctgacctcaggtgatccaccagccccagcctcccaaagtgctgggattacaggaatgagccaccatgcctggccatattctttttctcaatgctttaatctattctaagagatgtggccccaaacctctaattctgattctgtgtctatttcttttgtgactgtataatttatttattgttctgagactatccttctaggagcatacaagttcctgtgttgtattttcttggtggactgttccagtatgagacatctctctttgtcttttttactgccttttttcctaaaattttatcttgtctgatattagcattgctgcattgtcttttttagtgtcattaacattggcctggtggttgcccctttcattttaatgttgtagtgtcttttgatttatgtttctcataaacagcatagaactacacttcatgtaattgtggcttttgctctaatccaaaaatatctggatatctagattaggtgactatgaggggtctatcacctatttattttttattgtgattaccattacattggacttatttctgtcacttagtgctgtgtttactacttaacctgcttcccctttgctgactttttttccttctctgacttctggtagattgcacatgctttctttttttatcttatttttattttttattttactttaagttctgggatacgcgtgcagaatgtgcaggtttgttacataagtatacatgtgccatggtggtttgctgcacccatcagcctgtcatctaggttttaagccccacatgcattaggtgtttgtcctaatgctctccctctccttgcccttcacccgccgacaggccctggtatgtgatgttcccctgcctgtgtccacatgttctcactgttcaactcccgcttatgagtgagaacatgtggtgtttggttttctgttcctgtgttagtttgctgagactgatggcttccagcttcatccatgtccctgcaaaggacatgaactcattcttttttatggcagcatagtattccatggtgtatatgtgccatgttttctttatccagtctgtcattgatgggcacttgggttgattccaagtctttgctattgtgaacagtgctgcaataaacatacgtgtgcatgtgtctttacagtagaatgatttataattccttgggtatatactcagtaatgggactgctgggtcaaatttctggttccagatccttgaggaatcgccacactgtcttccacaatggttgaactaatttatactcccaccaacagtgtaaaagtgtttctatttctgcacagcctcgccagcatctgttgtttcctgacttttgaatgatcaccattctaactggcgttgcacatccgttctttattcccttttgttctccctgcctgcttggaatttaaatatttttgttttattcatttagtagttactttcatatttgtcataggcatcttaatttcatatatttctcacaaatcaagacagtgtaccccctttttaaacaaggtttggaattttcagttctttcccttttctcataacttagctcccaccagcaactatgtcattcttatctacagttttagttctgacttcttttaaaacataaattgttcttttgttcacataaattattataattatggctaagtcttttattatatcataattgttatatcataataaaaggcatagcaataatgataataatttatattgttattattttgagtgaatacttaccatatttatcaattatatatgagatatacattgtttcactatttaacttccctgtgatcgtgaggttaaattctgtctttaattataattgattttttttcttagaagttaataaagtagcagtatatcttacataacagtgtatcttataattggtaacatcttagatgggatgaaataaagtgtttagcatcaccaatgtattttcttaccaatctctttgctcattgttgcttcttgcatcccactccttccaaagttcatttttcttcttgctgaaatatattctctaattctcacagtgaggatccatgagttccttattttctgactccttgaatgtctgagaatgtctttattttacactcacgattgaatgatgctttggctgggaatagaattctatgatcacaatttttcccttaccattttacagatagttcttcatttcctctgacatctgtggcttctgattagaagcctgctgtcacctgcctgtgatttatttgtccattatctgtctttcctctctgtcttattaatgttttttctctttatgttttgcagctgcactgcaggtctaggggtgcaattgtcaaggtttccagcttggagttcagtgagccatgtctcgatttctggaaaactctctttggacattacttctccactgaactcttgtctcttttccttcatacttggcttctccattatcattactaaatcctgggattttcccccactcctgtcttttaatttcccagccatgctttcaactgaaagcaatctatactctactgagggtttttttatgaccgcattttcataccccagatttttttttttttttgaggcggagcctctctgtctctcaggctggagtgcagtggcgcaatctcagctcactgcagcctctgcctcctgggttcaagcaattctcctacctcagcctcccgagtagctgggattataggtgtgtgccagcacgcctggctaatttttatatctttagtagagacagggttttgccatgttggccaggctggtctcaaattcctgacctcaggtgatccacctgcctgggcctcctaaagttctaggattacaggtgtgagtcaccgcacctggcccataccccagatttctaaccaagaggtttttttctcccatatctgcctcttctatttcaaaactgcctttcttatcccacaacttcatattatttcatggatactatgctgtcctttatttatgtgagagtttttaacttctaaaaattattatttcacttaatttcatgtttatttttatctattttaatgttttattctttcttcatgtatttatctaaacctgaaagtcttaatgtcattttcagatggctttattatgtctatttcctcaatcataaattcctctatttttgtggatctgtcattcttggtgctagattttctcatgtctttagaatcatgtgtttagaaattcatgtttgacagccccttttccactggagggctttcccacaggtacacctctcttcagggccgttttaaggcttctttttttaaaggatctacagggtgcctagctcccaagcaggtcttatggtagtggcttagcttaggctccacattccaatgggtggagcggttttaggacctggcacaggactgagcacttgtctcatccgcggcctctgcccagctcctggcaagcagcctagaatctggctacagcccatggtgtgtgggcagcattctcagccccttccatgatcaggcagctggtcctggccccgtgccagtgcagggtggccagctcagcccctgccgggcagctttgctatcccagcccctcttaagcccacttgtcttcttagctctccacaagtgtgagctcctgctttcagctgtgaccttctcccatttcttatccagaggcgtgggtttcttgtttttaatcacagtgacattatatttctcatttttatctaactacctagtagcctgtgtgttgggagcagtcaatctctcctgtggacctggcactctggttgaagttcagtgttctaaggcatcctgagatccgcagaggcactgccagctgacggtagggacagtgacatgtgatatgatggtggggacagtggggtgctctggacacacctccagctgctaccagggagctctacttgcaggggtttgtatacaagtttatatacaaaatctctattactaataagccaaatatttggaacccatactctagcccaagcatctcattttccagatggagatgaggctgttagttccaaagccaggcgggaaactaggtctgctcatgtcctgtctgacactctcagaactgcaccaggcataggtctgctaggcgccctgtaatgcccatctcatcccacatgatggggtcacctccctcacttcatccccaagacgaagcagttgggaactcagcccaagaggaaacttacttccaaacccatctggaacactgattcatgtaaccaaaaccacctagctgcccgcctggagaaggttctgggttgtggcactgcaggatccagtaaggcccgggcctctatttacacacatttcaaagagagtggacccctctcaaagctgcagcagcagcgcctcagggaccagtgtccaggaattcccccagctcacctggcagtgctgcctaaaggtttaggtctggccggatgcagtggatcatgctccccctttggcctcccaaagtgctgggattacaggcatgagaccaggagctcaagaacaacttgggcaatatagcaagacccccgtctccaaaacaacaacaacaaaattgtttttaatgagccagttgtatttgtgtgtgcctgttatcccagcttactcgggaggctagggctagaggattgctgagctcagttcaaggctgcagtgagctatgatctatccactgcactccagcctgggtgacagagcgagaccctatccctaaggaaaaaaaaaaatgtagctgaaacattgacccattcgtaaggtaggtgactcagagtgtacttccagctgattctctggcacagctaggagcatccagtcaattactcaaaggattcttgatgatggccaaaatatgtgtggttttgatgatgtctggagaggatgaggatggtgccaacatgttttcatttgagcaactattaccactccacaaagggaaatctgcagatcctgctccttctggtgcatgcgttttctaaaggtggaccctgctggattctggggttccttgcaggtgcctcaggagccatctcagcaacacacgtgtctccttccttagaagcaaccaactgtgctgtgccatggtgaaaaggagctgaactgagacaggagtcgtgtcttcctgggtgacctcaagcctcaagcctacatcaaacatggtaccacatcgtggacaagttactagtcaggatttttcagcctcaagggacaggtgcccaattagacaatgcttaggtggagaaaggagaattgtttgctggtttgtaacaaatttcaagaagggcaggagtccaaacaccatcacctttgctctctccaatgccacgactgtccatgtcatcatcctcatcatttctcaagctgcttttcttaaaagacaggacccataaccatggcccagatcccatctctgcagatcagccccagcaatcacggctttgttgtctccctccagtttagaaaggcccggagaaggagtgtgattaaagcccagctctggggttcgcttctggtttcgaacattctcctggctgtttacgtttacagtttatattactcataactcagagagttctcagtactctaatctgttttattgccgttcttaatgcaagtgtgttgatgtaagcgctctgccagatctttctgttctttgtaatctcccgttctgtataaacgctctgcccttcatactcatcgtgtgctctggacaatggctcttcatcatgtcgggttttcagtaacaatttagttcatttctctctgttggctgttttcctttattgtaagagagggaatacaaggcgttgcttactgaacacctactgacatgttccaattagaaggaggctcttcttggtacaaagcatatctccctaaaccaaaaatacttacttatttttagagaaggggtctctctctgtcacccaggctggatgaggttgttaattccagagccaggctggggtgcagttgcacgattatatctcacaggagcctcaaactactgggctcaagcaaccctctgtccttagccccttgagtagctggaattgcaggcacatggccccatgcccagttaattttctgtttttttgtttttttttttttagagatggggtctcactatgttgcccaggctggtctcaaacacctggcctcaagtgattctccttacttgaggaaggcctcagccttctgagtagctgagattacagacacaagccactgagcctggaaaaccaaaaatatttagataaaccctatgtcagtttccttctaccaatttctacccacatttcagggtcctcacgtgctcccagccgggcatgatatgaaattgactttgttactgaaaatcatgttaacggggccatcctcttattttgcacacatctttatttgtcctttttgcttctcacttatctctggtgcttggaaccaatccatcattttttatggcttctgggctttgtatcatactttgaaaggcctttgtgcctctgaggttataaaagaattctctcttgcttctatcacttttatgagttccctttttagactcctttttagattaagtctgacccatccaggattaattttagtgtaatataaaaggtatagctctaattccacatttttccaagtggcctctcaattctccaaatccccggatttcaatgatccttatttttcccctattgatttaaaactccacctctattatgtagtaaaattccatgtgcattgggtctgattccttaactttcttttgcaaataccttccatcgatctgtctaatctgtttaaatcattataattttgtaacatattctaatatttggtagcattgttctgtccttcattattctccctagaggtttcctagttattctttttttaaataacaaataataattgtacatattcatgaggtacaatgtgatgctttgatgtacgtatacactgaaacgattaaatcaagctaatcaacatatccatcacttcacatatttctcatttttgtggtgataacatttgaagcttactctcttagcagtttttaaatatacaagacgttaattgtagtcaccacgaagctattcctgaatgtttattttttccatggaaactttaaaagcaatgaatctagctcctccaaatcaagtttctattgatttttttgttagtcaccctaaatttttaaattaacttggggagattttgatggtattgagttttcccatccaagaacagggtctgcctttccctttgtccaagtctctgacttctcagaagcatttttgaagtcttaggcaaatcgcttttcacattaaatgtaagcctatatcttccatcttttttaccggtatggtaaatggggcctcttcttccactgtatcttctaactagttgctatttgaaagctattttgttccatatgttaattttgtacttgccactttactgattaccttgctatgtgtaatattttttcattttattttcttggattttctgggtacacaattgtaacaccatctcagatgttgatgattttcctcctcttttctaatttttaaactcctaaaatcattcttttttggttaattgcatcgacctttagaatattaaacagtacagtggtagtggatggcttttctcatcccaaacttatatgaagatgcttctaatgttttcccattaaacgcgatgctcatgtctgggtggagatggatgtattttataccactaaggatgtgtccagctccacattgggtagcaggttggttcttggtttaaaagacatactttctatctggttaaggaagaatccatcacacctatttgtttttcttgttttttcagacaggttcttgctctgttgcacaggctggagtgcagtggtgcatggcctcatgtgatcctcccccttcagtctcctgaatagctgggactacaggaacacgccaccttgcctggctaatgtttctaaatttttgtaaatatggggtcttgctgtgttgtgcaggctcatcacacctgttttacgagaactttaggtttgggactagataacatttagttaattagagcttcagtacccatctaccaaccataagatattcataatctctttgagcttcaggtaaaatgtgataatacgtcccttctagaacactgtaaagtttaattgagaaggaatgaatggaaggcaccaacacagtacttgacacacagcaaatgtgcagtaagtgataattccttccattctcattaacagtatagggtttgttttgttttgttttgtttgtttgtttttgttttagttttcttgagatggagttttgctcttgtctcccaggctggagtgcaatggcacgatctcggctcactgcaacctccacctcccgggtacaagcgattctcccacctcagcctctcgagtagctgggactacaggcacatgccaccatgcccagctaatttttgtctttttagtagagatggggtttcaccatgttggccagactggtctcaaactcctggcctcaagtaatccgcccacctcggcctcccaaagtgctcgaattacaggcatgagccactgcacccggcctacagggcagttctttttggttttcattcttttcgcttttttaaatgaaagcaagtttattgggaagtaaaggaataaaagaatgactactccatcagcagagcagccctttctgggttttcttaatgtgaccatgatgataattttccttgcatccaaactataaactctatttggttaaaatatataaatatcactaatccacataaaatattaatctgattaataaaatacaattttatatttttgccaattgtgagattctcagattggtcccgtaccttttacttttggccttggccgattttttaacttaaaacatgtttgtgtcatgattttttttttccgtgttttggaacatttactgtgctactgtctgggagtgggtgggtaattctcacccacggtgggatcttgaattcctgaccactttggaatgtgttgaccctgcactgcttttactcaacactagggggcagcattgtaaaagaaacctggcgatgcttctcagtagcaccatgaaatgttaaccggattagagcctgagttaaaacgctcttgaaggagtttagtctttgccatttcagtctatttcagaggcctcttcataaaactgtgggtgtatcgccgggtgaggtggctcgcgcctgtaatcccagcactgtgggaggcagaggcgggcggattacttgaggtcaggagttaagaggcgcctggccaacacggagaaaccccatctctactaaaatactaaaaatacaaaaattagccggatatggtgcgagcttgtaatcccagccactcgggaggctgaggcacaagaatcgcttgaatctgggaggtggaggttgcagcctgtgggactgagagggaaaaaaaaaaaaaactgtgagtgtgcaaaaagcactcagtaaatggtgtggactagcacagccacctctctcacctccttcacgttttgattcaaatgtccctgaccaacctgtatgaaactgcagcctgcccactggcctcacctccccatccttcttaccattctctacttctttccatagcatttaacaagttctaacattttaatttccttatttattatggcttattgtgtctccccactttccccctaaaatctaagctctacaggggcatcgtctattttgttcagtggagtaccccaagtgcttagaacagtgtctggcacaaagtagatgcccaaatagttctttgttaatgatgtggaatttgtcatgacagtggtgagggtggtggcaatgtctgaggtaggggcagtggaggtggggaggctggtgacagggtggagataggggtgatgtggcaattgtcatgatgcttactgtactgtggtttggtcagggtcctccggcaagttggaatctaagcctgaggctggatgaggatttctagagatttcacaagggcttatcaccatgtgagcacacacaatgggttcctaggcgaaagtgggggaaactgttcacactcatacatgcatgcatacacacacacatgcatgtgcacacacacatgcacacacacacgtacacacacacacacaagtctgtattcctggccctccaacaaaggtgctgtacaagggagtgatggaggagctaggaaggttgaccaaactatcacttaccgagctcatcatgcaggtttgttcttctaagaaaggattccctatcaccatattgcaggctctaaggtgaagaaacacattcaaaatcatgcctggaaccatcacagtctagcctggtgaggaggttgcaggcagggcccctcctgacatggacagggcacagggcgagatgatcagtgagcagttaccacatatctagataattacaatgataaacacacctaacagactattaaataaaacatgtctatcctcctccattaacaaatacaccctcatgaagccctgcaaggctgctggactctcagaattccacaccaggacacggcagcccggggagaagcccccagctgcccacttccctcatccaacctctgaggggcaccgcacaaaagataccccaatttgcacatcccagctctatccacaccctccacaagaacgctgacccttgggccccctcgggccgagggctgtgcacaaggatagtgctggccccttgggaggacaggccctgggaggcagccatggcaggtcctggaaagcatgcttaaggctttggggctgggaattctagcatcccaggcacccagagcaggggcagaaggaagagggcaagctctggccagatgtgctctgggctgatgggcccctcgcaccctgggggaaacgccagttaggaacctcaaagtccgacacctggggcaggtgcaggtctcctgactgcaagaactaccgggactactgttgttctgcagggcttacaaagcgcatccctgttcaaagaaagtttgaagaatgaagtcagtggtggggtcccctatagctggggaaatagagaagaagaaaggaccttggcaggaagtagcccagccatccctagcagctgagaaattccctccaccagttggcaccctcctcccccaacacttctcaggccacaacagagggaagaaaggctggtctcaaagcacacctccctgggcctgtgtggaaggctggcagcctctggccctggcccatttcctcctcccattaacataaggggctcttggcttccgctggaggtcttcttacttgccttggttgctctccctcagcaacctctccgcactcaaggctgtgactcttacccaccccacatctggattcctcttccaagccatgtctactagatcctccgaggcctgcctctcactccccgtgcagacaacctcgctcccttccctcagcagcagctcctgcacctgccctggccctgctagggagcctcaaaacctttatagatggaggtagtggttgcataaccttgtggatgtactaagcaccatgggattgtacaccttaaaatggttagttttatgttatgtgaatttcacctcaatcaaaaaatgaaattaggctgggtgtggtggctcatgcctgtaatcccagcacttcgggaggctgaggtgggtgggtcactgaggtcaggagttcgagaccagcctgaccaatatggtgaaaccttgtctctactaaaaatacaaaaattagccaggcatggtggtgtgtacttgtagtcccagctactcgggaggctgagacaggagaattgcttgaaccggggagatggaggttgcagtgagctgagatcatgccactgtactccagcctgggcaacagagcaagacttggtctaagaaagaaaaaacagaaagaaagaaaaaacagaaagaaagagaaaggaaggaagaaaggaaggaaggaaggaaggaaggaaggagaagaaagaaagaaaaagaaagaaagaaaggaaggaaggaaggaaagaaaaagaaagaaagaaagagaaagaaagaaagaaagaaagaaagaaagaaagaaagaaagaaagaaagaaagaaagaaagaaaggaagaaagaaagaaagaaagaaaataaaaatgtaaaacatcttctgaggcctcccttggccacactgagccaatgatgtctcaggaatccctgcacccactgctcctccagccagtccttctcatttgtgttaggccctccctgaggatgtggatgttttgaccctgtcactgggcttgggggacaggggccatggctgggaatggaccctgcttatggatacccaaagacagcaagctcttctgacagcaggcattcatgccagagaaggtgggtcctttgcaaaacgcaccctgagatttcccccagaaatctccccagcactaagggtcctagctggacactcatccctccttcagggaccacagatctgcctctaaaccttcatgcgtggactctgcaccgctcactctaaaagaatagggcttgtgtagtctggagccttctatcttatcctgggtaacctccctctgactttctcaacatcctcagcccctgaagatacagcagctaggacagagtcagtctcgaggcctggaggcgagaacccaatgtctttgttatcgggccctctcgttcttccaggtaaacatccctgagcgagggaggtctgaggacagggcgctccttgggcacccctttaaaaagcaacatacattatgattacttcaccctgcaaggccaaattccccagggccaccaccagtgttcattgttgccctgttgctctttctgtccacaccagtggtacgaggagaccctatctcaactctcactccctgagataaatgtgaaatggacaacttatctgtgtctccctccctcgcttgctgccccttctgggaacaggaccccactgaggacaatcgattcacttggctggttggcaaattgcaagaacccctctgcctatgccactgatgcacaatgtctagggctggcacaatgcaaactcctccaagagccagttctgtccctccaggcacacagatactatccatcacagagctggcggcctcaagaatggccatggggagccactgaatgttttgagcaggggtgtgacatgagccagttgggagtagtggttatgtgcaggcattttggtgttgggctgcctggattcagataccagaactgccacctattagctgtggaatctaggacaagtgaccatgcctctctgagcctcagtttcccacctgcaaaatggggataacaacagtacctacctcctagggttgttgtgaggactgagtgggtaaggcccttgcaatagggcctgccatttcatgttaggtaagagttagcttttatgaattcaatctgagctccagctcatggaaagttacttgacatcgctatgtgagttaggaaaacaggctctaaaaccaaaggcccttgcagtgatggaaataagcggtacccacgcctgacatagccaaatggaggtgggatggaggggaagaaagacatttgagccactgagaggcggaagggaaggaccagtgaggtgtgtgaactgggtgggggtggggagggaaaggtgacccaagggaaagagaggccttgagtctaggtgagcaggaggagagtgatgctggctaggaaagcagggtcttggggcaaggcaggagagaggaggtgaggggctatcttcggacctacaaggctcacgaaggaagaggtgatcatcagaaagctgtaaatatggggatgcgtttggagctcaagcaataaatggaggctgaaggttgagctttgaggggaggtcattcaggcagcagtgcaaagctccaagatccatgagatttccaaagggaagaggactgcaagtggagagaagaggggaggggagtagagggaggaaaagaggagaagaaactggacaggaggagtggggagaggaaaggaggccaaacagcctccagggtggtaatgaacaccacagctatggtgtcatacctgagtttgagccccgctctgtcactaactagctgtgtgaccttgggtagattgctgaatctctctgagccttaatttcttaatctgtaaattgggcataatgatagaaactcccatacagggcaatgatgagaattaaataagattgtgtgtgtaaagccctgatttcaatgcctggcaccagggcagagcccagggaatggcagctagggtcattaggattcttatgaaatccaagttaaatgaacagaagaaggaagaggggttagagaaaaggcaacagagtggagctgcttttaaagagccaggagagcatggtggagtgggaggaaaggcagggagatgtttaggaaagcaggagaggccagcaggtgcctggcaccaatcagtacagaggctagaacttagtgctttgggtttggcaactaacatgtctctcgtaacttttgaaaaagcagtgtgattttcaaaaataaagagtaagtggggccaggcgtggtggctcatgcctgtaatcccagcactttgggaggccgaggtgggtggattacttgaggtcaggagtttaggagttcgagaccagcctggccaacagggtgaaaccccgtctctttaaaaatacaaaaattagccgatcgtggtggcgggtgcctgtagtcccagctactcggaggccgaggcaggaaaatcacttgaacccgggaggcggaggttgcagtgagccaagatcacgccactgtactccagcctgggtgacagagcgagactccggctaacaaaaataaataaataaataaataaataaataaataaataaataaataaataataagtgggaaagaccattggaaggtacgttagggtgtcttctggggaagggctgggagtaggcaagtttgaatgccaggccagagagtctggattttatatttagacaattatgtaactttagaggtatttgagtgggtgtcagcctggtgctagtttgggatgatgtatctgggtggggcagagggagagaaggacccacgcatcacacctgcccaggtcaaaattagaatgtgattgacaaggacctaaaattcccatgttgagattttaaccactcgatttctccagggattcagcgattcaggttgactgaagtttaacagcaaagcaagcactaggcagaacagtatcatgcaaagcccctaactctggcatggggagggatgggggacagataaaggagagaggttgggagggagatattgcaggatggagccaggcccaggcaaggtggaagttgcagctgctcagattttttacgattgctcataccgttcacccgcagctcccaaatccggaagactcttcagggacatataaatagtaactgttatttgagaacccgcagagcctcacctgttctagcaactgccggaggcttatttcacttagcataatgtcctctagccacagtgcaacctgtaaatatatacagctattatttgtcaattaaaaaccaccaccaccaccaccactggggggcacttgctgagtgttttatctcagaaggtgacctcgctctccccaggtcttgtcatgataccgtaactaatcacacaacgacaatgagagccaaaaaggatgatatagaggacacacacatgaccagtccacttccttaaaagtacctggggtcttgtgatccggccacctggacagagaacacaacagtcaggggcttgttgagaaacaattgtggttttgcttaattatgaccgaggaactgaagccagtcttctatttatgattggcaaggtggtctcaatgcatctgtcctgcttaagaaagtaacccccgctttccaaatctttccaacttcttcaaattcaaaagtctgagggaggctcagactgcgtgggggtgggggtgttgttcaagatgtggcttgtgggattaatttttggcaggaagatcacagtgttgaatacaatgaaactctgtcctgagaacaggcctctcagggagccgttgctgctctcggactggcagggcctgaggaattcattacaggggatgaaagatctactcagagccaagatttattcctgcctggagaccctggagtcactgcatttccaaaaaaaaagggctcatttcattagactccaagaaagtggattttgggcttctaagagaaggaactatcgtgttcttttaaaatttttgtttggatcattgcagactaactagatgttttccatttgaaacgaccccctttgtatgtctctgccacaggaccacagggtaacagatgtgatttccgtgaaatgcacctaccatgggtcctggaacacagtaggtgctcattaaatactttcttccatctgccccaggtggtcctaaaattttctgagtcagatccaagttctgtgtaaatgcttacatcaaagtggggtctgtggtcttgaattcctccctccaagttagaacccaaaaagtgccctgattctgtagcaactttaagaatctctgtgatttatttgagtgaatcttttaactgaaatagtaataaattgtgacaggccttcacctgttagcagagagtgaccctgaaatgccacctagctttcaggagaaacagtttctaaagtgaggattcaaagcaaaaatacttgtggaaaaaaatgtaacggatgaaatacatgtacattctcctgtttttgatggtggttaggggacacatttttcctgccctacttcttcatttgaagttactttccaaagtaactttcataacttaattacatcttcagtgaccctgtttccaaataaggtcacatttggaggtactacagttaggacctcatggtttctttgtggaagccaaaatcagtccatgtaaatcagctttaataaatgagatagctgccttatgccacaaccccacactgagcaatgtcatttgggtaaatatttcatcccaaccatttgtaatgtaagggttgctgtttgcccagccaacagaagggagtatctgaccttagtccatcattgttacggggagatgcttgttgccatgtggcccactcaagggcaggcagttgaaaccaagcatccaggtgcttccagaccagtctctacacctcctagactttgctctcagttctctgtcccattatgggaatgtgtgcctagaaaacgggttgtcctgactttgagtttgtgatgcatcttgtatgtctgtttgtctctcccatgtttaagcataccaggtcactagttcccaattgtactaatttcctaaagctactgtaacaaagtaccacaaactattttgttgcttaaaacaacatagagttactcccttacagctctggaggctagaagtctgaaatcaaggtgccggcagggttgatctttctcaggactctgggagaatttgctccacacttctggtaacaaccagcaatccttggagttccttggcttacagatacaccattccaatttcggccttgcaggggcctagggaaaatgtcccctttgccctctgaaggttcactgaaaatcaactgacagaaggcagattcattaggagaaaagacaaacaaacttatttggtcatagtttgtatcacccaggagccttcaaaatgaagacccaaagatatagggaaactggccatttttatgcttaggttcaacaaactacgggcagctatgtagaaatataaggggacaaagaggataagatctaatgttaataggctgagtggggaaacccatgaaggctgtctgttagattcctcttggcctctctgtagagcgttccttctgtattagtctgttctcacactactaataaagacatacccaagactgtgtatttttgtaaaggaaagaggtttaattgactcaaagttcagcagggctggggaggcctcaggaaacttacaatcattgtggaagaggaagcaaacatgtccttcttcatgtggcagcagcaaggagaagtgcagagcgaaggaggggaaagccccttctaaaacgttcagatctcatgagaactcactcactatcacaagaacagcatggaggtaactgcccccatgattaaattaccttccaccaggtctctccatgatatatggggattatgggaactacaattcaagatgagatttgggtggggacacagccaaaccataatactttctttctgtgtgtggggcaggactatctctggaacgggggccttataagctcttatcagatgagataagtcaaataattaatgtctttatggccagtttttataccaaatggcagagagggagagggaaagttagactatttttaggttttatggctggcttgggggaaagggggctctggtttctatggcccaccttggggaagaggctgttgctgaggctttcattttggggtgtccagttctcatttctaccagcaatcttaccacatggccatcttccctctgtgtctgtgtccaaattgttctctttttggaagaacaccaatcacattgaactaggggcccacccatcctactccagtgtgaactcattataacttaattacatcttcaatgaccctatttacaaataacactacattttgagatactagatttaggacttcaacacatcttttgtaatggacacaattcaatctataacaccaaccagaggttttcttactgttttcctctacattttgaaacattttgcttaccaagcaaaatacattagtgaatatttgttttcctgttttgttttttttttaaatcagtcacccaaatgggctttctgttccagaagaagatggcactgagtcacttttctctgttgttaccctctaaatacaactacataccccgctaattagtcaatggaccatgatacaaggactctgaaagccgagagaaggaaggcagactggctgggagcttcaagacttgagaggtctggtgagtcccctaggtttcctttttatctcccacgtaccttcaggctgggcacccgatgggcctgcaacttggaaccaccaacaggaatagacaaaataatccaagagaagcctgctttgtccagccaaacgaaagggaaagcccagcagagcctgagttgggatcctgaatcctccttccacaaccagagtccctgcagcccgtctgatccaccagctgggctggcatcagccgagctctgtgtctccctgttctctgttgagattccacagtgtgcttccacccccagagagcaccagcaaaggctgagtgtgaaccccagcaataccaggagaacaaagaggaaaaacaaaacaaaaccagaatagaattcaaagggctcagaaaactaaactgtcattgatacaaatgcccacaaaagtcgaccagatcctatgaatcaaacctaaacaaggtgaagcctcattgaaacagaagacttaggatcaagaatctccagctgggcatggtggcacatgcctatagtcccgggactttgtgaggccgaggtgggtggatcacctgaggtcaggagttcgagaccagcctgggcaacatggtgaaaccccgtctctactaaaaatacaaaattagccgagcatggtggcacctgcctgtagtctcagctatctgggaggttgagtcaggagaattgcttgaacccgggaggcggaggttgcagtgagctgagattatgccattgcactcaagcctgggcaacaagagcaaaaaaccctgtctcaaaacataaaaaaatttaaaacaacaaaaaacaaaaaagagtctcctgacagaagaatcaaaatgtccaggatgcagtaaaaaactgcaccatatccagaactcagaatgtttttcctactctctactctcacacactcctcaacacaatgcttctgacactagatgtgtgagggtttctcctcacacacaaagcaagcaattctccactggacaccagctggatgtcccctaatttaattcaattctgacactttctacttggagatagcatcagatcccacaggttggtaactctaccaggttcgttgcccgatgcactgagacacagggttgcagcagagaaagaggtttaatcataaggcagccaaatgagggggaggaaacctcaaatccaccgcccagaggagtttggggccagaggtttttaggggtttggagtgggctgaggtctggggaatcactgattggtcgaagggtgcagggtaaagccaggagacagggagatgaagaaactgtattctcaagctgatctggttccctgttgtggggggtcttcaaactggtgggtgtcagccgttgctgctggaattcaggatctgaaaaacatcttaagcaattcataaaagccttatgattctaacatcagaagttccgtctataggaacaatggggatgaaaatagtctagtgcgcgactttcagttagcaagcagccccaagggagtgggccagagtgcagcctgaccaatgcttacttataactatatttctttttatttgtttatttgtttgttttttaattatactttaaattctaagatacatgtgcagaacgtgcaggtttgttgtatatgtatacacgtgccatggtagttggctgcactcatcaacccaccatctacattaggtatttctcctgatgctatccttccccttgcccctcatcccgacaggccgtggtgtgtgatgttcccctccccattatcatgtgttctcattgttcaactcccacttataagtgagaacatgcagtgtttgcttttctgttcctgtgttagtttgttgagaattatgatttccagcttcatccatgtccctgcaaaggacatgaactcatccattttccatagctgcatagtactccatggtgtatatgtgccacattttctttatctagtctatcattgatgggcatttgggttggttccaagtctttgctattgcgaacagtgccgcagtaaacatatgtgtgcatgtgtctttatagtagaatgatttataatcctttggatatgtacccagtaatgggagggtatttcaggatctacatccttggggaattgccacactgtcttccacaatggttgaactactttacactcccaccaacaatgtaaaagcgttcttatttctccacatcctctccagcctctgttgtttcctgactttttaatgatcaccattctaactggtgtgagatggcatctcattgtggtttttgatttgcattactttaatgaccagtgatgatgagctttttttcatatgtttgctggccacataaatgacttctttcgagaagtgtctgttcatatcctttgcccactttttgatggggttgtttttttcttgtaaatttgtttaagttctttgtagattctggatattagccctttgtcagaaggagagattgcaaaaattttctcctattctgtaggttgccttttcaccctgatgatagtttcttttgctgtgcagaagctctttagtttaattagatcccatctgtcaattttgacttttgttgccattgcttttggtgttttagtcatgaagtctttgcccatgcctatgtcctgaatggtattgcctaggttttcttctagggtttttatgattttaggtcttacatttaagtctttaatccatcttgagttaatttttgtataaggtgtaaggaaggggtctagttccagttttctgcatatggctagccagttttcccaacaccatttattaaatagggaattctttccccatggcttgtttttgtcaggtttgtcaaagatcagatgcttgtagatgtgtggcgttatttctgaggcctctgttctgttccgttggtctatatctctgttttggtaccagtaccgtgcttttttggttactgtaaccttgtagtatagtttgaagtcaggtagtgtgatgcctccagctttgtcctttttgcttaggattgtcttggctatacaggctctttcttggtttcatatgaaatttgaagtagttttttctaattctgtgaagaaagtcaatggtagcttatagcattactttgggcagtatggccattttcacaatattgattcttcctatctatgagcatggaatgtttttccatttgtttgtgtcctgtcttatttccttgtgcagtggtttgtagttctacttgaagaggtccttcacatcccttgtaagttttattcctaggtattttattctttttgtagcaattctgaatgggagttcactcatgatttggctctctgtttgtctgttattggtgtataggaatgcttgtgacttttgcacattgattttgtatcctgagactttgctgaagttgcttatcagattaaggcgattttaggctgaggtgatggggttttctaaatatacagtcatgtcatctgcaaacagagacaatttgactttctcttttcctatttgaataccctttctttctttctttctcttgcctgattgccctggtgagaacttccaatacatgttgaataggagtggtgagagagggcatccttgtcttgtgctggttttcaaagggagtgcttccagcttttgcccattcagtatgatattggctatgggtttgtcataaatagctcttattattttgagatatgctccatcaatatctagtttattgagagttttcagcatgaaggggtgttgaattttatcaaaggcattttctgcatctattgagatactcatgtggtttttgtctttggttttgtttatgtgatggattacgtttattgatttgcatatgttgaaccagccttgcatcccagggataaagccgacttgatcatggtggataagctttttgatgtgctgctgaattcagtttgccagtattttattgaggattttcgcattgatgttcatcagggatattggcctgaaattttctttttttgttgtgtctctgccaagttttggtatcaggctgatgctggcctcataaaatgagttagggaggagtccctctttttctattgtttggaatagtttcagaaggaatggtaccagctcttctttctacctctggtagaattcggctgtgaatctgtctggtcctgggcttttttttggttggtaggctattaattactgcctcaatttcagaacttgttattggtctattcagtgattcaacttcttcctggtttagtcttgggagggtgtatgtgtccaggaatgtatccatttcttctagattttctagtttatttgagtggaggtgtttatagtattctctgatggtagtttgtatttctgtgggatcgatggtgatatcccctttatcatgttttattgtgtctgtttgattcttctctcttctttattagtctggctagcagtctattttgttaattttttcaaaaaaccagctcctggattcattgattttttgaagggtttttttgtgtctctatctcctccagttctgctctgatcttagttatttcttgccttctgctagcttttgaatttgtttgctcttgcttctctagttcttttaattgtgatgttagggtgtcaatttaagatctttcctgctttctcctgtgggcatttggtgctataaatttccctctaaatactgctttagctgtgtcccagagattctggtacattgcgtctttgttcccattggtttcaaaaaacttattatttctcccttaattttgttatttacccagtagcaattcaggagcaggttgttccatttccatgtagttgcacagttttgagggagtttcttaatcctgggttctaatttgattgcattgtgggctgagacactgtctgttatgatttctgttcttttttgtttgctgaggagtgttttacttccaattatgtggtcaattctagaataagtgtgatgtggtgctgagaagaatgtattgatttggggtggagagttctgtagatttctattaggtctgcttggtccagggttgagttcaagtcctgaatatccttgctaattttctgtcttgttgatttgtctaatattgaaagtggcatgttaaagtctcccactattattgtatgggagtctaggtttctttgtaggtttctaagaacttgctttatgaatctgggtgctcctatattgggtgcatatatatttaggatagttagctcttcttgttgctttgatccctttaccattatgtaatggccttctctgtctttttcaatctttgctagtttaaagtctgttttatcagagactaggattgcaacccctgcttttttttatttatttttattttttattttttgctttctatttgcttggtaaatattcctccatccttttagtttgagcctatgtgtgtctttgcatgtgagatgggtctcctgaatacagcacactgatggtcttgactctctatccaatttgccagtctgtgtcttttcattagggcatttagtccatttacatttaaggttaatattgttatgtgtgaatttgatcctgtcattatgatgctagctggttattttgcccattagttgatgcagtttctttctttttttttttttttttttgagatggaggctcactctgtcacccaggctggagtgcagtggcgtgatctccgctcactgcaagctctgcctcccgggttcaggccattctcctgcctcagcctcccgagtagctgggactacaggcgcctgcaaccacgcccggctaaattttttttgtatttttagtagagacggggtttcaccatgttagacaggatgatctcaatctcctgacctcgtgatctgcccacctcagcctcccaaagtgctgggattacaggcgtgagccaccacgcccggctgatgcagtttcttcatagtgtcaatggtctttacaatttagtgtgtttttgtaagggctggtaccggtttttcctttccatacttagtgcttccttcaggagctcttgtaaggcaggcctggtggtgacaaaatctctcagtatttcttgtctgtaaaggattttatttctcctttgcttatgaagcttagtttggtgggatatgaaattctgggttgaaaattgttttctttaagaatgttgaatattggcccccactctcttctggcttgtagggtttctgcagaatgatccactgttagtctgatgggcttccctttggggtaacctgacctttctctctggctgcccttgacattatttcgtttatttcaactttggtgaatctgacgattatgtgtcttggggttgctcttcttgaggattatctttgtggtgttctctgtacttcctgaatttgaatcttggcctgtcttgctaggttggggaaattctcctggataatatcctgaagagtgttttccaacttggttccattctccccatcactttcaggcacaccaatcaaacgtaggtttggtcttttgcacatagtcccatgtttcttggaggttttgttcattccttttcattcttttttctctaatcttgtcttaacactttattccattaagttgatcttcaatctctgatatcctttcttctgcttgatcaattcagctattgatacttgtgtatgcttcaagaagttcttgtgctatgtttttcagctccatcaggtcatttgtgttcttctccaaactgattactctagttagcaattcctctagccttttttcaaggttcttagcttccttgcattgggttataacatgctcctttaactcggaggagtttgttattacccaccttctgaagcctacttctgtcaattcgtcaaactctttctctgtccagttttgttcccttgctggcgaggagttgtgatcctttggaggagaagaggcattctggtttttggaattttcagcctttttgcgctggattttcctcatcttcatggatttatctacctttggtctttgatgttggtgaccttcggatggggtttctgtgtggacatactttttgttgatattgatgctatttctttctgtttgttagttttccttttaacagtcaggcccctctgctgcaggtctgctggagtttgctggaggttcactccagaccctgtttgcctgggtatcaccagcaaaggctgcagaacagcaaagattgttgcctgttccttcctctggaagctttgtcccagaggggcactcaccagatgccagccggagctctcctgtatgagctgtctgtcaacccctgctgggtggtgtctcccagtcaggaggcacgggggtcagggacccacttgaggaggcagtctgtccctcagcagagctcaagtgccgtgctgggagatccgctgctgtcttcagagcaggcaggcaggaacatttaagtctgctgaagctgcacccacagccgctccttcccccaggtgctctgccccagggagatgggagtttcgtctataagcccctgactggggctgctacctttctttcagagatgccgtgcccagagaggaggaatctagaaaagcagtctggctacagcagctttgatgagctgcagtgggctctgcccagttcgaacttcccagtggctttgtttacactgtgaggggaaaacccctactcaagcctcagtaatggcagacgcccctccccccactaagctccagcgtcccaggtccacttcagactgctgtgctggcagcgagaatttcaagccagtggatcttagcttactgggctctgtgggggtgggatctgctaatctagaccacttggctctctagcttcagccccctttccaggggagtgaatggttctctcttgctggcattccaggtgccactggggtatgaaaaaaagctcctgcagctagctcggtgtctgcccaaacagctgcccagttttgtccttgaaacccagggccctggtggtgtaggtacctgaggaatctcctggtctgcaggttgcgaagaccatgggaaaagtgtagtatctgggctagagggcaccatccctcacggcacagtccttcacggcttccctcggctaggggagggagttccttgaccccttgtgcttcctgggtgaggcgacaccccagcttgcttgggctcactccccatgggctgcacccattgtctaaccagtcccagtgagatgagccaggtacctcagttggaaatggagaaatcacccacctgcgttgatctcgctgggagctgcagactggagctgttccttttcggccatcttgcccacgaccccagaaacattttaatcataactatatttctattccagaacccagcatgtaactcttgttagacctgtgaggacagtttcaggctgagagcccaatcccataggactgccccctgcatttcacatgccagtcacaagtattaatagtatgttgtcacttatacttctgactaactggctcttagtcacggattcccatgatctccatctggagtttgattaatttgctagggtggctcacagaactcaggtaaacactttacttatagttccccatttattataaaggattttacaaagaatccagatggacagccaggtggaaggggcttgtagcttccacgtcctttcctggcgtgccactcaccaggaacctccacgtgttcagcttctgtaagctctccaaaccctgtccttttgagtttttacagaggtttcataatgtagccataattaaatcattggccactggtgatcatctcaaacttcaggccctctcctgtcccccgaagtggaggatggggctgtgagtgccaacccattaatcacatggttgggtcccctggcaaccagtcacccatccagtggttatctagggactctccaaaaaccacctcattaacaaactcaagtgtggtcaaaaggggattgttataaataacaaaagacatgttcaccttacaactctggagctattctaaaactatttcagatccgaggacgaaaggtcaaatattttaacaaaagacaatcctactgctctagtcactcaggaaattacaagagttatgagccaggaactgtggacaaaatcaaaatatatattccataatattacgccttgaaacaaatgaaaacatagagaatctcagcaaaaaatagaaccaaacagcaattatagaacttagaaatactacaatcaaaataaaaactcactggatgggttcaacagtagagtagagatgacaggaatagaatctgtgaacttgagggtaagtcagtagcatatacacaatctgaacaatgaagagaaaatagactgaaaaaaaagaacagagcctcagatatctctgagacaatcacaaaagatccaacattcatatcattaaagtccagaaaataagggagaaagaacatggagagataaagaatgcaaagaaataatgctgaaaatttcctgtaggccaagcacggtggctcacgcctataatcccagcacgatgggaggccagggctggctgatcacttaaggccgggagttcaagaccagactgagcaacatggcaaaaccttatctctacaaaaaatacaaaaactcgcctggcatggtggtgtgtgcatgtagtcccagctacttgggggggctgaggcagaaggattgcttgaaactggtaggtcgaggctccagtgagccaagatcaaaccactgcgttccagcctgggtgacaaagtaagaccctgtctcaaaagacaaaaaaaaaaaaaacaaaaaaaaaagaaaaagaaaattttcagccgggcacagtggctcacgtctgtaatcccagcactttgggaggccgagggaggtggatcacctgaggtcaggagtttgagaccagcctggccaacatagtgaaacctgtctctactgaaaatacataaattagccaggcatggtggcatgtgcctgcagtcccagctacttgggaggctgagccaggagaatcgcttgaacccaggaggcagaggttgcagtgagccgagatcataccactgcactccagcctgggcgacagagtgagattccctctcaaaaaaaaaaaaaaagaaagaaaaaaaagaaaagaaagaaagaagaagaaaattttccaaaggtgtcaaaaaacataaaattgcagatccaagcagctcagcatacttcaaataaaatccacctagcataacctacaccaagacatatcataattaaatttctgaacactgaagacaaaggtcacagctggagagaagcaaaacatggcctgtaaaggaaccccaatgtgaagaacaggttcctcatcagaaaccgtggagtccagaaggaagtgacatatcttccaaatgctgcaagaaagacctcccaatcataaatcttatatagatggtgaaactattcttcaggaatgtaaggggaaaaaagacagtctcaggcatagagaaactaagagaagttgttgatagcagacctacctttaaagaattgctaacaaaatccctcaaaacagaaagacaatgataataaaaggctgggattttcagccttttattattccatttcagtaaaaatagaagtaaatattcaacatccattcattagtttctttgatcgtatttatggttgaagcaaaagttatacattttctgatatgtatgtagaggttatacctaggacaattatatttttgtaggtgtggaggataaaggaattaaaaggaagtaagctttctacccttcaatggaaatggtaagacattgacaccagtaagctgtgataatttacatatgaatagaatagtagctagaacgaccactacaaaaactatacaaaatggtatactaaaaatatatataaataaatcaaagtggaactctaaaaaacattcaagtaacccacgagaaggcagaaggaagataaccaggtaacaagaaacagggaacaaatggtaaacaaattaaactctaacaggtcaataatcactttaaatgtaaacggactaaatacattaattaagagacaggattgcaatgggtacaaagttataattagaaaggaagaataagttctgatgtcctattgcacagtagagtatctcaaaatagctagaaaagaggattttgtatgtgcctgtaacaaataaataataaatgaggtgatagatatgctaattaccctgatttgatcatcacacaatatatttatgtatcaaaacatcacattgtactccataaatacatacaattattatgtgtaaaaaatttttaaattaaaaatgagacaagattagctgagtagatttaaaaacattacccaatgttatgctgtctataaaaaactcaattcaaacataatgatatagctaagtaaaaagtaaaagcatagaaaaagatatatcacataagtattaaattttaaaaaggaagagtggctatatgaatatcaaggtagacttcagagcaaagaaattaccagacacggagaggaattttacatgatgataaaagatcaagatcaatctaccaacaagagatagcaaacctaagtgtgtatgcaccaaaaacagatctttcaaatacatgaagcaaaaactgataaagccaaaggaagaaattgacaaatctactattatagttggagacttcaacactcttttctcagtaattgatagaactactagatagaaaatccacaaggagccaggcgtgatagctcatgcctgtaatcccagcactttgggaggccaaggcaggagaattacctgaggcctgaagtttgagaccagcctgggaaacttaatgagaccctgtctttacaaaataataataattattttatttttggctatcaatcatgccacattatttttaattacatacaaagatctaacatgccatccagggaccattttacccactgctttgattggttgccaatctcttgtctctctcttcagcaatggtgaggcagataccttttccttggggaagagaaatccatggtatgttgcccttgcaaacaacaaaaatgttggaaagtcaagtggcaaagctgttgccattggcatctttcatgtgaaccacgtcaagagatccagggtgcctctctctgttggtgatcacaccaattcttcccaggttggcacctccagtcaccatacacaggttaccagtgtcgaacctgatgaagt

SEQ ID NO: 39 - DNA, 2018 bp, Homo sapiens
cctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaaaaaaaaaaaaaaaaaaaaaaaaaaa

SEQ ID NO: 40 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 41 - DNA, 4713 bp, Homo sapiens
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaaggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccgaaactatgttccaacttcctgtcaacaatcttggcagtttaagaaaagcccggaaaactgtgaaaaaaatacttagtgacattgggttggaatactgtaaagaacatatagaagattttaaacaatttgaacctaatgacttttatttgaaaaacactacatgggaggatgtaggactgtgggacccatcacttacgaaaaaccaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatctccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgt

SEQ ID NO: 42 - DNA, 705 bp, Homo sapiens
ctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccaca

SEQ ID NO: 43 - DNA, 2566 bp, Homo sapiens
ctcgcctcagtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccgctctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagagggcggcgaagaggacccgcaggctgcaaggagcaacagcgatggcagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaaaaaaaaa

SEQ ID NO: 44 - DNA, 484 bp, Homo sapiens
ggcagaaacccggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggtttttttttttcctttcaagatgttttctatttctaaattaaagtaatttcaaagtaaatgaataaaaaaaaaaaaaaaaaaa

SEQ ID NO: 45 - DNA, 1234 bp, Homo sapiens
cggcaccgtaggtgaagccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggacacttggagaccagaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattaaaaaaaaaaaaaaaaaaaaaaaaaaaaa

SEQ ID NO: 46 - DNA, 595 bp, Homo sapiens
  misc_feature 246, 247, 255, 327, 328, 367, 549: n = A,T,C or G
tttttctgcgaatgactttattgcgcgcgtttcggggagcgggccgtccagggaaggaagcaaagcgggaacgcactgcaggccccatccaggtgagcccctcaggggccggcgccccggggcacgatctcggggccttgggttggctcggatggtggcggctgccgctgccctagccgttgtcgctcctgctgaaggatgcctctgttggccctggaggagagggcacctgggtggttggtaaanngggatccnaaagtgtggttcctggacagggagcagggagcagaatagagcagggacagacctggcccgtgcccggccttnnttgtaaaggctgggatgatcccgatccttttcatcattnaagttaaagggtgcattctgcttcaccttcctgaagcattgtagttgggaagcccatgcccgccacatgaagaagaggggcagtacccacacttggtttgtttggtttttttgtttgctgctgccttcactgggcccccctgtggcctaacgctgtgaactggaacaatcttgcttgggggngggggggtgtccacgaacttaagtttttagggggggcaaactttga

SEQ ID NO: 47 - DNA, 1100 bp, Homo sapiens
  misc_feature 1100: n = A,T,C or G
ggcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgttagaagttaaggacatagaaattggtcatgtcacaagcaaatgtgtcgagagcaaaggcagtccgagccctgaagaacaacagtaatgatatttgtaatgcgattatggaatttacaatgtaccatatgaagcaacttttcctggtgtctcaaggaagtactgcaaccttggttgaacattgtactgttctatcataaattacagttatggcttctgttcggatgaaacaacaacaacacacacaacacacaaacaccaccacaaaaacacccgttttttttgttggctgtaacaaactattaaatagaacaccagctgacaagactgtcttgaggcccactctttttgacgagagagcatatggcggcccaataagagagagtaaactaagggttagcaaacagtacagagagaagacgagacaccaagcgacatgatgcaccaaaaggagacaacacatcaacggacagaccatgaaactcatccaacacagactacacatatgaatcagcaactacacataaaagcagagaagagcaagactagatatcaagn

SEQ ID NO: 48 - DNA, 1128 bp, Homo sapiens
gccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattacaaaaaaaaaaaaaaaaaa

SEQ ID NO: 49 - DNA, 579 bp, Homo sapiens
tctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataactctagaaaaaaaaaaaaaaaaa

SEQ ID NO: 50 - DNA, 150151 bp, Homo sapiens
gaattcagaacagttaaatgtagattatcccttcgttatatagagttacttaaactaaagaaacattttaataccatgtagaaatacttaactgggtcttaactgaatctatgaatataatacaaatatgaatttatatatgatgttgctaaaggcactaagctaaaagcaattttaaatcttgaagcctgggcatggtgattcatgcctgtaagcccagcactttgggaagctgaggtggaagaatcccttgaggccaggattttgagaccagcctggccagcatagcaagtccccatctcttaaaaaaaaaaaaaaaaaaaaaagactctccatggcggcttgtgcctgtagtcctagctgctgtggaggttgaggtggaaggatcacttgagctaaggggtttggggttacagtgagctatgattgcaccactatactctatcctgggtgacagattgagaacctgtctcaaacaaaaagaaaaaccttctcgagatgattactttaaattttcttttgctatcttattttctacttctgacatttttggacataatggtcaccatgcctttatttgtgaagttttctataactgaacttaaaaaaaaaaaaaaacttggtttattcctgtaagatgacaacaaattgaaataagttcaaatgtaaggcttcttttaaaacatgaacaaaaattcttttttcacattattaaatgtatatttcttcttcctcaaggtgactataatgaatataaacaaaatttcagtgtccttttaaaaatgttttaaattgttatacatttagaggaaatacattaaaatgaattcagtatatatgagaactgaacatctatacttttaaaactacaatatccttttttggaatgccaaagtttgtttttatctggtatactgtaatgaaacactcgtcatgtttcaaattcaggtttttggttcagtgaaacagtaatttaaataagcgaggtttttttttttaatggggattatgttgatttttatagctttttattacaaggaattctgaacatgcaggacttgaactttctcatgtagtagttctcagactagagaaacctttcctgttttgtggcttgggttagtgtttagcagtatttttagtaaccgtcctaagtcagtagctatgtaagcactgagtgaagatggagtcacagggcaaactgggcttgcttcccacagggagggctgggttttgagcaggaaggaaggcctgttcagcagtgccttgggtacaactatgtctgagtaggcagccggtaacacaatgtctcccttgtgcaaagtaactctcttagtgagtgctcagatatgtgaggaaaaagtatttgggtaagtgaagaagcttggggtgtttcaaagagattcttttcgtgtttttgtggtatttgggtttaagggagtgtactgtttgttgctgcaaactactggctttgttttcagtggcattttagactttttgaacaagctcttactgcaggcagattgaagcgtcttactttccgaaaatgtgagcttaattttaaaagtgtgatttgtttgtgatgaaaagttaatttgtgcttcttgagatcagtgaaaattaattgtagcagtcctttataggaatgagttctcttaaaaatctgctgtttcctgtcattttcattctgaaatcagagccaacttgtgacagtgatgaaaaccacctaaaactgattatgagtgtttaaaatgtataatgttgatttcaaggttaatttgcctgttttaaaacagtgtggcagttaattgtttacatgactgtaatgtaaaagtattataatttacttcattttgaataatattaagttcagttttcaccagaagaactggttatgcttttagaaatcttgatattgtgattaacataaatggctgatatttttaaactattatttttatttgatttacagcatttaattatcaagctataagagtcaacttttatggagtatgtacatgtttatagtcttttgcttttgaatctgtctagtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcaggtaattactgttctgacttagatttcatttgctgtcctctgattttgaattataattctccctttcccagaaccctcaaaaaacctgtttttgtctggtttgtttttagaggcaccaaaaagcacttcaagttttatgtggtactaattggaataatatgtctaatttgttctttttggcccaaatattttttcattagttttatcttaaatataaatactctatttatatctgctttttggacttcaagttatggtatgattttctagctgtcatttggaaatgattaaatgttaactgtgttaaatttcttagtttttccaaataatatttaaaattagtgccaagtgattggtcttttgctcatgtaataagttaaaatttaaaaattccacaagtaccattaaaaacagaagaaggtactgtttagtgctgaaggtactatttagtcttttctttttcaaagtagaggatagtctttaaattggtcagatcttattttgtaatgaggctccgtagtcattcaaacctggaatcaaaacctgacctggcgcagattagctttgcaagcttagataatttatttaaaccgtctctgcttcactttactatctttaaaacataattaataatatctttatctcagtgtttgagaatcagggataaaagtgcctagagtagtgtctagtttacagtaggcactctgtggaagttattagtttttccttttcactttcttatctcattccacagggatttcaggtcattttggagtgcatttacaatacaaatagtacaattggtttaaagaaataatggaagaaaaacatggtgttgtgtagttcctaaagtgagggaaaaaattgattctaagattctttgcagcaaaagcaaagaataaaatttgatttattacaacatatacagtacgcataagataaaggatgtgtttttttcctgaattaatttgtcagaaaagttaagcaacattttcaaacaactgtgttccttggatgtcagcagttgtaagaaaagagagggtccctggtcaaattagtatgagaatgaatagatcataaacattttttaaatggtggactcaattgtgcttttgtgtataaatatagtactgtgattttgcaaaaggtggtaaaaaatataatatgtagccattttccaaaacatatgatcacaaatcccttctacttagtgtattttaagggactatggtgtggatcatccacatgagtgattcttactgaggagggaaaaatgcacagcattcttaggggttgctaatttgactgacttagcacagaacttcccaacaattgggctgaggtacactggtttgttgtgaatggttatagattgatccgtttattgaaactctcaatctttggggtgttggtgctggttttgagacacctacatccacctcagcaagttatggaatgggtggtacaaaaagaaacctcctctaagacgagccttaccccagcataccttaaaactattaatttctctctgtgccttaatattagaaaggtttgggtatactagccccagggccttttcaatattgcatgtgcaaaagtcctgtttccattctaaaacttcctgagtattgcttcgctttcttctgtcccttaactcccgttattattgtcattagttataggatcatgccttatccgtaactcaggggtgttgggaagactggtggttgagaactaatacatccactcatgttctcatcgtaatactgctctgtctttttacctggcctaatcttcctctcttcttttctgcccagacctcctttttttctacaccttttgatatgctatctggaattctctcatatcctagcaaactcacattcttcatctcttcacctacattctcctaatcataactgaaacctagctctttcccaaatatactacttccccagtaacatttttacaccaaagattcttattttccagtcaccctaatacttcactgtttagagatggggtttttgtcctcatttctcattgtcacttctaaaggaagtgattgtaagtcccattttttgagacttagggcatttggctgtatcaactcttctttactggttcctacctggagcttacaaaaggcttggcccttagcccactttccctctttattataagctttgctgcagtcctgagtggctgcagtgttcatgtacatgagtcatttaaccctctgtttgcttagtcctgtaggacagtggtctccaacctttttggcaccaaggaccagtctcctggaagacaaattttccacaggccatgggtgggaggttgggggatggttttgggattgggatgaaactcttccacctcaaatcatcaggcattagttagattctcataaggggtgttcaacctagatcccttgcatgcgcagctcacgatagggttcgtgctcctatgagaatctaatgctgccgctgatacgacaggaggtggagctcctgtcagataagcaggaatgcttacatgcatgccctctgcttacctcctgctgtgtggcctggctcctaacagaccacagactggtactggtccctggttaggggcttgggcaccccagctgtgggattttctatatacaagatatgttatctgcaaatagtttttaccttttcctttccattttggataaaaatgtctttttatcttttgcataattgctatggctacaacctctgttgagtagaagtggtgaaagccaataggtgtgtcttgtttctgatatggggggaaaataaatattttaaatattttattgttaatgtgatgttagctgtggattttaaaagatactttctatcagtttgaagttcccttccattcatggatagttgagtgtttttatcatgaaagggtgttggattttgtcaattactttttctgtgtctatggagataatcttttttttccgctttcattctactaatgtggagtaatactttggtatgttgcgtgttgtgttggtatgttgtgtgattcagtttgctagtattttgttgaagattttttttgtgtgtgtatgtgtatatatatatatatatatatatatatatacacacttaagaaatactggtctgtagttttgttttgtttttcttcttgagatatccttgtcttgttttgatatcaggaccacacagattgaattgggaagtattcctttcacttctacttttgggaagagtttgtgaaggatttttgtgaattcttctttgaatgttttgtagtattgaccagtggagttatttgggcctgggcttttctttgtggcagttttttggattgctaatttaatttttatagatattctgtagatgtctttttggtcttgttggtttataatgttgcttaaatcttctgcttctcatatatctctaattgttctgtccattattgaaagtgaggtgttcaagtctccaacttcactatatattgtagggaaggtgtgttagcaataaattctctgtttttgtttatctgggaatgtcttaatttctcttttattttgaaggatagttttgccagatgtagacttcttggttggcagtgttccttgtaatatttcaactcccatgctttctgatgagaaatcggctgttaatgttactgagcgtgtcttccacatgatgagtccccccgccctgccaccaccaccccccccagctttttttctgcattaaggattttcactttttctttggctttcaacagttaaattataatgcgcctctcttttagtttatcatatctgtagtttgttgagcctcctagatatacagattaatgtttttcatcaaatttgggacatgtttggtcattagttacgttctttctgcccctccccacttcgctctggccacttaactacgggaatgtatgagcatcattccttgcttgtcacaaaaaatttgaaaaaaaaaaaatacaaataatgtgaaaactacttaaatcagatttctccctggccaggatttgttgttgtgtttttttgtggttgtttactgacttttctagacagattctgtaaaaagtctgtattttaaaaaaatatttgacgtctttgcttggtttgattagtggtcagctaatggttggatggagatttcattgaatgccttgaactagtaagtctcccagcctccaccagggggctctgtgtgtttgcttaggcacacctgcagtccctgtaagtagtttgcagcttaggcacacctgcagtcctgtaagtagtttgcagctctgccttggccttcacttcctgcttgtttagagtttcaaagtcagccaaaggtggaagattaggggattctctggtatttccttggcatgtacatacacagcctatacatgtatatgttcttctctattcccaagactatattggagcatttcaaagcctcttgtggacatttctttcctcaggttttccttttatgatttttggtcagcttcttgtttgtcccaattgatattgccatttcaggcagctgagattttaagcagtgcactagggataagggaattaccgaacaagctttgaatcagctcaaaccaactcctgagaatgggctttttctagggagcggccagggagatcaaatcatagcagttctttgggagtggtgctttttggagagttctaaacccattttgtcccccaatctctagtgactgctggatttcatagctgccatgcttgttgtaatgcttttggttctcaagctaccacaaaggtaaggagatgggtgtggctattggataaattaaaatgccacagagcttgctgtttctttgagattcagcagtttttattgattaaatgctccttagttgttgcaagcatttggctgatttctagagttctgaaaaagttgattttgacaaatttgccagtgttcttagtgctttaatggaggaatggagttttagaaatctctgttattctggcagtgtttctcttcatttgtcatgctttatttttctttctttccttttaactaatagattttattttttagagcagctttgggtttacagaaaaattgagcaaaaatagagttctcatatgctttctcaccttccattagatacagtttctcctatgattaacatcttgcatgattgtattataattgatgagtcaatattgatattttattattaactaaaattcatagtttatattagggttcactctgttttgtatatcctatgggccttgacaaatgtataatgccataccattacagtatcatacagaatagtttcactacccttcaaattctgtgtgttccacttattcatccctcccttcttttcctgaactcctggtaaatactgatctttttgctgtttctacagttttgccttttccagaatgccagagagctataatcagatagtagatagtcttttcagattggcttctttcacttaccaaaatacatgtaaggttcctctatatatttttgtggcatctcatttaaaaaaaaaaattagccaggtgcagtggctcatgcctgcagtctcagcactttgagaggccaaggcaggaggatagcttgagttcaggagttcaggaacagcctgggcacatattgagtcctcgttttgacaaaaaaatcaaaaaaattagctgggcgtggtggcacgtgtctatagtcccatctacttgggaggctgaggtggggggatcacttgagcccaggaggttgaggctgcagtgagccgagatcaccccactctccagcctggacaacagagagagaccctgtctcaaaaaaaattactgaataatattttgttgtatggctgtactacagtttgtttattcatttacttactgaaaaacatcttggttgcttccaagttttaacaattattaataaaactgctgtaaacatttatatacagatttttgcacgggcgtacatttttcacctcattttggtaaatatcaaggagcactattgctgggtcatatgggaagcatatgtttaatttggtaggaaactgccaaactgtcttccaaagttgctttacccttttgcgtttccaccagcaatgaatgagaacttctgttgctgctccatatcctcatcagcatttggtactatgctttggacattaactattaggtatgtagtggtatttcaatgttgttttaatttgcagttccctaatgataaatgatgttgaacattttctcacatgcttatttgccatctgtatatcttctttggtgatgtgtctgttcagatctttgcttatttttattttattttttataatttcaacttttactttagattcagtgggtacatacgcaggtttgtatcacatatacatggatatattatgtgatactgaggtttgggatacagatgatcccatcacccaggtagtgagcatagtacccaacaatttttcagcccttgctcctctttccctcccctgtctagtagtccccagcgtctgtgttaccattgttatgtctgtgagtacaatgtttagctcccacttataagtgagaacatgtggtatttggttttctcttccagcgttaattcgcttagaataatggcctctagctatttgcccattttaaaattgggttgtttattctcttgttgagttttaagagttctttgtatattttagataccaatcctttatcagatatatgttttgcaaataattttttccagtcggtggcttattctcttgatagtactttttgcaggacagattttcaaaaatttttaacattttcaacatccattttttctttcttgggttgcacttttcatgttatatccaaaaaactcattgccaaatccaaggtcacctggattttctcccttttcatattataggaattttatagtttcgcattttgcatttaggcctttgatccattttgacttaatttttgtgaaagatttaaagtcattctttttgtttgtagatgtccatttctagtctcatttgttgaaaagactatcttttatactctgttttgaattgcctttgctcctttgtcgaagatcaattgactgtgtatatgtgggtctatttctgagctctctattgtattcagttgatatgtcggttcttttgccaataccacacatgccattttgatgactgtagctttgtatagtaagtcttgaagttgagtagtgttaggccttcgactttcttcttcttcaatattgtttcggatattttgggtcttttgcctgttctaataaagaatttagaatcaccttgccgatatcctcaaaataacttgctgaaattttgattgggattgtcttaaaatgttaccacaaacataaaaatacgtacatttaacttttagtataaagtttttattaatggtgatgaaacactaatgattttatgaaatcaaaactgtgactcaggttacataagaaatgaagaagaaaaatctccccaccccacacacatacacacacacacacacatacacaagtatacacacacagatatacaaacatctgcacttgccagtctaacctataaatcacaaacttttagattagcatgaaatcacacatcttagtaatcaagaagttctgttgggagtgggaagaataaagttatttgtaagtatatgggtgtagccatagaatttggagaaattcctttaaaactgcattaaataattatgcaacaatgatttgtatgcttgtgggtttaatatcaggttctgctactgtatgtgaattcagtttaagtgggtaaagacggttatctcttcaagattcttttctctagtttgcatctttttttttatcttgttgattttattggcagcacttaaagagcaaggttagataatattggagacagtgggctttcattctcatgcctttgaaaccactgaactcatttttgccttcacccatatctctaatggttcatttcttcatatttacctgcctgcctgggctatgatcggccacataagatctcacttcactaacacatggctactagcattctagtgtgttcatgccacagcagctttgcagtcttcatgttgctttcactaccggagtttctgttagaaattcatgaatgttaaaatttatacagaggtacaaatgtatcaacttaatgtgggggattatggccagtaattcccccttcatctcttattttttattacccttcttacacatttgcccctggatttgtgtctttagtcttagaaagtgattttacctcccattctgagatttattttttaatgtggaaactgcatcatcttctcagaatctgaaatctcaaattctgagattaaaatcttcattatctttctgtcccgtgttcccgctccctcctatcttcatagtctccttttattttctgaaaataatccctgttatatatttgctttctgttccatctttccctctttctgtctcttagatttctctgttatattgatttttttccccagaaaacttcatgtgtttctcccagtgggattttatgtcacttttaatttattgtcagatggtttagcaacaaatacatagatgcaaagcaaatgtgtcaatattttaacagttggtaaatataggtgaagggtatattgttgttcattgtagtattcttttgatacttctatttcaagaaatgtttcaagataaagaggttggaaacttaataatattatagtaagtcatttttatttaatatttactatatattatgtattagtccaagcactttaacatatattacctcatttaagtcttatactaacctaaggagacaagtattgttattttgcccattttatagattaggaaatgaagcatagagggatttggtaacttgccctgtgtgttgtgtggctagtaagtggcagctgaatttggactcagatcatctatgcagataatattaaaattaataagatatggctctgttttcaaagggcttacaatccaattagagttgaaaagtatataggtttctttatgctgtgaaacaaattaaggatcataaaatgatagttttatctagttgaggggatcaggaagggcttctgaagaaagtagcatttcagtactaagagaaaatacagggttaattttgaatctcatggtggaggtatttgaaatgcaacctaaggcatataaactttgttcaatgagcagtagagaacattgagagttaaagaaactatggcccaaagataataaatattttcaacagctagttactgtcagataggatttaaacctaaatctgaggtgagaggtggctattgtggcttttctagatgtcagttctttgtttcagttagtgaacaagacttgttgactcttccttaaaacattttaaatttattagttccatgcatttggatcacatttatgtcaatatatgtccatattccatacctgattctcatggcgtagcctgcagaccagtctccttcagtgtattccctttctaatgctctctcacttgacaaaataagaagtaccttttaatttgattattagctattcagattatagttctaaagcagtgcttttgtcatgtgacagctacagaattttagaatcttggagatataagcttttaaaaaaaattctagtgggtaaaatacatgttccttacccattcagtgcaaaaaaaaaaaaaaaaaacaagaacaacaaaaaaataaataaccaaaaaaaccaaaaactcagatgcaaaggaaaagagtacacagttcattccttcatagagtttgtaatttggcctgaattgcaaacaaagtatactgtaataaatactataatgggacacagtacaggtcgctataaaaacacctgtggaagtgccaagtcctgccttaggggatttaaggaagtgttctctgaagtagtgtcagctgatttaagatgaagaggaattatctagatcaagtgtgcacagtggagggcagaatggagagactgacaaagactactcagaggttgtgggtttggagatgagattgtaggatgctttgggaatctcaggtaattaggtatgaattaagaagtcactctgggcccggcgccgtggccgacgcctgtaatcccaccactttgggagggcgaggcgggcgaatcacgaggtcaggagatcgagaccaccctgtgaatggtgaaacccccgtctctactaaaaatacaaaaaattagccgagtgtggtggcgttacttgtagtcccagctactcgggaggctgaggcaggagaatggcgtgaacccgggaggcggagcttgcagtgagccgagatcacgccactgcactccagcctgggcgacagagcgagactccgtctcaaaaaaaaaaaaaaaaaaaaaaaaaaaatgccgggcgcggtgtctcaagcctgtcatcccagcactttgggaggccgaggcgggcggatcacgaggtcaggaaatcgagaccatcctggctaacacggtaaaaccccgtctgtactaaaaatacaaaaaattagcccggcgtgctggcgggcacctgtagtcccagctacttgggagactgaggcagaggaatggcatgaatccccgaggcggagcttgcagtgagccgagatcgcgccactgcactctagcctgggggacagagcgagactccgtctcaaaaaaaaaaaaaaaaaaggaagtcactagtcactgcgggaggcaggtgtgttgagggaagaagatgaagaataaataggattcaggctgtctgtggcatcataaaatcaacagtttgtaaatttctaaaaatctttttcttgggttaaaagaaagttgggcctgaagtacttaatgagaagtagtttcagagaaaaataatcttgtaaaaatcgacctcatactgaatatttgagaattcagagatgtgggaatatttgttaaaagctagaaaatttggtagaaaccatatttctacgttttcaatatggttgaaatttaatgcgttggaatttttgcacatttaatgcattatgaatttaattttaatcttgattttaaaatagccattatattggagataatattttttcaatgtcttatttcttgaaattttgctagaagttgaagaccagcctgagcaacccgtctctacttactaactagccaaccaaatacacacacacacacacacacagagagagagagagagagagagagacagagagacagagagagacagacagacagcgagggcgatttcacatatattagaagttctcggccgggcatggtggctcacacctgtaatcccagaactttggcaggccaaggcgggtggatcacctgaggtcagaagttcaagaccagcctggccaacatggtgaaaccccctctctacaaaaatacaaaaattaggcatgatggtgggtgcctgtaatcccagctactcgggaggttgaggcaggagaatcgcttgaactccggaggcagaggttacaatgagccaagatcgtaccattgcgctccagcctggatgactgagcgagactctgtctcaaaaaaaaaaagttctcctcacagtttaagaaccaactggaattaaggtagcaatttttaaattgctataactatgacttctggttaaaatattttgctttttactcccatgaaacacattacttttatttttttccttattcagcatgtatgttattgtatgaaactgaagggaaatgtaaaaaattttagagtagttttttttttttttttttttgagacggagtctcactctgttgcccagcttggagtgtagtggtgcgatcttggctcactgcaacctccgcctcccaggttcaggggattctcctgcattagcctcctaagtaactaggattacaggcacgtgccaccatgctggggtaattttttgtatttttagtagggatgaggtttcaccgagagtagatttttttaatgcactgtaagattaggaaatatgcggtatatataaaacttttataaaagcttaagtaacctttattggaaaatatgctttattagtaatataaaaacaaaaaattcatcttaactgcctgttgagactttcaagaaatgggagtccaaggatgtatacaaactgagagttaatgttggtagcatcgttatggggctaaaaaaggtgtgcaatttaagaagttaaacaaagttaaaaactaatgaacaacagtcagtgcagaaaaggaagaataagtttaactttttcacataaagtctttccagagtattgtttctattccggtgcctaaagaaggtttattcttccagtatgtaaaatacacaaaagatgggggatacagaagataattgttttaataaactacagctgattgcgccttttgtggaaacacatcagtgactgaggtgagtggaagtcagagccatggtgataatgataagtgatttgtaataatcactgcaataatttcattatctttatttctttctgaaattgtattgtatatcttttccctccaccttcttccctgcccttccagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcaggtgagtacataatgaacatttccagctctgatattttgaattgcaaaatggattgactttagttttttttaaaaaaatacttactgggtttctcatgtctttttagatttctgtagaataatgcttgtaaatagtatatagtagaaagttttgtggaaaaaacctgtgggatattgcatgagggtctcattacacagtccctggtatttatgagttgtgtgatatttggtaagccaatctctgcttctgtttcttcattttcataatacctacattataaggttgttgagagaattagaaataatagttgtaaattggctaatccaatgcctgaaacataggcattcagtattcagtgggctgctactatgatttcagctaagtgacaaataagaaacaacaatttttgctttacataatgatagtcatataattcagtttttgtttgggatcttcaagtttaatcttctcctgtttttttttttcttttcttttttttttttgagaaaatctagactcatagcagtgatgtcacttgtccaaagccacaggataacctgatgttggatcctggcatctgattcagtagtatttactttgttttagcacttacagacaaggtcagatgtatagcagaaaatcaaggaataaaatactaattttaagtcatagatacctttcgtttggttttaaatctgtatttgtactttgtagaatagccaactttagcttaaaactacagttaagaaagaacagcctgacttctctctgctgctcagtttgctttctgtcttagaattcctggtggccatcaaaacaaaacatgcagtatatgcacacgaaaggctagttgaagtgaaatttggctcctgtgttagaaatgatggttaatgtaaatattctgttaaagtcaggtaaattgttttctgttactcagggatcttctgtactacttctctccattcttgtggatatttgactactgttttgaaaagaaacttttttgagctaaggaacaaaagagtggagaatcctttttggatatgagattgttaacttctcttgaggcagaaataaattatatgattgaattatccagacattgagcttacagcctagttcaactgtaactagaaaataggcattggtatatagtgtttttctgttggctggtctggggagatgattttttgattaggagttttagtgtcaaagggaagaggtggtagggaatggtgggaaataggtaaaatatgtcaaatatccactgtgagccagtcattgtactagctgtaccacgtaccatcttttgtgtttgggtgttttgccctgaatcatgaagcatgactaaatagcagctaataagaccaggccacttctaataatgaaaaaagtagcataattcaggtagtagtaggtgaattggtaaccaatgattggtaccataaaaataaaaaagtgttttttgaggttctttgtgtaaagttgtaaatctcttaatggttcttttctgtcattatggcctctgaactcttaggtactacacacgggtaaaattgactttattttttgtttatgtgatgacagcaaaattatgagaagaaaattgcaaaatctttgtaggtcatctttaaagtttcccaaatgctaatagaagttaaaagatgactgagttcaaaatttcatgtcattgcctctttaaatttgtttctaatgtgactgaatttaaaaaaaacaatgtgatacgtatatatagttttcaaaaaaattcatacactattcgaaggcttaatgaaaaaaacagtatgtctggccccctccccacctcagtcaacctgttctcatctgaacaggttactgtccaaagcttctctagagctgtcatgcagggacttacttttgccataatctgggactggatccattctttcgatagcatgtcttctttcttcctagtttattctctcactttgctggaatatatctttaatttacttcctaagagaggattaatgaatggcacactgttttagttacttcattactgaaaatctctttatcctggtctcacatttgattgatattaataagtttggttggtatgaaatagtttcgttgtaatagaagagagttttcccttagaaatttgagggcattgcttttctaggatcttatttagccgttgaacagtctactacattctgatccattgtacattgtgttttgcctgtttttatctctggaatatttttaatcttttatttctagcattctgcagtttcacagtaatgtccttggacttgagttttgttgtagttggttggttggtttccacttgatgttttggcatttagtaggctctttggagattaatgtagtgtgaaatgttcttgttatttctgtgattattctctttcctttattttatctgttatctttctggaatctttagtaatcagaaactagaatttctgaattgaatctccttacctttttattttttgttatacgtttttctttttctttgggtttggttatgtttcctggtatattttctcgacttgatattccagctgtctgtttttatttaactgtttatcttggcaatcatattttcaatttccaagaacttttgtgtgtactattccttattcatatcattcaactgttttttcaggaactatggtaagtagagagtttctgtttgttttgtttcattttattgagaattctttggttccctgtattctttctctttttaaatggtcattttgttttttatgcttattttgatttctctttcttctggaatatttattcaaatttataatgattctttgttgtttattcaggactttgtacatggccatgcctgtcaactggctggttttactttatggcattgtgtggatatcagtggaccctcagcatctactgagtgaaggttttttccttcagaggtggttgtaatttatccaaagaagaaacctgattttatgctgggaataaagtagaagactgggaaaatgttttttttttttttttttttttttttttttttttttttttgagacgaagtctcgctgtctctcaggctggagtgcagtggcgcgatctcggctcactgcaaactccacctcctgggttcacgccattctcctgcctcagcctccctagtagctgggactacaggcgcccaccaccacgcccggctaatttcttatatttttagtagagacagggtttcaccatgttagccacaagggtctcgatctcctgaccttgtgatctgcccacctcggcctcccaaagtgctgggattacaggcgtgaaccaccacgcctagccaaatgttagtttcttacacagactttcaattcattcccacatttttaaccttaaggggtcataaatgtatgtttttctctttctggcaaaatgggtgataatgagaacaagacaaattcagaaggttggacattcagtaagaaaagttgagatctctttggcttcttagtgtcctaaaaagatggtgggggaaggtgatggtgctacattaaaaaaaatgtaaaggacaagtagatacagtgtgaaattttgaattgtatattgatttggacagatcagctataaaggacatcttggattagttggggaaatttgaacataggctgtatattagatgagatggaaatttactaaaatggaaaggggagattgttgactgaaaaaagtaggttataaggctgtatgtatattatgatcatttatctatctatatctacatctgtatatttctccagagggatatgctctaaggtgttactagtgatgattcctggatggtaagaatgtaatttcttttttgtgtgttttttaaaaaatctcttttctcatttctaattctccacgaattattgtttctggggggaagaaaaggttttttaaaaggtatgtgccttatccagtgatcagttaattaactggatatgttaaaaatgtagtatgctcacactgcctgactccaaactatattacaaggctacagtaaccaaaacagcatggtgctggtaccaaaacagatatatagaccaatggaacagaacagaaataatgccacacatttacatttacacacatttacaaccatctgacctttgacaaacctgacaaaaacaagcaatggggaaaggattccctatttaataaatggtgttgggaaaactggctagccatatgcagaaaactgaaactggaccccttccttacaccttatacaaaaattaactcgagatggattaaagacttaattataagacctaaaaccttaaaaactctagaagaaaacctaggaaataccattcaggacatagacatgggcaaagacatcacgactaaaacaccaaaagcgatggcagcaaaagccaaaattgacaaatgggatctaattaaactaaagaacttctgcacagcaaaagaaactaccatcagagtgaagaggcaacctagagaatgggagaaaatttttgcaatctgtccatctgacaaaggtctaatatccagaatctacaaggaacttaaacagatttacaagaaaaaaaacaaccccatcaaaaagtgggcaaaggatatgaacagacacttctcgaaagaagacaattatgcagccaacaaacatgaaaaaaagctcatcatcactggtcattaaagaaatgcaaattaaaaccacaatgagataccatctcatgccagttaaaatggcgatcattaaaagtcaggagacaacaggtgctggagaggatgtggagaaataggaacacttttacactgttggtgggagtgtaaattagttcaaccattgtggaagacagtgtagcgattcctcaaggatctagaaccagaaataccatttgatcccgcaatcccattactggttatatacccaaaggattataaatcattttactataaagacacatgcacacgtatgtttattgcagcactgttcacaatagcaaagacttggaaccagcccacatgcccatcaatgatagactggataaagaaaatgtggcatatatacaccatggaatactgtgcagccacaaaaaaggatgagttcatgtcctttgcagggacatagatagagctggaaaccatcattcttagcaagctaatactggaacagaaaaccaaacactgcatgttcttactcataagtgggagtttaacagtgagaacacatggacacagggaggggaacatcacacaccagggcctgtcggggggtagggggctgggggaggatagcattaggagaaatacctaacgtagatgacaggtcaatgggtgtagcaaaccgctatggcacatgtataccagtgtaacaaacctgcacattctgcacatgtatcccagaagttaaagtataataataataaaaaaaaaatgtaggatgctagagaagaggcagaagacatagatagatttagggcaggttgtcaaggaccttgtgtgccataaaggtagctggggcattgttctgttggtagtagtaagccaaacaagcgacttggccaaattgttatttttttaaaaaaattactgtaagggatatgtagaaaatgaatagcagagggagtgacttaagtcataatatttaggaggctgttgcatccattcaaattttaggctaaagtcgttaaatttatttggacattcttctaggttctctgatatacattatctctagtctgaaaagtaggtaatattggcttcaccctcatagctggaaagggtgaggctcagaaaactaattagtgatacaaccaggatttttttttaaccctaatctatatgactccaaggcctgttgcacacagtggtgttctagaagataccttgagggacagcagggagaagagagtgtgaaggaaacatacaacactaattctaccatcattctgtgtccccttagccaaacccaagcaaaggaatctttgttttattaaatagtactgtttaagagttcacttgaaaaaagttctccctgcacacaaaattttaaaaaattgtaaaccattatatttggcctttgatcttttatttgtggttttactcaaattaagattactttatagtttaagcatctcttttgtgtacctcattctactcatcacaacatcattatgggataagaatgacaacagtagtaattccattttaatggtcagaaaactaagactgaaatttaattgtgctttgcaagatcacccagttgcatattaatgtagagtgcattttaaactcagggctttttaattattttagcttaatacctctgtatagtttattgcctgatttagaaattttgaataagaattttgaccctgacatgaagaacgtggggacatgatgaaaaagatagtttttttgtggtatcttgtctctctctttttttttctgagttggagtcttgctctgtcgcccaggctggagtgcagtggtgcagtctcggctcactgcaagctccgcctcctgggctcacaccattcttctgcctcagcctcctgagtagctgggactacaggcgcccgccaccacgcccagctaattttttgtacttttagaagagacggggtttcaccatgttagccaggatgacctcgatctcctgaccttgtgatccacccgccttggcctcccaaagtgctgggattacaggcgtgagccaccgcacctggccggtatctctttaagtctctataccctgtttcaaaaacttcttaacaaagtgtaatatacatacagaaaagggtataattaataagtatttatcttaatgaattttcagaaactgaaaatacctgtgtagccagcatctagcaagaaatgaaacattaccagaacagaatcctctgcttgcccattctcatggtggccaatggatttctgaaaatatagatgaatttgtctgtatttgaactttgaaatgaaatgaaataatataggatatacttgttttatatctggcttcttttgcttaatattatattcatgagtcatccattttctgcatcattctcattgctgtagagtattccattgtgttaatatggcacagtttatttcatttgttctataatagatatttggacaggtttccttttttgttgtttattatgaacagttttgctgctgtattctagtatgtgtcttttggtgaacatatgtatgcatttttattgtatttatacctgtaagtgggattgctgggttaattataagttgggtaaatattcagctttagtagatactacaaaggttttctaaagtagttatacctacccactctttccctttctcatttcttttcattattttttgtttgctcttatcatatcacagtcatcatctgttttgaccttgcaataagaaatgaagaatttaagatggagtaatggaaaggcatgatgatacctcttcctaacattttatttgcattgcaaaatatttgattcctatgatttatattatgtctacttcaggatgcttgttttggggataaaaataaaggagtatataatagtattttatgaactgtcaaatgtgatatacaaatgtttagtttcattattccctcccctccaacgttgagaataaaaccaataatttttccctcacataattctccgattcactgtgtgtgggggcagtgggtgtagtggcagtggtaggtggtggaatgttagtggcatcatcctaagtggggttcaccaagagctaagaggctactgaatgatttccacttggtagcaaagaaccaaagaagagccagagcatgcctgtttccctatccccatatttctctcatcactccaggaaaaaaaggagtttatgaaatattcataataagaatatatacaacataagggttcagtttaacttagaatgtgaaggagcttgtactcttacccacccagattaagaaataagacattaataagctccctgtatgctccttcctgattgcagtacctttcctttccagaacctagagttttcccttgtttttcctctcatttttaccatctgtgtttgtatttccgtgaatataaggtttgcctcttttttaactttatataagtgaaattataatgtgagtattcctctatggcttctttcattcaacttttttttaaggttcattcatgtttggctctacttcattaattttcatttctctattggtgctccaatctatgaacgaaacataatatctttgtctgttttactcttgatgtccattttgtttgtttccagtttttttttttttgactctgacaaataatattcctatgaacattttcccggtacaaccgtgagaaagttcctctgaagtatctaattagaattggaatttctgagtcctgaagcatggaaatagtttaccctagaaaaaccaaactgttttccaaagtagttcagtcttttttactcccctcaagtagtagatgttgtttttcattgtttcacatgtgtgcaaacttgataatacccaacttacgaatttgtgtcatatggatagaatatagtgacatttaattgtggttttaatttacatttccctgattgctaataaagttgaacctttttgtatgtttatggaatgtttgttgcccgatcatatgttttgtgtgtatgagagcgagatttttgtatattctagatgcaagtactttgttagttatatgtgttgcaaatattatcttccattgtgtagagtgttttttcactgtctgatatcctttgatgaaaaaaagttcttggttttaatacagtgaatttatcagacttttttctttgtggtttgcacttttagaaatccttgtttgaaaatcctttcttgctctgaggccataaaaatattctattcttttctaaaaaattaagaattttgaccttcacaattaaatctcaaataacttggaattgattttggtgcatttaaagtatgaggtagaggtccacttttatttgtttttatctgtgggtgatcagtggatggattcagggcttaaagtgtgaagagttcgtttcttttgttttgttttgttttttgcagcagagtgttgctgtgtcacccaggctgggcagtggtgcagtgtcggcttactgcagcctcgacctcctgggctcaaccgatcctcccaagtagctgggactataggtatgccccaccatacccggctatttttgttatcctgctaagattctgaatccttatgcatggctgctcccactcttccgtgtacccttttctcatactactccagctctgactgcttgtcagcccattggactctgatactccacaccaatccccatctccagatggacgccttctcactctgcttggcctgacactgcacatcagttgagtctacgcatggatgccctccttacccattttggatctgaaacctggcattgagccctttactcattgtcatgcctgagctctggcagtctttgccaggccatcctgtgtgtggatattcacctcactcttctttgactctgatagcccatgccaggctgctgattatgcacatacactctattctttccacttaagtttgactctaatatcaagctgtttccccacccctcatggatactgttttcactccttttgggatatggcatatattggtaagctgcctccctatggagacatgctctttcaacctacttaggctctgaaacttcctgctgggcttttggggtggaaacctattttgctctgacttacctaatggcttgttaagaaaggaataggaaggtgaagaggagaatttaaaaaaagtatcaactttattgagacagaatgtacattcaaataaactgcacccattttaagtgtacagtttgttttgatgaatatatgcaattgtgtaattaccaccacattcaagatatagaccatttctgtactgataaagttccttcatttccctttgcagtcagttctttctcaaacccggcccaggcaaccactattctgcttttggttctaaagttttatctttcttagaatttcatcaaaatggaaccatttgttgtgtactctttttgtttctgaatttttttactcgccttaatggttttgatattcatctgtgttttgctagtatcagtagttcatttctttttattgctgagtagactccattctacatatatgtaccacaatttgacttttatcaatttatctgttgatagacattcaggttgtttttagttgtggaataattgggataatgctgaatctctacgtttcaatgatgaaagttaataggaataaatgtaattaagaaaaatcaggccaggcgcggtggcccatgcctgtaatcccagcaatttgggaggccgaggtaggtggatcacctggggtcaggagttcaagaccagcctggccaaaatggcgaaaccccatttctactaaaaatacaaaaattagccaggcatggtggcgtgtgcctgtagtcccagctacttgggaggctgaggcgggaggatcacttgaacacgggaggcagaggttgcagcgagctgagatcataccagtgcactccagcctgggcaacagagtaagagtctgtctcaagaaaaaaatcagaatagacaattccaaggtggagttttgggttcaggcaaattttcctacttgtacgatgttggaaaagttgcttaaactctctgtgctgcagtttcctagaaaagataatagaatgtaatagctcttacttcaggactgttgtgaagaatgcatgaggcaattcccataaaatgctaacgtagggctgggggcggtggctcatgcctgtataatcccagcactttgggaggccaaggtgggcagatcacctgtggttgggagttcgagaccagcctgatcaacatgaagaaaccccgtctctagtaaaaatacaaaattagctgagcgtggtggcgcatgcctgtaatgatcaggaggctgagacaggagaattgcttgaacccaggaggcagaggttgcggtgagctgagatcgcgccattgcactccagcctgggcaacaagagcaaaactccgtctcaaaaacaaaacaaacaaacaaaaaacacattaaattgctaacatagtatcatccatagtatcttaaaatgctaagcatactatgctgatagtattctaaaatgctaagcatagtatgctgatgtttcagcataacctgatacatgtaatgcagttaatgcatgttagcagttaataatagcaacaacatgtttcatagtaacatgaaagtcaagggtttttaattgctcacaattttatgtagctgcccagaaagctaattttatttacttcaatacctgtgtttgtttattattattctgtccataccaaggatcatggtagtaatggagataaaaataaagaggacacagtttttaacctgtacccagtacattgttcgaaaactataggttaaaaccggttagtgggtcttaaaatgaattttcatcatgactagaatttttggtaatgaagtaaaacagtataaaactatcaaaaggacatcacacgtaataaggacaaatactttttcatgaaatttgtttttagtgagagaaatatatgtatatctccctatattacacacatggatatgtgcatacacatgtaaatgcatacctattcatgtatatatgtacttggttgtgttataaaatgtatttttattgtggatcagtgtccccaccccccaaaatagaaaactctgttctagtagataaacaatactatgctcaagactccaaggccaataaatcatagagctgggacttcagtagtaaataaggcagctatcactgcatcaataaaacatgaaattatcaataaatttactgagagacatttgtgatgttttatttttaaaaacctgagaaactttgtagaaaccatttacgttctgtgggaagaccaaatattataaatgctacagatattaaagtagtaatcaagatagctagcttatagtctaggggaatatacatgtattaaattaaataattatgagaatgatgtgttgcaaagggtaacaaattaggtgttataaaaagattgtgtaagatacaatctgagtgtataataaattgtgtgttgtataaagattgtacaaaatacaatttgagtgtatggtgtgtatctacagtttttctcagtacgatttacagatttaatacagtttcagccaaaatcataacagctttgtttttggaatttatcaaaatgactccaaaattggaaacatcaaaggataagatttgtgtacattgaaaaggagaaaggggaaaaaaccctttagagcagggtataatactgacacaaatagacacaacacatagagcaatgaaagagaataggaaacatagaaatatgtgctgatgtatttagtaaaaaataattggctatagaaaggttttttttttggttggttgggttttttttttttgttttttgtttttttttttaaagaacagggtcttgctgtgttgcctgtgctggagtgcagtgactactcacaggtgtgatcataaagtactgcagcctcaaacttctggcttcgaatgatcctcctgctttggcctcccaagtagctgggactacaggcacgtgccgttgcgtccacctgcatatagaaagagtttatgcaaaagttactgaggaaaatttattagtttaggaaaacttagtttcttatactgtagcagaacacagatggcttgaggagttggatattttttaaaaaccaaaatctagaaaaattagtagaaattaggaatatctttaagtgccaaaacaaacctacaggaagggatatctgggttcagatatgtacagacgtaacagatatgtaaatgtgtaggttcaataaaaaatttaaacagaaaaaatttgtaaatactatttgcttagaatattataaaggttctatttatatataacaacattccagttaacttggatgccagatagatatgttttttatttcaaagtgtctttgccctgaccatctgtgaggatcacttcacctctaaagcgcttattaaaatcagattttataagtcagtgtttttaaaatcctctcaaatgtagcttgaattagtagattttaaatcccactgttgaattttacagtattactcaaaaattatttgtagtgcacattctggactgtgtgatgtgatgtgattgttcatctatatacctttgtatttaaaaaagaaaaaaaacttacaaaaagaaaagaaagaaaatgtctctgtcctcttcctctgctccctttcctaggatgcctcttgtcattgtgttgtagcatatctgaaacacaaggcagctttgttgacatcactgatgatgcttgttagtagggatttgtcagtgctgctaaacgtttttgttagtcatttcaagtatccatgtccattgcagctgctctggaactcacaggaagatctcagtttttgcaaactcatggaagaatcacctgggtaagatggagtttgttacagggttttcagcaagttaacatgtggaagaattatagtattagaacaaaagtttgccattgtgatgtgtcaaaaaagaagagtggaagatggtttgctgacaatagtcctctaatgctttgagaatagaggaaggtttatccatctttaataaaatgctgataatgtattagcatcctaattgcattcagagttcagaaattctaactagaaactgtagagactgctaaaacatttcacctagtaaagcagtccagaattcctagacagttggttaactgtgaattacttattttttgttcagttgctatggattttttgtactatttttgctcctgtgcatttattaaatatgtttatgcaaaacacttggaacagtacccagcactggtcaataaatgttagctctttagtatgtataatgtgaaacatgaaaattgaatgcatgaagttatttcttcagtattttttagaaagagtatgttttctattttatgatccccgccgcccccctccccccaccaaatgtttcctaattttggcctgggcactttccttttagtcaaggattaatagagagtactaaccattggttagtgtcagagttattaggagggtggttattatttgattcagttgttgttatattcctaatctttaaggctcttgtgctttaatggaaataatagcttttttatctttttgatctcctaaaatctggactgctagactgtttaataaaaaggagcagaattttttgaagcatattaataacttaaacactagtaactcctagttgtcttgggctgtcccatgcatttattttatttcattttttttttcagttttcaaaaataatgacttggtatatggggctttcacttaatttatttctaatttctaatttttaaattgatcagaacaatatatttctatgatataagttctttggaaggtgttaatgttttctttgtgggctagaacagagtttggaaaacttttctttagaagatcacgtagtaaatattttagccattttgggcaagacacaaaattgaggctattatgtagataaaacatttcaaatgcgaccatttaaaaatgtgaaagctttcttaactgtagtaaaaagaggcagctggccagatttgtcctgtgaaccgtagtttgttaatctctcgccaacagcgtggtcagtttttatgatggctctgttcgtttgaatggaatatatattttctgtatcttaggtagcagtatgtctattatatcaggcttgttaattgtactatttatatcttgcttatccttactaaatttttgcctttgatgtgtgaatttctgagagtagtgttaatctcctgctataattacagatgtctcagtttctccttttaatgctgtccatttttgttgtagtattttcaggctattgtatcaggtatatacatgtttatgattggtacatcttcttggcagattggtcctctgattactaattagaattctttgtttatctttattaatactttccttctttaatggtaccctgcttctcgtgttacaataatattgctatttcagctttttgtgggtgtgattgttgagatttatctggtgtttctctctcctttttacttgcttttagctgttttttgatcaaatcttatcttagttttttagagctgccataacagattaccacaccttggaggcttacatcaatagaagtttattctgtcatagttctggaggctagaaatccaaaaccaaggcgttgtcatcagggcttttctctgtctgaaggctctgtaagagaaacttgcgtttcttctaccttctaatggttaccagcaatccttgggattccttgatttgtagatgcatctctccagtctctacttccatcttcacatgaccttctcccttgtgtgtctgtgggtccaaatttctcccttcttataaggatatccgctatattggatttatgacccaccctaatcccgtgtgaactcaacttgattacatcgtaaaggcctattttcaagtaatgtcatattcacaggttctggatggacatgaatttctagggggtacatcattcaagctagtgcagttctattgagatgcaatatacacagtaaaattcagccttttggtgtgcagttttttttaagtgtttaataagcatattttatttaaataaatcctctcataggaaatgaagaattcattgcttttacttagaagaaggctgttaaatagatgtcaaatttatatatgcagctcaccagtatttccttattggcaacatctgtatttccacaatacacttcccaaaaggacttctaagtctcaaaattctgtctcctttgatgtgcttctctcttgattacacccaggctctattaatggtttggttcatatcattatctccttcttcatatattttctttagaatattcatcaatccctcactagcatctgtttcagtatcataggagggtttctctttttctttgcacttgatttggtttggctatgtcccaacccaaatctcttcttgaattgtagctcccataatccctacgtgttgtgggatggacctggtgagaggtaattgaatcatgggggaaagggtttttcccatgctgttctcatgatagtgaataagtctcatgagatctgatggttttatgaggggcagttcccctgcacatgctctcttgactgccaccatgtaagacatgcctatgcttctccttcggccatgattatgaggcttcccagccacatgcagatgtgagtccattaaacctctttttctttataaattacccagtctcaggtgtctttattagcagtgtaagaacagcagtctttttcaacctgagccaggtaatccctcccaccttgtgttttccactttctttctttttttctttttctttttctttttcttttttttttttttgagaaagagtctttgtcgcccagattggggtgcagtggcgcaatctcggctcactgcaacttccacctccagggttcaagtgattctcctgcctcagcctccctagtagctgggattataggtgcctgccaccatatgtggctaatttttgtacttttagtagagacgagcttttgccatgttggccaggctggtctcaaactcctgacctcaggtgatctgcctgcctcagcctcccaaagtgctgggattacaggcgtgagctactgcgcccagccttttccactttctttctgcataaaataagaactgtatcagtcttgaccttttttgaactgccttccacagaaatgagtttcaggagattgttcacagtcatggagtaactcctcccacttagattctttaccaaaagatcaaatgacctctctgtaaaatgcacctgcacattctcagagggaacttgatgaactccagttaaggtaatgtagattttcacagacttatctgactgatcccatccataattactggttttcactgtatatcccattgtaacgggagcaaccacagcatctggcttttcattatcaagaagttctgctttcttctatgatttctgttgcatcttgttctggatttctgtctcaattttggattttttcacctgtaagggcatcacgtactcctttcctagtagccttctccagcaacacctttgcttcttctagatgtttctgtagctcttccaaagcctagatcgggctgggtcaggccaaagacccgagctgcagccacacaggggagagaacaggaaacgccatgcagagccctcaaatcaaacacagacccccacctgcatgaattcagtgtacagttttatgagctttaattgacaattgtgcagctattacaatcccctcccagaattccttttcttttaaagtcaatttctacacccactgctagctcctggcaaccactgatatgaaaagattatcatataaatggatatgatatagccttttgagtataatatatagcctttgagtctggctttttttacttaacataatgcaacttgaaatattcatttatgctgtaccgtgtattaggaattcgtttctgtatattgcagagttagtgttctattttaatgctaccagtttgcttattcatttaccagctgaagggtatttatgttgctttctactttttttgcagttacaaataaaactgctgtgaacatttgtttacagattttcatgtgagcatgtgtttttatttctctcgggtaaatacttgggagtaggattgctgggttgtatggtaagtgtaaacttaactttttaagaaactaccaaactgttttccttggtgactatatcattttgtattgccactagcaatgtaagaatgtaactattgttctgcattcttgctggcacttggtattatcagtgtattataaaagccactgaataggtgtttagtggtatctcattgttgatttaatttgcatttgtgtaaagattaatgatattgagcatattttcatatgactgtttgccatttatatgtcttttttggtgaagtgtcttttttgcctattaacacaaatgtcttttcttactgatttttgagagttctttatatattttagatatagctcctttattaggtatgtaagtgatgaaacaaatggatatttttaaaaatgggactagctttttgggcaactatgtacaattgtgaggtaataaccctgcaccttcacattctcattattttcttactattgttttaaaattagctgacactttaaaaaggctttctatgagttacgcattatgctcggtatttacttgaatgattgcagatattttcttccagtccatgtcttcttttatatatatattacatattatatataaatatattatatattatatattatataaaatatattatatataatatattatatattatatataatatgttatatataatatattatatataatatattatatattatatataatatatatatttattttaaatatatattttaaatatatatttatttaaatatatattttaaaaaatatatttaaaattatatttatatataaatacatattataaaatatataatatatatataaaagacatggactggaagaaagtatctgcaatcatatatatttatatataatatatgtataattatatataatgtatattattatatataaatttatatttatatattatatataattatatatttatatattatatataattatatatttatatattatatataattatatataattatattatttttaattttagttattatataaattatatatatttatatataattatattatatataaatatataaaattttgtttgtttgtttttgtttttgtttttggagacagagtcttgctctgttgcccaggctagagtgcagtggtgtgatctaggctcactgcaacttccacttccctggttcaagtgattctcctgtctcagcctctggagtagctgggattacaggcgaatgccaccacgcccagctaattttttgtatttttttccgtagagatggggttttaccatgttggccaggctggtctcagaactcctgacctcaggtgatccgcctgcttcggcctcccaaaaggctgggattacaggtgtgagagcaaaagttctgctcttgaagtaaaatttatcatttttttgccaccattttttccatagatcatgttttggtctaagaaatctttgctcaacccaagattgcaaagattttctatgtttaagtggataagttttatagttttaagtttgaaacttaggtgtataatctgtttgaagagtttttgtatgtggtatgagttatgggccaagattatttttatcacgtgtatgttcagttgttctagcaccattggttggaaagaatattgtttctgtagtgttttgcctttgtaattttgtcagaaatgcctttgaccataaatgtgtgggtctgtttctggactcttttctttccattgatgtatgtttatctttttgctattatcactttctcttgattactggagctttatagtaagtctttaagtagtgtgactcttccaactttctcttttcagaattgtttgactattttagttcttttgccttttcatgtaaattttagaagcagcgtttctatttctacaaaaaataaattctgctgggattttgatagggagaatactgaatctccagttgagtttggaagagaattgatatctcaacaatatttaatctttccattcatgaacagaggatatctccatttatttagttctctctgatttctttcacatatacacacacatatattccttcacatatacacatatatacatacacatatatgtatatacatatatgtgaaagaaatcaacctatatatttaatatacagagtctgtgttttgttggatttgtacctaagtatttctcttttgttattttggatttttttcccttgtcttttggattttgctttatcataaatggtagttttttttaaattcaattttcagttgtttgccatacacagttgatttttgtatattgaccttgtatcctgtgattttgctaaattcatgtactagttctagtagtttttgtttttgtctttgagacgttctcgctgtgttgcccagactggaatgcagtggcacgatctcagctcactgcaacccctgcttcctggattcaagcgattctcctgcgtcagcctcctgagtagctggaattacaggcatgtgccaccacgcttggttaatttttgtatttttagtagagatggagttttgccatgatggccagggtgttcttgaattcctgacctcatgtggtctgcctgcctcagcctcccaaatttctagtacttttattatagatacttaagggactttctacaccatacattctgtgtctaaatgaggttattttatttttttctttcctattcgttcgccttttatttctttttcttgccttattgcactggatagaaactccactatgatattgaataggagtgccttgttcctggtcttggggtagaatattccatgtttcaccattaaatatgatgttactggtaggatgttttgttttgttttggtttggttttgggggggaatcagagacaggatctccttctgttacccaggctggagtgcagtggcacagtcatgactgaccacagccttgacttcccaggctcaggtgattctcccacctcattctcccaattagctgggactacaggtgcatcccaccacacctggctaattttttatagttttggtagagacagagttttagcatgctgcccagaatggtcttgaactcttgggctcaagcgacctgcccctcttggccacccaaagtactggggttacaggcatgagccaccatgcctggtgggttttttggatgaactttatcaggttgagcaagttcttttattcctagctttctgagttttttttaaatcctgattggatattgaattttgccaggaaatttatctgtgtagtctattgagataattgtgcagaccttttatttctcaatttggtgaattacattgctttctgactattgaaccagctttgcattggtgggatcaacctcagttgctcatggtgtatttccctttttacatattgttggttttgattcttcgattttttttttttttttttttgagacagagtctcactctgttgcccaggctggagtgcgggggtgcagtcttggttcactgcaacctctgcctcccaggttcaagcaattctcctgccttggcctcctgagtagctgggactatgggcatgcgccaccatgcccggctgattttttttttttttttttcatatttttagtagaaatggggtttcgccatgttggccaggctcatctcaaactcctgacctcaggtgatcccccccgtcttggcctcccaaagtgctgggattacatgtgtgagattttttaaaagacttctgcatccttatacatgaagaatattgatctgtagtcttcttatactgtctttgttttagtatcagggaagtgcaattaatggcctcattaattgattttattaatttaatttgatttttctctaagtggttgtatagaattgatgttattctcttaaattttggaacaatttgccagtaaaacatctggcctcagatttttttttttttagtgagaggctttaaaccatgaattcatttttattagtagtcatatgtttacacagcttatctatttcatcttaggtgagtttcaagagtttgttgcttttgaggaattttgccacttcacataagttgtcaaatttgtgtgtgtagagtcattcatattattattgctttatttactcttagcatttgagatgtctgtaatgatatttctgctttcattcctgataatgttttgatttgtgctttcttttttgcattttggcagttttgctagatgtctagcaattttcaaagaaagtgtttttagtttcattgatttgtttgtgttttttaattttcagtttcattaatttctgctcttgattattttcttctttctgcttgttgtacatttattttgctccagttattgatttgacacctttgttttaataaaagtatttcattctataattttcccttatcactctgctttagttgcattccacaaattttggtatgtggtgtctgttattttccttcaattcacaatattttcttgtttttcttgagacttcttctttgacccaaggatgatttagaaggttgtctacttttcaagtgtatggagattatctttctgttattagtttctagttaaattctcttatattcagagagcatatgtttggtgtatttttagttcttttaaatttggtttctcaaatctgtaggtttgtgtctttcaccaaattcggggtgtgtttatccattatttcttgaaatattttttctgcccacccctatccttctgtgacttcaatgacaggagtgttagctcttttattactgtccgcatatgttcctgagcaggctctgtcaattttttttgaccaatcttgttgctcttcatcattcagattggataatttttgttgatcactctttaagtttattgtataatctgaaatgctagtatttagcccatcaatagtgcattttaaaattttggtttttgactcttttcaggtctaaaatctccatttgtttctactttttatattctgttttttttttttccccctgagattttctctttgtagtcccttcaagagtttattcttttggagaattttaataacagctctgttaaaatctcttccagttctaccttctgtgtcattttggtgttggtgttttttgattgtcttttcctttgtgagttgacattttctcctctgtttagatgttgagtaattttggattatatattagatatttgaacgttgtataatgagattcctgatcttctttaaatctttattttattttgtttttaaacaggcaaacaatgtggttgagtttaggctacaaggtacagctagctgtcttgattgtggttttaatgccagctctgttttcaaagcttttgccatgctttccagatctgttctgagtatacatcttccagaggctagtctgggacctgggaagtgatcttaggttatttttcaaagtctttgctatgctgtttaggatcagatccaagcaagtgctgctcagggatgaaccgatgaatttacaacagctttatggagctactttactcagttcctggtattttgtgacctctggtattttctgttttgctggacttctcttttttcctctatccttaatgctgttgttttattttttctattctgctgtacacttcccacaagtgcacctgcatttaatgcaaagcagtatgtgcttgtgttgtctcatattccttggggttcctgcattgcagttgggaagaagacatttagatatttggaaataattcaaattttacagtctgtctctcttctcaaatatacttgtaggtaggactggcgatgcttttatatgtctaggcagtaataacggagatgaactttttactgagatgagtcctgtaaaactcactttactttctttatttcttaatttttaaaaatgtgttccgagaatattgctattcattagaatgttgcctatgttcttagatcaaagtcttaatgtccatttgacaccaccatagaaaagtaatttatctatgctggaaatttggcaaacacttactctcttgactgtcaatcagcattaccttttgaactgccctaaatacacatttagaaattctgggccccatccctagagattctgtgtcagtgggtatacagtacaataaattaagaagaaaataacctgcatgctcacctcccctattgtagacattatccatggtatgggagaaccagaaaagatatatctgaggaagattgcaatgttatgttccttgaaggttgctggttcagtcactgggtttactgaggcagccaggaatcatgaacaaataaggtgttgaacctcagttgtgctgccttagtcaggggctcagtcctgatcaaggtagcacgtcatccagttatattcttcactggttcatttttcttgaggctgtctttctgaaccattgagcatgtggtttcttagtactaaaccagttcagcaaagggtggaacttagtattgtcatcctattttatttataatgttttggaacaaaaatctttatttcagccttttttgaggcatgagatacatccagtaaagtggttaaggtgtaccaatcttaagtgtacagctcaagcttttcatatgtatgtttaactaccgtacactcaggacatagaacatttccagcttcctactaggttccctaatgttccttcttagtcagtaacccccttccctttagtctaccatcattcttctgatttctaacaccatagattagttttgccttttctcagacttcatataaatggagttatgtgatatatatcctcatgtagctagtatttttaattcagttatttttgctgctaagccttactgggttacttaatattattgtttatggctccttggtactcaaaacatgtctaaaccaaagcagattcagttgacctttgttttacacttttcctaggtgaaacagtcttaaaattctttaggaaatttctcataatgcttaatggttctgtatttcagccgcttatatagtatccgttatttacttccacagattattcttgccgtagctcccttttttcttcttccacatttccttctaacagtatatataggggaaatgaagatttctaaaattttgtctcccatttgttcttcaccatgctagcatttggtcttcaccatgctagcatttggtctgggtaaattcaggttgaactgaatgtccacaattactatattaatctagtgtttttcttcccttctttctgacagcatgatggaagtggttcattgcatgatattcaactgtcattgccatccagtccagaaccagaagatggtgataaagtatataaggtatgactatgtagtcatgctggatttttcaaaattctttttaaatactaaaataatgatacaatgacaatgaaaacaataataaatgtattaatacctaaagcatcaggtttgttcttaacttttgctactttgttaagttgaaatgatatctctgtggtgctttaatttgaatttatcagttggataatgatctgtccttgtattactactgttgcaggatttaaaaagaaaatatattgctcataatgataaatgataagagtttttaaaatatgagtaggaatgaaagttaaaatggttataggtgcttctcatatataaatcccaaaattgaagaagtatactgaaaatgagattaatttcttttttcatgtttaaaaatacagaatacagatgtatttttgtgagtgaaagtgtttttttataattcttatttatgtctatttttagttgaagaaaactcttttattttgcaactatttaagcacatatttatttcttaagcacacacagagattcttggttaatttaatgtttccaagtcaagttatagttagcttttacatcccattttcagggtacacttattagtgtttgctagtcatctacagtaacaacctgaaagcaatggtggcttataataatgaaatttatatttcacttacatattggctgtagatcagctgggactctgcttcatgtgtcttcctcattctgggatccatactgagacggatcagcccctattgtgggacatgttattgtgccagtgggaagagaactttgataggatcacatgtgaattctgcttggatgtggcacatatcactttcaaaacaattcaaggggccaggcctggaattaatagggcagaaaagcattatttgctcgtaggttgcagagtgatttattgggaagaagattgtatataaagcaatcaaaatcataagagtatagtacagtagtcaatctcattctctcatcttggcttttcaacttgttgactacctgtccttgcccagattgcttcccaaccctgagctttcatcctactctcagtataatacattaagtcagcaggttcacagcaggccatctcttaacactcagttgagaaccattgacttaggtaatctctgatgacctcccagtttagaaaaaaaaaaattgtgaatttgtgactgacattttaaaagcaaagttgacctctttcctgaatttgtgtgtgtgtgtgtgtgtgtgtgtgtgtgtgtgtgtgtgtgtgtgtgtgtgaaaaagttttttacatgtaaagatttttttttttttttttttttttttttttagacggagccttgctctgtcacccaggctggaatgtagtggcgcaatctcggctcactgcagcctcggcctcctgggttcaagcgattctgctgccttgatttcccaagtagctggaattacaggcatctgccaccatgctcggctaattttttatatttttagtagagatggggtttcaccatgttgtccaggctggtctcgaactcctgacctcaggtaatccacccacctcggcctcccaaagtgttgggattgcaggcatgagccatcgcacccggacaagaaattatgttttaaagaaaaaaaattaattccaacatttttacacaattggtatctttactcttttccagtgttcctttctagttcatctaaatatttaatgctatatgatagacattttttgctttttttttcttttttgagatggagtcttgctctgttgcctaggctggagtgcagtggcatgatcttggctcactgcaagctcagcctcctgggttcacgccattcttctgcctcagcctcccgagtagctgggactacaggtgcccaccaccgcgcccagctaattttttgtatttttagtagagacggggtttcaccgtggtctcaatctcctgaccttgtgatccgcccgcttcggcgtcccaaagtgctaggattacaggcgtgagccactgtgcccggccatatgatagacattttgttacacagtatttatttcttgtccctgctccatttccttccaggcagattattcctagtctttcttatttaagctgagttgcaataggtcatacttgtcttttcttcagtattctggtctcttttgcattttaatcagcaaatccccaactgtgtcacctttcatccaaaatggtttagcagtgcagtttcaaatgacacaaatactgcatctcgtgccattaaaattgtaggatctaaagtctccattggacctaccatgcctctaatctatccttttatttaatctcaggacagatccctctcccattcccttaatgatctcttccaaatagctctctccaagttccatgcttagctatacttctcaacctctgcaggtagccttatgtttgttcatccagtaaatatcttatgcttcctgccttcttgctttcttttttttgtttttttggttttttttttttttgagacaaagtctcgctctgttgcccaggctggagtgcagtggcacaatctcggctcgctgcaagctccacttcctgggttcatgccattctcctgcctcagcctcccgagtggctgggactacaggcgcccgccgccacgcctggctaatttttttttttttttgtatttttagtagggacggggtttcaccgtgttagccaggattttcttgatctcctgacctcgtgatccgtccgcctcggcctcccaaagtgctgggattacaggcgtaagccaccgcgcccggcctccttcttgccttctaatttatctatatttgtctcattcttactcctttgttccagttacaggggaaaagtgtccactgtgctatggaagatcagctcttctgtgttcttaactcttgtcttctgctgttgcttaaggacctaactgcatctcttcctcctctctcatctgtcttgagtgcgcctcctctactttcttgtcattatttgtttgtaaatgtgtatatctcatttaatttcagtaaatcaaatacactttttcttgactccttttaaactcctttccagttagtgtgaaaacttggaacaatgaaaatagctaccatttcaatgctgtagacgtttgacatgacctttgttttaaaagctttctcctttggcttttgtgtcacttctctctggaatccctcatacctttcaacattttttcctgtaggtttctcctcttctttaaatgttagatttatatctttagtccagtcctctttgaacatcttactctcataatttcaaatatgacatatatggctaacatgtaaaactcctttctttcatgcttggtaatccagttgcccactggacacacttctattgtatgtcccacccataagtacttctaacacagactctctctctctcaccccccacatatgtgtgtgtatgtgtgtgtgtgtgtgtatttgtatgtgagatgtcttaaacattttatttatttaatgaaaaaactgataactgttgagctcagaaaccaataccccaacatacagtactttgacatactgaactgaagaaacctcaagatctcttctggctccatcatgtccccacctcccccctactgcccacccacctgtgtaacaatatatttaaaattcacacatattcctctttggacatacttgttgttcttctgtattcaccatttcttttgttggcgcagctattcaccatgtcactcaagctagaaatacagtgtcacccttgaatgctcctctgttcttttctcacatgcagtgaattgccaaaaatctcaaaattttgatttcttctctcccttttcatctatattatcactctcttgggtcaggctcctactcttatctagattattataatattttcataagtgcctagctcagttttcttgctgttgttaaaatttgtcctctaaacacctgtcaaagccatctcaaatgcaaatctgtcactccctagctaaggccatgcgtgatagtcatggctctctgtgatctggcccttgcatagtttactagccaattgcttctcaacattaatcagaacctatgtgcaacagcgacactgcttatacttctccagacgtgctatgctttccctcacctttgtattatattgtatggcacttagaatcctttaactaaaattccaagcctaccacactcctctatcttctgaatcttgtgcttatcctttggaactccactgtagtccctcatttctgatgtgtgatgtcacttctttgcctatctttatatataaaatcagtgttcccaatgcaaagagatgataaatgtttgagatgatggaaatgctaattgccctgatctaatcactataaattatatgtgtcaaaacattactgtgtaaaccatgaatatgtacaatgttatctgtcaattaaaagtaaaattaaaacaatgaaatggttttggtgggggaaaaaaatccttagagcagtgcctgccatacagcaagtgctatatacatgctggctattaatgttcttagcacattatttgttgatttcatttttgggtccatttcctgtgtaacacagtccgaacctactggtgactgcatgaatgatggctatatagtgttccatgaagttgctacattttattcccgttgtcctcttacaggacaattgtaaacttgttaactttcagataacaccttgttataggttttctctttctaaggatcatttctttcatatagattcctaggagtaggataactgaatcagagtgcaggtattttgatggctcttaaacatacagatgtatatttgtccaaaaaggttaactgctatgtctgatggtgtgccattttttcctgcagtctggttaattacattgggtatttcaccactaacttaatatttataaaacaatactttattcaacaagttaaatacaacattttaccagttatatgtatatttgtgagaactggctacttgtctgttgaggccttaaaaatgatcttaaatgtttagacaggctgttaatatacttgagatataaatcctctgtcatatttgcatggattatcaatagcttttaactaatgttaattgttaaggtgccttaaaatgttatataattaaatataaatcatttcttttgaatagctatatttgctacataacttagaaatgtgtccttctaaatgtattcttagaaatgtatctttcatgatctgcaatccatcttttttgtctttatgaatttttataattcctaaacttaaaaacaagtggagattatcttttgtatgtaataaagtctttttcaattatagtgtacataatagcattttaaaaatcttccacattgtttgggatgcttatgtgatatgttcaaggctttgtaaaatgtctatttctgatctctttgttaaagagaatatatgtttttgttcccgatgtagctaaaggggatgacattctttgcttagttacaacacatcctaattatttgcttacttgtttttctctctggaaagatgttattcacatctatatttgaatttccttgcttatattaccttctcttttggataactgaataatgaaacacaaacaacatgggctaactatagggtaatgattaacactttggaaatgtaactggattcctgcttaacttgacagtaggtttccatttaatagtactaggcatttcttatagatccaattgagaaggtgttctctctttgattcaggaggtactcctcaaaaagtggctcatggtcaaagaatcttccttgttacccttcaggcacatttatcttttttgctgatttgtaaaccagccatgaaatgcctctgtgcctttaattattctattgcctctgcttctcatgccctttgttttctttcacaggctactcttatgtatcccttgaagtctagctgaagttgcttttttgtatgtgattttttttttttttttttttttttactctgtggcctatgtcccagttttcttatatgtaaaaaaggattacagtacctacctcaggagtgtgggtagaatcaaatgcttaaataagtgcaagtgcttagtttttaacatctaataagttctcaatgaatgctaactgttgctgctactattgctcattgtcaacatgtcacacttcattaccggatgaaatcttagatttttttttaatagaggatttcccccctaaatgaccagatagtttgttcattactgtgtcttcatcattgatttcatgcctctcattatggtattttaaatacctcatctaaagattttttaatatttcagaatgaagatttattaaatgaaataaaacaacttaaagacgaaataaagaaaaaagatgaaaagatccaactattagaacttcagcttgtaagtattgtagtataatgtatagagacttttcaaactgggtgaaatgtgtttttcataaaactctgagccagaagtagagtttagctttatttttggctctcaaagttgcacttttatattatttttagattatatgcactgtaataaaagtatgtgatttaacttttaatctaaatattaagtatttggtttggaaaattcttcattgattcagcgacctcagttttgggtatttaaaatttaccaatttacattcattttgttgatacaagggtaaatggcttttcttcagatatatttaaagaaacaagtacttgtgagttgagaacagggtattttctctctctgtgagcagaattagcctgggtattcagatttaggtagctgcatcactatcagattgaagggtactccaagaaaatgtttatttcctatggatgctattgaatgatccatcagagtcatgtttgaatcttcataatctaataattgtgcaatttcacatattagtctcatatgaaaacaatatgtatggtgtcttgaatttaattattacttagtttgtatataaaagaccatgataaaaagaaaataatggcctaaaaatcacaacactcaaaaggaaatctttgttgtgagtcaagagcacattttggtctaacaaagcaatttggtgaaatattaatctcactgaaaatataaaggatatcatatactgagctctgagccactggggtcagctcacggagatccatttcatgaataaatagagcagataaatcaaatattatgattaaaggaacaaagaaaatttatgaaactgaataaaaagtagcataatattacaaattgaggtcctgtcacatacaaaattaaaaaggaaaataataaggcctagtgtttgtgttcaaagccaaagacaagaacccaatcaactttcagggagaagaaaaaagacaacaaagaaaattatgtaagcttcgatttttacaaaaatatattacagagcacaagatattgtgtcttgtgcaattcagaaaagaggttatgaacctcctattttatatccaagcaagtttttatttatatacaaaggtaaattctgacctttaatgtcttgacagacccagttaatacatttcagatatttgagaggtaaattgaaaaataactcaagaataaggagataaagattaaaatgaatgagcggtgaaatggaaactaagtggtgtaaacttctgagccactagttggagaaaacttactgcccattttacctaatgtaaattacatatcattctaatgttgggatttgtttggatttataaatccttaatttttctgaaattaaaaattatttttaattttaaaattttaagttgctattaattttggaaaatattcagattaaataagtttgaggaagaacataaggaatatgctgaaggaagttagaagtactgaattttttatcttctacaaatgaatattcaacattcttaattttaaaaaatatacttagataaattataatgtttatgaaatgctttaaagtaattagtaggttggaataaagtatcttgcaaaagttaaaagttaaaaaaaagacgaagtagaaaaataaggaaaacttaaaaacagcataaaactaaagtaatagaaattagaccaaatataacaaatataatagtagttgcaaatagtcttatgtcttggagagactttccttgaggatctaaagcaaaatccagtaacttgctttgtataaaaaaaatttagctaaaggaaaatggcacgataaggctgaacataaaagattgggggaggctgggcatggtagctcactcctgtaatccgagcactttgggaggcctaggtgggtggattgcttgaggtcaggagttcgagaccagcctggccaacatggtgaaaccctgtctctactaaaaatacaaaaaatttagctggttgtggtggttcacgcctgtagtccccagctacttgggatgctgaggcagaacaatcacttgaacccaggaggcagaggttgcagtgagccaagatcatgccactgcacttcagcctgggtgacagagtgagactctgtcttaaaaaataaaatagaagactgggggagacagaataaaattattctcatcaaaaatattaggattgcaatagtaaaattagaaaagtaaatttaagacaaagatttatgtaaaaggtcactttatatggacatatgataaataatgaaagatgaatctttttatgccgtgaagttttgataaagtattcttttaacctcagaatgtatctttaaaaaaataagaacaggtctcttcatagctcaaattatattattatctctaagcaattaatagtaattccttaacatcttctaatatctagtccatactaagattttctcagttgttccaaaaacatcctgtactttgatgtccctaaactaaaagtcagtctaggactatgcacaactggttatatcccttatatctcttttaatttagaactgttcttttttttctttttgtattgatttgttgaagagactgcaccagttgtcctgaataatatctcatcttgaaaataatttttagaaagatttaagaaatattgaagagcatcctaaagaaagaaaagtgaaagcattaatctttatcagtaggtaccttgaaattctctgtactcgatatattaaacctagtaatcatatttgtcataaaagagcctgccacctgtttttctaggtggtgtgcctagttttcctgtggattgcttgggaagctgtggtgtattcagctagaaattccctctgtaaacacattagaatctcattagcatgtttacaaattgcagaggagctgtggccccgtaccaggagaacttcgtgatattttctttacagttcatgtaaaggctaatgttagtgtggttttctcaacataaatttagaggattagaaaagattcactgcttctcattgcaagcagtgatctctgtaaagtgaatgccttagttttaggtggccaagtatcctttttatagtagaaaattagaaatcactcaaagattttaacagtataaggtttagttatagaactcgagaaagtcacttgttcaaaccaagagagttttaacagatacaaaccatttgaaaacaaagataagtaacagtatttttcacattatcaaattaaaatcacctattaaaaaattttttttaacatctctattcttaatataggaaaaaaatcagaagaatcatagactaggaattaaaggacttgtttctaatttaattagctaaatggcactgacagtttccatcacctctctctagtgctttctttatccaaaatgtgaaggtttttctaggtgatttccaatttccctttcagttatagccttctatgcttttttatctttttaaaaaatatacattcaactccaacctatgtttgcatgcaaaccttcataaaaatacgttgacagtataaagtgttgaattcaaaatattctgatttaaaatcagattgcagcgctctgagaattaactgaaaggcatagaagtttaactattcaaaccttactaaaaaatgctaagaatgcctgtttatctttactacaataccatagttaaataatagttcagatacatttctcattgactcttcagaataatcttgggaaattgctagtgtagaatttcctttatgggagacacattagacagtggaactcaggttaagtgggctagcagtatagtatatttgaaaaaccaagacagacctgagttcagatcctgactttgaaatttatagccatgttctctgaagggagttctataatctctcctaagccccttctgttagaggataataaaagtagtactgggctgggcacggtggctcatacctataatcccagcactttaggaggccgaggcaggcagatcacctgaggtcaggagttcgagaccagcctggccaacatggtgaaaccctgtctctactaaaaatacaaaaattagctgggcatggtggcacatgcctgtagtctcagctactcaggaggctgagacaggagaatcacttgaacccgtgaggccgaggttgcagtgagccaagatcgcgtgccactgcactccagcctgggcaacagagcaagactccatctcaaaaaaaaaaaaaaaaaaaaaaaaagtagtactgaccatatagggttatgatagttatgttgtgatagaactacatagtaaactacttaatgcctggtccatggatacatgatgaatagcaactcttatataagccctaaatcacccagtgtaaatcagtgcatatcttatgatgttttaagttccgagtaaaagtccctaactaaaagtgattttaaaaataaaaacagttgtaaactcaacaagaaattatgtaggtcccatccatttcagtggtttcttattggtcatttggctgattgattaggttccagatcagcttttttggaatcctgttggctgtccattcatggtcacaagatgtctgttgctctgtgtgtcacattctcacacagtaatacccaaggataggttaagggcctatgatctccagtgtctgtttttaaaatcaacaaaccctttctcagataccctagactttcctgtttgattggctagatttgagttacttgtcccttcctaagcatagaggaatgggattaatcacattggttcagactaattaagttctagctccttggggtaagagattaggacacatttccccaaatgtgggaccaaatagaaggtgagcatctgtacagtctgtcagcaataaagaaggcagatggtgagaaaatgatttggttagtcattttatatatgttgacatgtcactagaaactagacttttccaaattttggaaaactcatatatttgccaaatattatttttcatgtgtgagcatatagaccacagaaaataaatcatagacagtctgctacttaggattttttgattatatgatggtacaaaagtgatactcattcagtaagctcctcaacttatgacggaattatgtcctgataaacccattataggttgaaaataatcccaaatcaaaagtgtgtttttagtaatattatgagtttatccaggtgtgaccccattataaatcaaagagcacctgaatttctggaattgcaataggatggaataagtaaagtgttttcgttacgatagtgtttttaaattatcttttctgttcctcatatacccctcatatatgttaaaagttgatcctattacagtgaattccaagagactgtaaatacttgattatatattgaatttggggggttattttggagttagagtctcactctgtcacccaggatggagtgcggtggtgcaatctcagcacactgtggcctcaacctcccaagctcaggtgatcctctcactcaacctcccgggtagctgggactacaggcacatgctaccatgcctggctgtttttgttgtgtgttttttgtagatacagggttttgccttgttgcccaggctggtctggaacccctgggcccaagcaatccgccagccacagcctcccaaagtactgggagtacaggtgtgagctactgcacccagcctatattgaattttgtttcagtgactgtctcatttgttaggaatgggaaatatgtctctatgatagacatttttgtttttagattttattttgtataaggaaattgtaatgatctgattgcagttaagaaaaattttgaatatgggtaaatattattaaagtagaaatgtatcattttaacctgatggaataatcaagaattttttagtttcctatgagaaagtatatctacctccagtgaggttgtttaacaaataatgtggttattttctagcttgtcactaagggtgaattctctctctttttttttttttttttttttttttttgaaatggtgtctccctctgtcacccaggctggagtgcagtggtgcaatctgtgctcactgcaagctctgcttccgggttcatgccattctcctgcctcagcctccggagtagctgggactacaggtgcccgccaccacatccggcaaattttttgtatttttagtagagatgaggtttcactgtgttagccaggatggtctgcttctcctgacctcgtgatccgcccgcctcggcctcccaaagtgctgggattacaggcgtgagccaccgtgcctggccgggagaattctttttatcagtattttcatgatcttttttgaaagtgatgattatttgggaaagttactttgtgttatataaatgagtgtgctttgagtggaatcgtgtggagaaatcatttgtgaacagaaatggtcagatggatcttgtcaaagggctgacactcttcaaaatatttcagtccagtaaagtcaatacatcatgaaagaggcttcatcacactgcacatgagaacagacatcctgacaagtggactggtggtattcaatgtccagcagagtcccattaaaatatggatttaagaaactgagctttagtgactgtagtaccatgacagtttagggaaatactgtaaattctgcagttgtattctttatatactgaatatccctatatattctacatccatatacttaactctttatattgatatacataaaatcatatattgtatgttttatggacaatataagagattgccaagggtaatttagattattcaaaattctaaccttacaggctgactctcaaacccactccctgaataagatgagagaccactgaatagaccttattgttggctgtgataacattttttcttcaaaaaagtagccagaactattttgccatgtgtgacttttttgttgatttggttacataccccctaaaagagccctgattacctcctgtcatggctgttaattttttttataggtaatttagttttgcttgtctcttaggtgttttatgtgttttcctaaagtttctcttgtgtgtcttggtgtgtatatgcagaattaaaccaatgtaaaaattttgtgtttttgtttaggcaactcagcatatctgccaccaaaaatgtaaagaggaaaaatgcacttatgctgataaatatacccaaacaccctggagacgaattcctgtaagtaacatttgctcttagcctcctctccagtcatttgctattttgatgttttatttcactctttttacagcaatctctaatgattttgaatctgtcatggctgttaatttttttgtaggtaatttatttttgcttgtctcttaggtgtttatgtgttttcctaaagcttctcttgtgtgtcttatgtaagtgaatgtgcattttaatagctttttcattctacatactatagttcattttatttgcgtgtctactctcctcttattgcatgatttatgagagtagttccacatgccttaaaggaaatagcagtcctgtatgcagtcatcccactttagcagcatatgacactttgaaaatatatgatttagcatattccttttttgttaaaacttttcaaatatgtttattataattactcaaatgttgagggtgttaggaaatataaatgcacgaagatacagacaataaaagttatgttttaggcagaactagggaatggtttattttaaataggaagtaactatgtattccatgcttatttgtttttcaaaaatgttatatctcaaaacatgtttagtgctaaaaatactctatcatttaatctgagttctcagaacttagtgcaggatgtgtgtgagccagagaattatcatatggacattagtcattctgctgttgtttggggccaggtagtagacatttcttgttaagagattgcctaataagtcagccttgactcttttgccttatatttaggagtggaatcctagtaacacaaaggaacagagaaatataatggctaatataatcagcaattcagtttataaagcttagccataagcctttaaagtttataaaagagttttgtttcttttcatctaacaagtattttttttgtgctctgtataagatacaatggtaggaattaatttattcaacaaaagtttgatgatcccctttcatcccagatatttggctttcaaactagaagtggggaattagggaaggaaatacagacaaataaggattcctctgtttataagtacttcttaagaaattgggaatgcattgatgtagttaaagtgctgtgtaagtctataaggttcaaaggatgtgggaaagtctagttgaaagaatcaaggagcttggtgaagaaaatgaaggttgtgtttgaatcatagaaagcaaaagataccaacagaaaaagatgatgtgatattatttaatgtcaaaggcggtggaagctcatctgtttgcagacagttgtttaatagaagaccatgccccttgcttctagatggaagtttgggctttccaggtgtctccatttaccccatagggatgttatgccttataattgtactactaagaagactggtgattccattaagcatgataagttccattttgccatcctcatggaagtctttataccacctctggctccttcagcctcactgttctggaaactggatgttagtcttcctcctcatcagacaaaagtaactataaaaaaagtaactataaaagttactataggaatcatctggccaaatacctttgttttgtagataaggtagcaaaagctggggagattaactggcatagcaaagttcccataattaataagtggctgagctagtactataacttaggactcttgactgctagttctaggttcttttccccaaaagcacattgaagagcctttgaaggagagtggtttgctgccaacagcagcagagcaaaaatttgaatgtattgagatttgtccaaggggattttgtgtcacttaatggctgcaaataagatctctgaagtagagaatcaacaggaaataagaggaagaaatatagtagtagaaaaggggaaaggaggaaaagcagatattcacttgcttattcagcagatatttatgtgcctacttcatgccaggcactgtattaatttggatgtgtaaatataaagaagaatataaaaatacatgtgtaaatataaagttccatccctcaagatgcttgtagaaacctccagtgtgcttaaatgatagtaagctcactctttttctgcatgtgaagaagctaagactaagaagtgacttatgcaagtgtttacacaacttgtatacagcagtcttattttagttgcttttcttttgaatggttgcaggagggtgagggggctagaaggaatagagaagagaaaaggatcatagctctgggaagggaggacagaggcttaatcttagtgagagatcacaataaggacttaacttccctgagaggaaaaaaaacaggtgcccaggtttgcactgcatggtagaagacttagcagtatactgtgataatccatagaaacatacttgtattttaaaagttatttaatttattttgagacagggtcttggtctgtcacccaggctagagtgcaatggtgcaattatggtccactatagccttgacctcctgggctcaagtgatcctcctgcctcagcctcccaagtatctgggaccacaggtgtgcaccaccatgcctggctaatttttttattttttgtagagacaggggtctcacactcctgggctcaggtgatctttttgcctcagcctccccaaatgctgggattacagacatgagccaccatgcctgaccacatacttgtattttaaattactgagaaaaaagtatttttggttgaaaaggcatagtttcagtaagagtgtaataagaaaactcctctacaaccaagttagtttcaatctaatgtgagtacaaagaaatcttttgacatattaaattatgtaagtcattttctcaatagaaataataaaattcaatacctctcattaaaagcatgaaaaaatagaatactaagaatactttatgagtaacctgaggccaaaatatgtacgtttaaaagagaagtactgtaaagtggatttttcctttcctatttttattgagagataacgatatatttattctatagcaaatatagaaaatagagaagcaaaacaacttaagaaaaatttaaagtacttaaatcatacaagccaatgacagtcattgttaacattttatatatggtcttccagccttgtttggtgttgtgtgtatatgtgtatgtgccatctgtcatctctatttagatgggattatgttgtatatgtggcattttaacctacgtaggtagtggtgatggtggttgctattaatatttggtttgatttttttactaaaccaaaatgaagaaatgcattacctttaatcaagttaaggaattaattcctttactggatggtctttgtaaggttcttgaaataaattactacagttttttttctgaaaggtttatacaggcttatactaccaccaactaagtatgaccagaaagtggcttggtggccgtgatgttaggttgtgtgattcaagtgtttgatgtcattagtttatttaaaaaaagcccctgatatttccctccacaaacgaggaaatacaagggcaggagggttaccccttgtgccccacactatcatttcaggtggtactgggaagccactcccaactatttatgttatgaccattcctgttatgtaatgttttcttaccttacaaattctttcttcctcctggcctgaaaaccattttatcatgctattttctgcatatattcaacctcagcttttgtgtatatcaatacacaaaattttttatatattttatatatattgattttatatatattgatcctcagaattttaggagtttttttctgcctgtagtaaaatttggctttcatgctacaggtgcttttggtgttagaactgtactgataaagatcaaaactgtttgggtttggtttggttattatttgtgagactgaacccagcaagggaatagtggctagtcacctggtgggtgctcttcatttagggcaagacaaaggtttctactaccgtagggagttgcctaagccatgctgtaggcatagtacaggatgtttttaagtataagtttttaagaacagtgttttcagcattgaggaccagagtgtgaagcacgtcttagtggagtaaggggtctatcttctgcttgggaaagcaataatgtagtgttataaactcccctgagccttgcattataaaaagagggcagccataggaccgtattccagaattgagaatgccctactctagagcggcacagtcctatacaactttctgtgctgtccattgtagtagcctgtagctacatgtgactgttgagcacttgaaaatgaaggaagagaattttaaattttgtttagttgtaattaatttaaatgtaaatagtcacatgtagctaattgacatcattttggacaaagcagccctggacctaatgatatctacttacatggatatggaaagctacctagaacaataagtaaagggcaagtcagtaaaagcagttttcagaagaaatgaaggaaaataaaaaacatggagttcagatttaggtggaggaaaaaagagggaaaagagataagaatgagccgtaagagcagaaaatgatacttccagaggaaagtggggcaattatttttcttatctgaggggcaaaatacccggatacaatggtgaaatgagtaacgcgaaaagaagaataacaatatggaagatgcctaatcattcacatgaaaatagttgatattactgtgaatactgctggaggttgttggttatgcgagaaatcaagattcattttaaacataaaaacttacgaaactatttttaagcatagtgtacagatccatgtacaagcatattcttaaaaattagcattatcttggactgaatttatttttatgtatttccaatactgttttaaaagcatttaacatcagtatttaaaaatatgaatattctgcacgttaagtaaattgtaaaatcttatgatatgtaccttttgtagtccatttgtttgaacacctcaagttaaccagagaagccaaaatattagaaaaaagaaacatttctggactcataccttcaaatgccttattacttatccccttgaatctctacgcagggagaacaggttagacccaaaggatctacctgacctgtcatgtaattacctgacctggattactctgaaaattgagtacatgaatacacagactgttgtatcggtatcagtgtgaaaaggtgcctacaagttaaaattctgaatgggcacaattcgatctaatgctaattttctctcatatttttaagaactaactctgttatatatagcaaagaggcaagaaaaggtgattttatatacattaaaaatgatctgttggaattatagtactgaatcaaagattaatccatgttacggtatatataaaagatatgcatatgtaatttatataagttcagcaattggaatatggtcagcattgtcaaccaccctttttgtgcttagaattaggtttttggtcacagcactttgggaggctgaggcgggtggatcaccggaggctgggagtttgagaccagcctgaccaacatggagaaaccccgtctctactaaaaatacaaaaattagtcaggcgtggtggtgcatgccaataatccgagctactcgggaggctgaggcaggagaatcacttgaacctgggaggtggaggttgtggtgagctgagattgcacaattgcactccagcctgggcagcaagaatgaaactctgtctcaaaaaaaaaaaaaaaagacttaggtttttgggcctcagatatactgggtcaagtattttcccatcataaatatttataaaatagaaaaggaaaaagcagaaaactatcacagttacatcacaaaaatcacatcaaatgtttataatttccaaaggagacagattttacctagtttctagcaaccgtggaaatttatcagcaaagaactccactctattttttcttgcctgagaaatgggatggaacgctaaccaaaagacagtgcaggcaaacgatttatcttatgaataatctcccccaaatccattttcttagaccatattctttcctgatttggaaatgggcaaaattattggttaatttttatgttggaaaaatgtcaattttttttcttttcttttttttttttttgagatggaatctctctctcttgcccaggctcaagtcagtggcatgatctcagctcactgcaacatctgcctccctgttcaagagattctcccacctcagcctcccaagtagctgataccacaggtgcatcccaccacacccggctaatttatatatatatatatatatatatatatatatatatatatatataatttttttttttttttgagacggagtctcgctctgtcgtgatcctggctcactgcaagctccacctcccgggttcacaccattcccctgcctcagcctcccaagtagctgggactacaggtgcccgccactatgcttggctaattttttgtattttttttagtagagacggggtttcaccgcgttagccaggatggtctctatctcctgatctcgtgatccacctgcctctgcctcccaaagtgctgggattacaggtgtgagccaccgcacccagccctaatttctatatttttagtagagatggggtttcaccatattggccaggctggtcttgaactcctgacctcaggtgatctgtccgcctcggcctcccaaagtgctgggaccacaggcatgagccatccaccatgcccagccaaatgtcctgattttaaattttaatgagcccatttatttctctggagagacgttgcatgcatgtgtgcatgcacgtgtgtgtgtgtgtgtgtgtgtgtgtttcaaagggaattacttctttgctaaggccttttatttgtattcactattacttatatttttaaatgccactaaaagtatttttagagaaaatcacatatacattggtgtttaaataagtgatatttatgatctggtcatacagttatttttaaattattcaatgttttactcaatattagacattggccatggaatacagcctgtgttttgatgatctgaatgttgacaggagccatctgtgttgctgagacattgtgtggcatgcagaatttatgacaacacaagaattcttttatgtttgtcatttcttctatttttttttaaacattagtgctgtgactttctttcatgtatacaggttaaaccaataaccgaaaaaacataattgtttcttaaggatacgaacaaattaaatatggatattatagcagttgagtggtttattggttgtaagtttacagttacctaaatctgtatttttcaataccagatactagaactatagaaggcatttttgaaactttgtttaaagtatccattggaagaagcaaagtttgcctgtagtgtaattacaaaagagtgataagaagttgcaaaaaatgtggagatcttttttatttttcaaccaattttccacattagttacattttacataattgtagtacaatatcaaaaccaggaaattgacattagtgatggtgtgtgtgcacgcttctgtgccattttataacttgtgtagtaactgtgccattttataacttgtgtagtaatgatcatcatatttaaggtatagaactattgtaccaccacagcattttcccatgtgtggtacctctttgcattctaaccattctcactttctctcaccattcctaacctctggtaaccactaaaactgttttacatctttataattttgttattttcagattttttataaatagtatcttacagtgttgaactttggagcttggctttttaaaactagcataacaccctggagatccattcaagtagttgtgtgcatcagtagttagtttctttttattgctgagtactgttccatgatatgggtgtaccacagtttaaataaactgttcaaataaataataaagatgttgattctcccaatttatgaatatggtatgtctctccattaatttaagcatttttgatttctttaatcagcatttttcagttttcagaacacagttcactacatgcttttttaattattattattatttaagttctaggatacatgtgcacaacgtgcaggtttgttacatatgtctacatgtgccatgttggtgtgctgcacctattaactcgtcatttacattaggtatatctcctaatgctctccctaccacctcccccaaccccacaacaagccccggtgtgtgatgttccccttcctgtgtccaagtgttctcattgttcaattcccatctatgagtgagaacatgcggtgtttgtttttttgttcttgcgatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgctgcagtaaacatacgtgtgcatgtgcctttatagcagcatgatttataatcctttgggtatatatccagtaatgggatggctgggtcaaatggtatttctagttctagatccttgaggaatcactacactatcttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctgtgatggccagtgatgatgagcttttttcatgtgtctgttggctgcataaatgtcttcttttgagaagtgtctgttcatatcctttgcccacttgttgatggggttgtttgtttttttcttgtaaatttgtttgagttctttgcagattctggatattagccctttgtcagatgagtagattgcaaaaattttctccccttctgtaggttgcctgttcactctgatggtagtttcttttgctgtgcagaagctctttagtttaattagatcccatttgtctattttagcttttattgccattgcttttggtgttttagacatgaagtccttgcccatgcctatgtcctgaatggtactgcctaggctttcttctagagtttttatggttttaggtctaacatttaagtctttaatccatcttgaattaatttttgtataaggtataaggaagggatccagtttcagctttctacatatggctagccagttttcccagcaccatttattaaatagggaatcctttccccatttcttgtttttctcaggtttgtcaaagattagatggttgtagatgtgtggtattatttctgagggctctgttctgttccattggtctatatctctgttttgataccagtaccatgctgttttggttactgtagccttgtagtatagtttgaagtcaggtggcatgatgcctccagctttgttcttttggcttaggatagtcttgaaaatgcgggctcttttttggttccatgtgaactttaaagtagttttttccaattctgtgaagaaagtaattggtagcttgatggggatggcattgaatctataaattaccttaggcagtaaggccattttcatgatattgattcttcctacccatgagcgtggaacgttcttccatttgttagtgtcctcttttatttcgttgggcagtggtttgtagttctccttgaagaggtccttcatgtcccttgtaagttggattcctatgtattttattctctttgaagcaattgtgaatgggagttctgtcatgatttggctctctgtctgttattggtgtataagaatgcttgtgatttttgcacaatgattttgtatcctgagactttgctgaagttgcttatcagcttaaggagattttgggctgagacgatggcgttttctagatatacaattatgtcatctgcaaacagggacaatttgacttcctcttttcctaattgaataccctttatttctttctcctgcctgattgccctggccagaacttccaacactatgttgaataggaatggtgagaaagggcatccctgtcttgtgccagtttcaaagggaatgcttccagtttttgcccattgagtatgatattggctgtgggtttttcataaatagttctgattattttgaaatacgtcccatcaatacctaatttattgagagtttttagcatgaagcgctgttgaattttgtcaatggccttttctgcatctattgagataatcatatggtttttgtctttggttctgtttatatgctggattatgtttattgatttgcgtatgttgaaccagccttgcatcccagggatgaagcccacttgatcatggtggataagctttttgatgtgctgctgtatttggtttgccagtgttttattgaggatttttgcatcgatgttcatcagggatattggtctaaaattctctttttttgttgtgtctctgccagtctttggtatcaggatgatgctggcctcataaaatgagttagggagggttccctctttttctattgattggaatagtttcagaaggaatgataccagctcctccttgtacctctggtagaattcggctgtgaatccatctggtcctggactttttttgtttggtaggctcttaattattgcctcaatttcagagcctgttgttggtctattcagggattcaagttcttcctggtttagtcttgggagggtatatgtgtcgaggaatttatccatttcttttagattttctagtttatttgcatagaggtgtttatggtattctctgatggtagtttgtatttctgtgggatcagtggtgatatcccctgtatcattttaattgcgtctatttgattcttctctcttttcttctttattagtcttgctagcagtatatcaattttgttgacattttcaaaaaaccagctcctggattcattgattcttttgaaggattttttgtgtctatttccttcagttctgctctgatcttagttatttcttgccttctgctggcttttgaatgtgtttgctcttgcttctctagttcttttaattgcgatgttagggtgtcaattttagatctttcctgctttctcttgtgggcatttagtgctataaatttccctctacacactgcttcaaatgtgtcccagagattctggtatgtcgtgtctttgttctcattggtttcaaagaacatctttatttctgccttcatttcgttatgtacccagtagtcattcaggagcaggttgttcagtttccatgtagttgcacagttttgagtgactttattaatcctgagttctagtttgattgcactgtggtctgagagactgtttgttatagtttctgttcttttacatttgctgaggagtgcttcacttcaactctgtggtcaattttggaataagtgtgatgtggtgctgagaagaatgtatagtctgttgatttggggtggagagttctgtagatgtctgttaggtccgcttggtgcagagctgagttcaattcctggatctcgttgttaactttctgtctcattgatctgtctaaggttgacagtggggtgttaaagtctttcattattattgtgtgggagtcagagtctctttctaggtctctaaggacttgctttatgaatctgggtgctcctgtattgggtgcatatatatttaaaatagttagctcttcttgttgaattgatccctttaccattatgtaatggcctcctttgtctcttttgatctttgttggtttaaagtctgttttatcagagactaggattgcaacccctaacttttttttgttttccatttgcttggtagatcttcctccatccctttattttgagcccatgtgtgtctctgcacatgagatcggtctcctgaatatagcacactgatgggtcttgactctttatccaatttgccagtctgtgtcttttaattggagcatttagcccatttacatttaaggttaatattgttatgtgtgaatttgatcctggcattatgatgttagctggttatgttgctcgttagttgatgcagtttcttcctagcatcgttggtgtttacaatttggcatgtttttgcagtggctggtaccagttgttcctttccatgtttagtgcttccttcaggagctcttttagggcaggcctggtggtgacaaagtctctcagcatttgtttatctgtaaagtattttatttctccttcacttatgaagcttagtttgactggatatgaaattctgggttgaaaattcttttctttaagaatgttgaatattggcccccactctcttctggcttgtagagtttcttctgagagatccgctgttagtctgacgggtttccctttgtgggtaacccagcctttctctctggctgcccttaacattttttccttcatttcagctttggtgaatctgacaattatgtgtcttggagttgctcttctcgaggattatctttgcggcgttctctgtatttcctgaatttgaacattggcctgccttgctaggttggggaagttctcctggataatatcttgcagggtgttttccaacttggttccattctccccgtcactttcaggtacaccaatcagatgtagatttggtcttttcacatagtcccatatttcttggaggctttgttcatttctttttactcttttttctctaaatttctgttctcgcttcatttcattcatttgatcttcaatcactgataccctttcttccagttgatcaaatcggctactgaagcttgtgcattcgtcacgtagttctcgtgccatggttttcagctccatcaggtcatttaaggacttctctacactggttcttctagttagccattcatctaatcttttctcaaggttgttaccttctttgcatggggttcgaacttcctcctttagtttgaagaagtttgatcttctgaagccttcttctctcaacttgtcgaagtcattctccgtccagctttgttccattgctggcgaggagctgcgttcctttggagggggagaggtgctctgatttttagaattttcagcttttctgctctgttttttccccatctttgtggttttatctacctttggtctttgatgatggtgaccgacagatgggattttggtgtggatgtcctttctgtttgttagttttccttctaatagtcaggaccctcagctgcaggtctgttggaatttgctggaggtccactccagaccctgtttgcctgggtatcagcagcggaggctgcagaacagcgaatattgctgaacagcaaatgtttctgcctgatcattcctctggaagcttcgtctcagatgggtacccagccgtgtgagttttcagtctgcccctactggggggtgcctcccagttaggctacttggaagtcagggacccacttgaggaggcagtctgtccattctcagatctcaaaccccatgctgggagaaccactactctcttcaaagctatcagacagggacatttaagtctgcagaggtttctgctgccttttgtttggctgtgccctgcccccagaggtggagtctacagaggcaggcaggcctccttgagctgaggtgggctccacccagttcgagcttcccggccactttctttacctactcaagcctcagcaatggcagacacccctcccccagccttgctgccaccttgcagttcaatctcagactgctgtgctagcaatgagggaggatccatgggcgtgggaccctccgagccaggcacaggatataatttcctggtgtgccgtttgctaagactgttggaaaagtgcagtattagagtgggagtgacctgattttccaggatccgtctgtcaccccttcccttggctaagaaagggaattccttgaccccttgtgcttcccgggtgaggggatgcctcgccctgcttccactcacactctgtgggctgcatacactgtcctgtccccactgtccaacaagccccagtgagatgaaactggtacctcagttggaaatgcagaaatcacccctcttctgggttgctcacgctgggagctgtagactggagctgttcctattcggccatcttctttggtgtaatctacatgctttcttagatttctttctggggtggttataagtgatactgttcgttaaatttcactttccctgtgctgattgctgatacttagaaaaaaaattgatttctgggccatgtgcggtggctcatgcctgtaatcccagcactttgagaggctgaagtgggcggatcacgaggtcaggagatggagaccatcctggctaacacaatgaaactctgtctctactaaaaatacaaaatattatccaggcatggtggcgggcacctgtagtcccagctattcaggaggctgaggcaggagaatggcattatcccgggaggtggataattgcagtgagcagagatagcgccactgcactccagcctgggtggcagaacgagactctgtctccaaaaaaaaaaaaaaagaaataaaattgatttctgtatattgaccttgtattttgtgaacttagtaaactcacttataagtttggagagtttttctgtagtttggggttttctatgttgaccattatgtcatctgtaaatagtaacagtgttctcactttttgatctgatgtcttttatttcccttctttgcattatgtcaccagcttggattttcattactatgttgaataagaattatgagaatgggcattcttgcctttttcctaatctaaggggaaaaagcattcagtctttcacctttgggtagatgttagctatcgatatttgggagatggtttttatcaagttgaagtagtttccctctattcctagattgctaagagtttttatcatgaatatgagttggattttgttacttttgttttggtaattgctatgaacctatgagttttcttctttagcctgttgattgcactgattgattttctaatagtaaactaatctcataggcctgaaataaaccccctttagtcatggtatgtagttctttttatatattcctgaattctagttagtagtattttgttaaagatttttacatctgtattctgggggttaatgctttttattctttatttttcttttgttgtactgtctttgtctgcttttgtattaagttaaacctggcctcataaatactttggaaggtgttttcttctcgtctgctttatggaagagatagtgtagaattaatgtttaattcttctttaaacatttagtagaatttagcagtaaaattatctgggcctggagatttcttttttgggagttttaaagttataaattcaacttctttaatagttattgacctattcaaatgacttctttcatcttggatgaattttgatagtttgtggttttgaggaattggccctttttctcagttgtcaaatatatgactgtaaagttgttcataatattcctttattaccttaatggctggagggtctgtagtgatattccttatttcattctgattttggtaatttaccttctctctttttctttgtcagtcttgctagtggtttgtcaattttacagatcttttcaaagaaccaacattttgttttcttgattttctctgtttttctatgttcaatttcaaggatcctgctcttttatagtgaaagtgagtttattagagaagtaaagaaacaaaagaattgttactccatagacagagccctgagggctgctagttggctatttttaatggttatttctcaatcatatgctaagcaaggggtggattattcatgagttttccgagaaaggaacgagaatttcccaaaactttaggtttctcttccttttaaactatatagggcagcagtccccaacctttttgacatcagggactggtttcatggaagacaacttttccacagatggggagagggttgtgggagcagtgtggatggtttcaggatgattcaagtgcattacatttattgtgcactttatttctattatgattacattgtaatatataatgaaataattatacaactcaccataatgtggaatcagtgggagccctgagcttatttttatgcagctagatggtcctgtctgggggtgatgggagacagtgacagattatctggcattagattatcataaggagcaagcaacctagatttctcgcatgtgcagttcacaataaagttcctgcttctgtgagaatctaatgctgctgctgatcttactggaggcagagttcaggtgataatgcaagcagtgggcagtagctgtaaatacagatgaagcttcaactcaactggcctgctgctcacctcctgctgtgttgtcaggttgctaatagcccatggattggtactggtccgtggcccaggggttggagacccatgatgtagggtaacttccagacattccgatggcatttgtgaactgtcaggtgctggtgggagtgtcttttggcatgttaatttattataattagcatataatgagcagtaaggatgaccagaggtcactttcattgccatcttggttgtggtgggttttggccagcttctttactgcaacatgttttatcggcagggtctttgtgaactgttatcttaatgccaaccttctcatccagtgactcatccggtgactgagaatgcctaacctcctgggaatgtagtccagctggtcttatcctcattttacccagcccctgttcaagatggaattgctctgattcaaatgcttctatttccccctcccctttacaaggggacccttaatcctaaaggttgtagagggaccaagatccatcttctgtagtatcctttggcttaataggggtgatgatattccttcctaacttgtagggtctcttgtattcaaggtagagtgaagcgcagtcataaagcagctatgtggtgaaagccattcataactctgagtcctgacaaaaggcgatatttgggagaccaaagtattatctgttcatggttcgttatggaatatattaccggaaaggggtctgatccagaccccaagagagggttcttggatctcacacaggaaattttgggtgagtccacagagtaaagtgaaaatgagtttattagagaagtaaagaaacaaaagaatggttacaccacaaaactgctgatgtctgcttttttttttttttctttcttcttactttgggtttattttggtcttattttctctagtttcttaagacatcagtttagcttattgatggaatttttttctcttttctgtctctacttcagctgtttcctacatattatatattttttcagctgtttcctatacattatgtattttcttttgcattcagtttgatatggttttttttttttttctcttgagacttcctctctgactgacccatggataacttaggggtatgaatgttagtatccaagtgtttggacatattcttgtcatctttctgttattgatttctaatttgatcccattgtggtcagagaacacattctgtataatttcaatattttaactttgttgtggtttgtcttgtggcccaaactatggtctgtcttggtaaatgttctgtggattcttgaaaagattgctttttgctattgttggatagaatattctgtaagcattgactaggtgctgttgttagtggtgtccttgagttttatgtcattgctgattttcttgtctagttatttttatcagttgttgggatggggtgttgagctctccaactgtaattgtagatttggcgattctctcagttttatgagattatgcttcagctactatacgtttctgcagtttggtgtgctgttaggatcactgtgtcttcttggtagattaacctttttatcattttgtgaggtctctttctatatgtgggtattctttttgctctgaagtctatttgataataatataagcacatcaaatttcttttgttttttttttttggcgtggtatatcgttttcatcttttattttaaaatatatatatttttatacctaacatgaatttcctgtaatctgcatatagttaggccatgaatctaccaatctgtcttttaatgggtatatttcagccctttatatttaatgtaatttttgctatgtaagtctgccattttatttttttcttttttctttatttctgttttttcttttctgtatattagttttttaataattctatttttatttatatatagtgttttgagtttatgtctttataataatgttttagttgttgctgtaggcattatatttcacacacacatacatatatatttaactatatatagtctactacatgtagaaactttatgtccttttaagtcccttttcctctcccatttataagtttcttaaatattttttatgcgtattttaagaagtacataagaaaatgtcacagccatacaagggtggaggcctacactccccagtcctccctttcttttttcttttttgagacggagtctcgctctgtcgcccaggctggagtgcagtggggtgatctcggctcacagcaagctccgcctcctgggttcatgctgttctcctgcctcagcctcccaagtagctgggactacaggcgcccgccaccacgcccggctaattttttgtatttttagtagagatggggtttcaccatgttagccaggatggtctggatctcctgacctcgtgatctgcccgcctcggcctcccaaagtgctgggattacaggcatgagccaccgcgcccggccttcccagtcctccctttctgatgggaatgggggctggggccacaggtttttctgtggtgttaggtagattactggatacaagtttcctgcattgctagtcttcctctttcctgatcctttggctagagtgtgcaggctttcttaaattttttttttgtgtgtgttccttgtcatttccaggggctggcttctctatcactcattttaggatacattaggcaaaaagaaaatcaccatatttttccttgggtcccaagctggtctcactttttctctctacctttcagaatattgtgttttatatatagtgcccagggtttttagctgtatttgacagcaggaaaagggagaagtatgtctactccatcttttcctgaaactggaattccctgttctattaaatgctgatcagagtatgttatttctactctctataagtaaattgacaagaagctaagtagttgacaccaaggaaagtaagagagctattattttcagggtggttatatttaatagaagaatttttaagatactcaaatcaaagtaatgaaaagaggaagaaagattccaccaattgctgtgggtgtttataaacaagaatgatcataattaatttaggcaggatcaggaaaagcttttaggaaatgggtttgaaagaacctaagggggctggataagattttgacagatgggtagagaagtggaagacgcattgtaggtggcagaaataaaatgagtaacattctttgtctttctgggcataagctctgatggcatacaactgtttgataggctaatagatgggtgccccttggcggtggcaggcagcgctgtttatgtatttatttcacaaggttgtctttcccttcttatactcagacctatgccagagattatgatttgttggtcttggggaaataaagacagatatcattgtttttggttttaaaatttcttaggtggttatagtgtgtggccgggattgacagatgctacagctgcatctctagataaacacagtaaattaatttaattttgtttaaatcagtaaatagttaacttagtgtctgctacatgctgggggagttttaggctatagaaggtgggacatctaatatcttttaaaactcctgcgaacttataggtactgtgacagatactttcacctaaattatttcaggaattaatgatctagcaggagagacaatttaatacaaagttgattgttttaaatgccatataaatagagttacaaaattaaaaatagagttataaaattactggagtggagatggggacagatatgagtaactaaattataggaactaaaagtaagagggttcttcgagatgaaccagtccagcctctgcatctgacaaataaggaaactgaggctcaaaaatcagtaattttctcaaggttacaaggcttgggaaagatccaaggaaaaaaagtttccctgattccaaggtcagtgctatttccacagacctgcaaaggtaaacatacctctttggtgaaggaaacaatgactgttttcttaaacatgtctatgaagttaccatctgaaagtttctttacttagtagtacagtgggtagaagcttggttctgcaaaacgcatagggaggatttggttgagaatttgtttagtataaatatagcctttgaaccaaaacatttcacaaacagcataacagcaggtagtatctatggagagcatctggggtcatcaccttattcaatgttttctaagctgtttttgccaaattagcaaaagaaaaaagtataataatttcaaaagataagatttttatttactagaatatcctaaagattgttaatttagtttttgtggcttttttttttcccttcatcaacatagaaaatggatcttttatgtttctgttttatattgaacaatgtgggatcacccttaaatttaaagaagtatttgattatacctgagtcaaagaatgttgatacggaaagtgagaaaaatttttttcatttcagacccttcataagatctgtaaacactgttaaactattatcgtaatttttaatacaatattatttttaagtcagattaattggtctgaaaaaatatacataatttcttttgcagatttaactgggtatgatcatgatttataggctgattttccttaatgatattttaagagtgtttcagtagatttttttgtgcatatgtttcagtcagtaaggaggctaaggacataagacccaatatggttccctttgtataacattgaacagttactttcttgaaaaaagttttttctgtaaagtgaggacattgaagtaaatgacatttcaggagtatcgtagttctgataatctgtgattaaaataagtaaagctaaaaagccacaagttattgaaattaaaaagcatgtccacgtaaccagtggcctacatgtcacattacaacatcctgaatcttttttaatgctgtgttggttttgctaactttagctaatgttctttatttttacctgctaatcctctgaaaacctgtgatttaagaagaaattttatttttttttgagacggagtcttgctctgttgcccaggctggaatgcagtggcgtcatctcggctcactgcaacctccacctcccaggttcaagcaattctcctgccttagcctcccgagtaactggttttacaggtggctgccaccacacctggctaatttttgtagttttagtaaagacagggtttcaccattttggccaggctggtcttcaactcctgacctcgtgatccacccgcctcatcctcccaaagtgctgggattacatgcgtgagcccactgcacccggccgaaataaaaatttttagatgataatttttttgtattgcctgattcacaaattggtgcattttctgtgtgtttaacacctaaagtctatctccccctttaaattccttctttttctgcaaaagactggaatctgctactttaacaagagatatatgatgataaatgtaatgtataccggaaagaatatattatttcttgtacattgtactacaaatattagaggaaaataattttttaaaaaaatattaaaaataactaggtttggattatgatgtatttttagtaatttgagctgcctgtattttaaaaaaatgaaatctgtcttctcgttaacactattgctctgtgttatttaaaagtaaaacaaagtatgacttggtttctctattttttggttcccttttttattatacctccctaccccatctctctctgcacagggtgggtattctgctccctccttctctccttggcagggctccttccaggggatcccacggactgttccaccgcaccgcagacagagtgagtctgtgtctctcactcctatcctgctctggcttccccttcatggtatttcccttctgcatgacctgttcctccccagcacctccttttctatcctgagtgctctgcaggcatctgctaaagcagcactctctgtggtctcctctcttaacacttccttttactgcatgtaaacagacctctacttagagccttatggaagctgtctgaggttaatttcattctaatactgtttaaacctattgccagtgaccctagacctactgacatgcatctgtctttaatgcattttcaaaaccttgaaatatgtgaataaaaattgttgtgttatctaattgttttaaaaagtgtacatgtgatctacaatggtatgatggacagatgcataatgtgtggggagcaggcttactagaccattgcacatttctttaaataatatttcctaattaagggcttggattgcatttcactgtcatctaaaataaagatatttctaattgttttttctaaaagtggtttaaaacaactaagatgtttttgtaatttatcagctttacagcacagaagaaatggcttttgaatatgcatggtttactaacatttctaatgatttagttactgtttgaccttaaaatttttgtttatgttaaatctcttttccaaaacagtgtgggttattttgttttatgtacttaagtatgcctggtaagttggttatattttatcttttttgaaaagtcacccataaaaagctattattaatgaaaatgaagtgtaaatacagtcaatcagaggtatttttatgccttctccaaggatttatcatgatttgtgattcattcaattttttcattatccatttccatgtgaagtatcaaaggtgtcaaaggaggaaattttaagcaattaggaatgtgatttatttaaagaaaattttatttcttgaattagccaaaattatgaggtatcgacatgaattccagagaaggcatgaagtttattttttggctgctacacctctccttcccttctgtactttttgttttaaagaaaaatcgtttctgtaggcttttatgtgatgttctttagtagcaagttcgtttgtttactggaagcaatgagaaaaggagtttttttgtcctcctccttttctatctcccaccaccttggtaactcctccttctcccaccaccttggtaactcctccttttcacttctctcgtcttcaagtaagttgctttcttttctcctctatttaaataatcccagcacaaaaagaatcatactaaaatgctagtcaagtcatctgaaatttcaaagggcagatacaacaaattatatgttcttaggcttgtggccagtaaacagcaaggtttgagatttcccctcagattagcacacccacctgtgtacttactcaagcccccttttagcctgtatccttttttgtcaccatgttcctccccctttctccttctcctcagctagctgtaatacggaattgaagtttgggattaattattctgtattacaaatagagtttcagctttacttttaaaaacatgtttatcagaaatacccatttcattggtttatttgtatagcattagaattttcttgtcttttccttgattcagtggctctccattttcaagtgcttcttctccttccttcttgggttcagagctttcctttttgtttccaactgtgaagcagcactatcctacaattcctacaatactagtaagacctgcttttttttttttttaaacctttctagatcaaaacttctttgcatcttcagattaacaaaaagaaagttttggttctccagagtttggatgtattagtcatctagggaaaaaaaaaaaaatatatatatatatatatatatatactcatatatatatatatgagtcttttcctgagtaggttctcacggcctgtgcatctaaaagcactggccctaggatttgatctttgagacttgtaggtccctgtttgtgcgaagtaatgaccagagggcctgttcacagccttttaataactattaatgagcttgaaaggttcctttagaggggaaatatgctctaaactactactctattttgaattcaccctgagaacagctaaagcagtttactaataaagggtttttttttagttataaaatatagaaaagaaaggtatgaaattattagaataaatctagtggttttccagagggttttgaaacagatctcttcttttcctatactaaacttgtagtcagatgatacttgtctccacatttaatcaatatgtgggtcctagtactcatgtttggagaggttgattgtgcttaagaagatagttgagagatttctccagtataatgtttcattaaaaagttctttgatgacttctttttttttttttttttttttgagacaagagtcttgctctgttgcccaggctggagtgcagtggccagatctcagctcactgcaagctccgcctcccgggttcacgccattctcctgcctcagcctcccaagtagctgggactacaggcgcctgccactacgcccatctaattttttgtatttttagtagagacgaggtttcaccgtgttagccagggtggtttcaaacttctgaccttgtgatctacctggctgggcctcccaaagtgctgggattacaggcgtgagccaccacgctcggcctctttgatgacttcttgaacatcagcttgagggaactgcctttatcctctaaatggggaggcgaggtaaagcttggctgtgagtcttcagtaacagcagtttgttgttttttaagttacggaagtatagtagaccttctagtatgaagatagtccgttctaaatatgcagagtgagataattaatgtttacagggagtatttagccctcgtcactctagaaagctgtagtggccagcagtgttcaaactgcgttgaagaatataggaaaataggcgaggcgcggtggctcacgcctgtaatcccagcactttgtggggccgaggcaggcggatcacgaggtcaggagatcgagaccatcctggttaacacggtgaaaccgcatctctactaaaaatacgaaaaattagcggggcgtggtggcgggtgcctgtagtcccagttagctactctggaggctgaggcaggagaatggcgtgaacccatgaggcggagcttgccgtgagccagatcgcaccactgtactccggcctgggcaacagagtgagactctgtctcaaaaaaaaagaatataggaaaatagagataaatggaaggttctggcctttattatttttccttctcaggaaattttgacttacatttcttaagtatattactagtctctacttcatgatacttttttatttcaaattaaattttctctaggttagcagaaaatatctacatttaggtctttcctgctgttagtagggatttgagcttttgtacaaattcacttaactggcattggtgtagtctttctactctaatttccaactgtgtaaaattgggagtaataaataacctacctcagagtaggaaaatttaataaaaataattgtttttggcaaatagaaagccttcctggtaattccaaatagcatttcttgccagagcatgtacttacaggaatacttgacttttcaaaaagtatgtttcgaaataatacctatttcttactgtgtctaactaagcttttaaaacttgctctttagtacctggcttgataaatttagaaatcctatttatttttaccttccatgtgcagtgacttaatgcgaagggaaaaagttcttttaaaacaataaaaattacataaatgcatctatatttgtcgtaatagcctgacagtttcttgatgtagtgttgtgtccaccataattatattaagaatgacaaatttatattgtcttacatcttctttctcttacaaatttcagggggtgtttcacaaacatttttgacatgcagtgattataaatttattttacatgacagcccagtatacatttactgagagaaagtatgtatttacaacaacctgattcactgtgtatgtatatttaaaattctgataaaagattcatgggacaatactttctcttaaaatatttgatcctctcatattttttctctctattctgtttttttaaatgttgctagcaacctgcagttaaaaaacattggtctattttgcccatataaatatgagcatttaggttttaatatactgactttaaatatgaaggctaagaagtgtagataatttaatgtgcatagattttgtgtgtataatcaaagtaaagcttttttttttttttgcagaaatactgtttttaagtggtgcctcctaagaattgtctatggcaggaaaaaatgtttattgttgaatattaatagagtggcttaaatggctgatgagccctttgtaagagccagcttttcctcagtttaaccaaaacgttgatcttactgaatgcccacctttgccatttgcctgcttatcctcgactgcactgtctcagtttagtaattcactgtacttattcttttagtccttttggctggagaattgttctcttgaaattcatacagttggataatctttctaagagctacttaaaaattacactttcacaaatattcctataggaaactcttatgtatatttttaaaaatttagccatacattttaagaaaggggaaaagactaatattaattgaatacctattatgtgttttaatgtcttaagtacttttctgggcatttcatttaaattatttgattctcacaacaactcagagccagagatattattccaattttataataaggaagatgcaaataaatcataaataaatcaataaatgatgtagtaatttgctcagggtaagtgaacaaaccataattaaattctgttctacttccagagtctgaaccttaaatattttttgtaaatacaatgactcttccttcaaaatgtacatttgtcctatttataatagtaatgtagtgactcattatggaggaattagaagaaacattttggtatatttcctttcagtcttttaaatattatgttataaagttgaatttatgtattttcagtcgttctgcttttttcacatagtatcattttatatatatacacacatttttatatggtaaatatttcttgaaattaacattttaatggccacttgataatgcattatgtggatatattctaaattaatttttttctattgggcattaatgtcgtttctagttacagagaggaatattggtaagcagtttatctttgtgtataaatcagtgtcagtgtctctcttttcttagatttcctggaaggatatcatttaattaaagggtatacactttctaaggccacttgatgtgtcaaatgtgtatttgacaattgttgaattgtcaaacatgctcataatgtataaattaacaaggctcaatctgattgactctaatgtgtgactataatcaattttatacataagaatagcttcagcttccttagaaattagctctgggagtgacttttcataaaaataaaatatttttgaatgaaatgcaaactagagtaactcagtaaaaaaactttactaattcaatttcgtgtatgctcatttttaatttaaatatggttaacatcaaatatggtattttgtaccttttcgcagccaatttcaaggactatctagtatagtcattggttaaatgactagaaatgtgcatctaactcatggtccaataggccttccacaaacgtaggcatgggttagtttcttggaattatgagaagtgcagcgttagtggtttctgtataaagccttttattacaatctgctttgcagcttgtgggattttttttagccagtcttttttctgtaccataatgcttacagtattcttgtactctggataaatatactgtgtctattgatcacatcaatggaactgtactattatgatgccatttaggttttttttcctgaactactctacatcatctgagaggtagatgttaatggattctgtgtctttgagatatagacccacgaaattaatcatctaagagtgattgtgcctctgtagtaaatgcttacttaagtccctcttaatcactttgatacttaaaaaaaaaaaaaccaaacccgttaactggtcatcaacttagaaaagccattgaactctttatttcagaaattatttttaaacaatttatattatcaatctgctatcctctaaattttctgaggtctagaggcaccattttgagatacagaggaataagagcattcctttttcccaaaaagcactggaagctgtgattggcttcatgtgatctctaaagcgaaagtctttaaatctagttgtaatacagtattagggatacaaattaagtctttctatactgatgtgcagagcctcacttataatttgcatcatattcaggttaagatcagattatacctttagtggtcttcaatggcaataattaaactggccgggcgtggtggctcacgcctgtgatcccagcactttgggaggccaaggtgggtggatcacaaagtcaggagttcgagaccagtctggccaacatagtgaaaccccgtctctactaaaaatacaaaaaaattagccgggcatggtggcaggcgcctgtaataccatctacttgggaggctgaggcaaggagaatcgcttgaacctgggaggtggaggctgcattgagccaagattgcactactgcactccagcctgggcaatagtgcaagactccatctcaaaaataaataaataaataaataaataaataaatctaacacttatttaatcttataatatgcagaagcctctgaaattacttaaaaattcatttctacctccttcataagaggttacttgggactaaaactttttaggtatttggagtatgaatattaaattttatcagaattactttcaatattttgtttggtaagagtcttcaagtgattcctcttaagtgtgtgtgagaagttttacacatgcctttctgaggttatgagtatttgtactaactcgcaaattactttagtaagaaagtataaatctatttaatgtttttgttatgtacaaatatattaaatgaaataatgaataatgcctaggaaaacacaacaatagcaaagcaaatacttgtggctgccacccagtcatggcaatccttggtgttgtgtgtggtctctgatgccattgtcctgtctttttcttgtctctgctctcccattatgccattggcaaggagttgagaagttagtccattacttctctgacaaagcgtggtacagtacaatttcggattttttcctaccaccttcctcataatcactttttttggtttttttttccagtttgcatgatgcatgtcagagcctgcatgaaagtacaggcatgttacagatggctctatttccaccttcctttttatggttaaaatgtatttaataataacaataaacttgtatgtacccaggaaaaaaattagctaaattctgtgtctgttatgcagtagcattattacactttagaacatttcctgctttctatttggtgcactttgacatatttttactccatcaggacttgacattttagctgccatcttttgctaataaccctagaacaagaatgcttatgaaaactggcatgagtgcttttccgtatgctaatgctgtagatctttgaagtgtcgtaaaacagtaaaggtgaactgttttgctcattggtgggtactactttgccttttttcatgttcattatgtttcccccaatgggtcactgtggaatcacctctttccagaaatactgctccacactgtggcttgagtttagtatctgaaagttatcctgggtaggctagatcatctaagaaggaaataggacattatccaggaaagttagttccttaatattggtattatatctgcctgtagtgttttaaaatatattaaaataatcatctggttatactgtatattctgaaagcctgtgaactcatcagaactaaccaaattgcacagaatattaaattttagtgctgtattttaagaaattatctgatggttcaaattctggctttgccacttgccaaaatgtttgaatttgaacacgttaacattttttaaccccagtttactcatttatagaaagaaaagaacagtatgtttcacctaggggtctcatggtaactagagatcatgcatgcagactcaagagtttgaatctatacccttggaaagaagggaacgctgttctctaagagcccagagtatgacatttctcaggtgtttatgtgtcaggcattgtactgttactggttattatttgcaacaattccatgaagtatatatactggtattaccctcattttgtaaattatgaaattccatttcagggtagtgggattatttttacccaatatctcacctcagtgatagatctataagtgatagagccaggattcaaactcagatcagcctgattgtaaaagctaagtgactcagtattgtgttgtactacctcctttgtagagagaagaaagttctctctaaacttgcatgtctttgctctggttcttatctccaggaaggcagttaaagatccttgacttctgtgtcatattaaatatgcttgatgtggattcaaaacttatagatagtgttgacattattgaactatgtatttgaagcctagcaacctcatattctagtttattattatattgctaaagaacttgcttttgtttcgaagacccagttacaaaatagctatgacttgaactcatcattcttatatgctttaataatcatagaagaaatttattgaggacatactatgtgctaggaagtcctatgctaaatgttttacatatgttgtcatatttaattattagaattttctagtagctgaatgcttgttaagatactttccccaacctatttctagtcttcagataaaaaacatttggtggctaagattttaaaaggtcattatgagaggtacttatgtataacatgcttgtgtataacatgcagtcagtatttcctgctatccttctaaacatgaatcattaagctaaccagacttatttggagggaacaattgttttttcctattagattatttttcatcagtgtttattttttgaaactagtttttatttaatcattaatgcttcatcattgacctaaatcactttggtaattcttggccaaataagtaattcttgaatataccactaatatttatttattcacttattcatttatctagcaaatgtatatttaatccctactttgtgccaaataatagaaataccaactataacgaaaaatgaataaagcatggtacatgcctgaaaggagctccaagtctttggctatctttgtaaagcagcctaaaatagacatttacaattatcattaaagatgtctaccaagcctttgcacaacccccctgtagtgcctattgctgacattattgaacttgacgcatggaactctttaatctgagaattatcagaatggtgtgctgaagtttacatgtataactaaagtaagacttgaagttgctgagttcagttagaggcacttagctctgtaagtctggggataggtcctcattttgatgcttcagtaaccaagccctccacaagtttcaggattaaagttttactcatttgtgactatagggagtagttaagatatgagatctttcgtagtggggggattccttttgccctctaggttttgtgggcttccgaggctatgaaatccatcgattagcggaaagccttcccaaaggccttttttggatacaagccaatacctcatcttgcctgtccccttcaaatctttttcagtcctctccagattttatgccaaatagcttgtgatatggtttttctgacaatttcgtccccactggttacattcctcactggttccactggagtgatcattctaaaacacacacattagatattctgattcctcttcttaaaattcatctatatctcccatcatctacagcacaaagtcatagctacttagcctgacatgagtcctaggagctggcccttagctatgcttttgcactatcctttcaaattcagtctaaaatttgaagtgaccagaacatggcatgttctttttttgcctctgtgtttggcatgtactagctcattacacagaatattcttcccttcttgtttatttgataaactcctattcaccctgttaaaactcagggcagattgttcgcggttctggaatgcctcctgtgacctctccaggcaggcatgttttctttttgttcccatatgttgttacgcttaagacatgatctcaccattcctttaccttattgtctccctcactaagctcctcaagcacaggaacaaagttatgttcagctccagattttctcactcctagtacagtacatgatacataataaacatttaaaaagtgtatgctttttgatattcattcctatttgtcttagccatgaggatatgggatctttttatatttacattctaaaaatgtctgagggcatccttttaatgaccatagaagcagcagtggatgtgagcaagatgaattaacatctggcatttatatgaacacagttgaatgtttagtatttggggaaattgtagcaacaagccatcagaacacatctctgccttgcttgctagaggttaagaggtagcttgttgttcaacttgctagcaggggtaattagcggcaatccagtccttagtgggtaaccacttccatgtagtcttccacataccaggagcaagttgtttccttgttcctcacattataggtgtttcttattcctcgtgaaagagactttttgtttttacagtagtggaattgattttccaaatatagttaccaaataaataataaagcaagacactgatttggggatagggaaattatatcatgccacaaaaattaatttttaataaaaatataaaattttatttcgcatatagaaaccactgatttagttaatgtaattcactagtagtatagatgtctaacttgtagtttagacatttatttataaaactgttaaattcctctcggttgactcaacattttgttattctttaaaaactggatgttttctaattcattaatatttgatatgaagctttattgcatttaatacaagtagcttgtctttctgactctgctgtatttccgtttatttctctgataagcagtggtcagttgggtactgtgagtaatcaaaacagtacaagtggtgagtacaaaacagtacaaatttatagtgcacaatggccctttcctgggcatttctggaggtaggttgtcttaataatcagtttattacctgtcttaattgaaaaatcatctttttatgcttttcactgatagcacatgtttataccttttttcttattggcaatagacatattacaataaagtccatttttaaattgtcactgatattttcagaagtcttaaattgctttaagagttttaacttggaactagaatatcttaccatgtttgagggtgaaaaggaaaaacaaatccccattcaaccaaccaattgatcgtgcctccttcctaattactttttattccctttggtagattttggtttgtttaatatggtcctgctctattttttcactaatctttcaaggtttttgatcactttggcacggtcatttttatctagggaaccccagggagaatctgttgatttaattatgtggtgattttagtatcttccgttttgcgggacagttcattcatttttgtgttgatgtgctgtgaaaatacccagtgactttaaagtctgggatatttagcttgaggcagcaattgagctgacttgtttatttcaaacattctgcaatacgatttgatgtgacatatttctgtacagattaattttgagtagtcactgtcttgatttttttttaatgcaagtcagctgtatgccatcatagccaaccatcctccatgagttgatgagccttgccctcagtcactcccaatccagccataatctaatccctggctgctgatcctgggcagccattgtccagtgctggtcagggaggtggaagaactgaaaaaaacacaaatgatgcagtataaatagatccgccccttctattggggaaattagagctactatgtagatttatttgtggattagcatagcaaaaaaaacttattagtgagaaatggccctctgaatttcatgttgtaaagccctttgccaaagtttttgacattttagcccacattatttaaacagtgtgtgtgtgtgtgtgtgtgtgtgtgtgagagagagagagagagagaggagagagataatgcatttgtagcaaatacccctgtatcaggacaggcccagttggccctgcccatatattttaactatttgggccattgaaagatagctttcagatttgtattttttactggatacccccaaatcatggaaatggcatagttcctctgattgtttttgaaacataactacacaatgagcttcagggaagtacatgtgaggcacacagaccctaagaaccttgtcataggcttctgttctttagttgcagttagaggcaacttcacatttgttttactctgagccatcattcaaaaggctgattattctaaatttaagtaaatgaatgtttacttttcattagggtagatctgtttttcacatgtcagccataataggagtgagacagaacaaataaactttgaaacattttatttggaaacttttcaacaagaatattaaaaataggttagcattagctaaatgtctcgacctatatttgttaaataaatagaatttcacataaactgagaatatagtgatttactctaaatcttgtttatctgctggtgcttttcattcttgacagaagaacaacacttgttaacatggtgtacaacttttttttttaactttaatgtaagtagtattccgaaggtcaccgttaacacctgaatgttttgtggaggttaaaccaaaagctgtagaatcattctgtcaagctctaaggtttaaaatacctaatgaatctattatggcaggaattttttctataataaattagtactttaatgttttctttttctcatttaattttggatcttgttcagtgtttactgcctgtatcattttttgtttgcattatcactcttgtatgtgtctaatttgcttgaatattgcagttcattttttaattaaaagaaactccacatattttccatattaaagccataataagtaccaacacagcctaattggtatttatattaaatctgggtggaatttctaagaacttgctgctaatgttgtttttaattttaacagcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccacgtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgagatttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttatcgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaaagttctcttgtctttctcaacattgactcccatagtttgctttttctttgatatcttttttcccacaaagatctaagatactgttcatttgcttatgtttttcccaactctgatactttattttacatgctgccttcacacacatcttgacaccccaagccctgattgagtaggagttgatcagtattttgttgttgtgtcttcacaaattctgtaagagatctagtactttcgtttccattgtaataaaatacctgctttatcttagaatattgggataatggttaatggacatttcaagaaacattagcaccttggatttagaatgctgtacaaggaagaaaacacttgtaattttaattattttgtcattgtttttaagcagtatacaaaatagcttgaggcaagaaaggtgtttagtgaaattttacataatttttaggaacaaaaggagtaaggaatatatattttttcagttttacagtttagtcagatgcgatagtcccgtaataagagacaaaaaagttgatgcagtggtatgttattaatccaaaatgtttacacgaattctgggaaaggagggaaattttattaatagtttgataatagcacttattacctcttaagacacctgtatgaactttaaggccatctgagttcttagtgttgcagaattttgctccttaggtcggctaaatcggggttcttgtgtcaggaccaggaaaatgtagacacatggacacattgaagtgtgtggggaatggaattcattgggcaaaaaggaaaaaaaaactcagcaaagcaaggggggaatcctgctaacaggcccccacctcacagataagttccaggccaccacacatgtgagctgaagagctcaggctcttccctcctgcccaaggctggaacttcccgtggctccacccagttctcccagtgcacaagctggttggagattctctgaggaccctcccccttattggccttctgcatctatcattagcaagtactttcttatactaaaaattttcccttttaattttgtcattaagtgtagtcatttcagtttcttcatttatgctgttgattgcgcgttttccattgtgaaaatattttatccctacagaaaagacaagcatgagttaaagaattgacttcttcctctgttaacttggtttaagtaagtttgatgggatgtcttacctgtgtcacttgctgtgctggctgcagggtgtacaaaggtaacgatgatacaggttctgccttatggagcttaggaaccctaggggatttttaacatcatccgatccattgcagcactgagcccttcccttgcattccctgtttattatcttcctttgaacctaccagtctcttttgacgtttcctcttcagtttcatttcattctgggctttaactcccttgcactattctcctcttggattctatattatgtttattcttgtttggttgcatgccttcatttccctagaaaacctggccttttattattttatccaagaacgaacttcctctttagccactattaaatactctgctttctactttaggttcttggaatttgattttaagacttctcgactatcctaaggccactgtcccttttagaacctcaacccataagatgttgctttctgaagtctacctttaacattcaaattcatgtccgggcttttccttccatcccattctcttggatagatcaaatataatatggtctacttgatgttttcagtttctattttaatttttaatttttatggatatataataattatacatatttattaaatacctgttatttcgatacaagcatacactataatctgtgtaattgggatatccattgcctcatttatttctttgtgctaggaatatttcaatactactcttctggttattttgaaatatacaataaattattgttaactatggtcactgtactgtgctactgaacactaggtcctattcattctaactgtatttttgtacccattaaccatcccctctttatcccacctccccaccaccctttccagcctttggtaaccactattctactctctacctctgttagatcatttcttttttatcttccacatgagtgagaatgtgcaacatttgtcttcctgtatgtggcttatttcacataatgacctccagtttcattcatgttgttgctggtttcctaccatttcttgccatggagtctctaaggaggaatttaggtcatccagagaagccttttcctcactgatgaattctcccacccacccatgcacacagccctcaaattagcatcttttctgtgcaaaaatcagagaggaagaaacagttcctcacaggcacttctctggtttctcaacctgaaaaatggtattgctactttccagatctcaaaacaacccactccttaatcctcacatgaattcattcagacacccattttgagtatgaataatcctttggtaatactttaagtgattacagaacaaatgctttctgcagcaaaagtatacctgaaatatcagtctactaaagtgaaaggtaactattccccacaagaaacatggttgaaatgcttgttttgtgcacagccctcgtttctgtctcgtggcaggaggtggatgagacggagaccctgcgattgaagagatcaaattgcaacatgacaagaaggatcccaaacaaagcactgtaagagagccagtgggcaggaaggggacgtttgggaccacaggtgaactcgcttccaaaaccattcatccttgacaaatgtgcatgtgtgttaggatttctttttaattacagctaaataaaaactaggccactatcacataacctgtagtggtaacgatacattccacgaacctgaggcctttttaagcacgtatcagttcaaaatacttctgaattatcaggaatttaaaaaattttcacaagttttagctgaggttttgcatttatagtaggtcaagtgcaaatgtgaattgcaatgaaaaacaaaagtaataggagttgtgatggattgttaatgcaaatggtttcttaaattgtgttccagagttttgctgagatgcaaacacagatgctctaaactccctgctgccaggggccgcctccaccaggttcaaagattcaggactagtcagagctcacaggaggtgtttgggaaagggtttgggccagacctgggcactcagaaccctggtccttggtctgactactctcattctaagaaaaatttcaactaagggaaggaaagcagagcacacagtgctttcctgcctttcagagctcgtaaagaattcaagggggaagcaaaggagaccatggacttagaactatttgtgaatattacaagaagcattactgaagtcacagaacaaaccaccaaagtacaaagggccaatataacagaacaaattaatgatttttgctattagtcaaagagatgcaaaacagaatggcgtgctacttacatacctttacatgcaaagaactgtttaaaagagtggagcattggaaaaaaaaagtctgacagtaggagaatgattacattatttatatgacaagatgatgccacagtcagctaatgctcttggggaatatttactcaaaatatgtataacaatatttattcaaaatattcatattacaactgaggacaaaagcaaatttacgaatccatgaatgtagtacaatgtgaatacatatatgcttataaatacctatataaaagaataacttcttaatggctgaattattggccattttttaatctttttatatattttctgttttttaaaaatggtgagactatgctcttataatcaaaattgcatgtgtatgtctgtgtgtttaataacagggtcatttctgttgcccaggcaacatttgtaaggcacctggcgtataggcatccaataattaatctcccttgccacagatttaatgagtggtctttgtcatcatgggatgatgtttcagaaaattttaagtcacttattcaatgacatagcaaatggcctatctccctaacctcaaaactagtaagactgcattattgttttactcctttttttgttctggtaattggggttgggaacacattaccttatgaatcaggatccgtccactgtcagtgacaaaatctatttctgccaaacttgaatagtttgttcccttagcatggaagcttggagagattcgtccttatttatgtcaacccttctctgtgttctttgtgtagtattttcttattagtcatcagttccgtctacaccatcccaaataggagtgccctaaacaaaatctttatagactgacaagtcctttccagcgtcctgctgcatgagggctgtttgctgtgggatgtcaactcttagtatattaactggaccttagtgcgtagtgtgacggaatgcaaattgcattgaacacatttttatagcatggcttgtggtgctggaaaccagaaaagacagatcccagggctttgccccacacactagttacaggattgaggattcctctggtttgttcagccactgctctgctgcctcctgcctcccaggctgggatgagctaaagaacaggccatctaattctgctcactggtttcgagccacggaaggagaccttaacctttaattataacgtttacttatggtttccttaaagctaagccagtgctactctggtttggggtgagtggggaaagcctactagagtccagttgcccagctctcagcagcacaaggcctggtcagagcttccttccttaaggagcaaacacacaagactgcatgaaagaaataggacaggaaaaggaatcctaaagcaagcaactgtgttaaaatccaagcaggtattgacttcttttgtacaaagaagtaaaatttttcccacaacaactacttttctctttttatcaatatttaattttctgtaaccacacttcaccaccacttttctaataacttttaactgcaaagttatgtgaccatttttctctgcctgagaaaatgggatttttttttcttttcttctgaatactgccctccccgcagcccctcccaaccccccgccctgtgacaacctcagaacatcaaaggcaagtgttttatgcaccgtgtacattcactgtctggctctctgccaggctggaggggagagcagagacttgtgctggccaggtcaggctctgtgcacagggatttgggctgcgggggaagctgctctttatcctcttctgccttagagcaggcaagatgggaacactcttcttagcatcttttaatccatgttgtctgtgctctgtcactcccgcttctgagtattcccaatagtcaaaagaattttgcccagtttccctcagtcctttgcattacacattataaattacatttgaagacacatctttgcataaggcatcaggccctgtaagccaccccatccccatccccactcaacactcactggtgagatgataagccattttttaaatgtttattttattttatttttttgagatggagtctcactctatcacccaggcttgagtgcagtggtgcgatcttggctcactgcaacctccacatcccgggttcaagggattctcctgcctcagcctcctgagtagctgggattacaggcgcccgccaccactcctggctaattttttttttttttttttttttgtagagactggggttttaccatgttggccaggctggctttgtactcctgacctcaggtgatccacccactttggcctcccaaaatgctgagattacagcatgagccactgtgcttgccaaaccattttttttcaagtaggttagttttcaaaagctgtgtggtctcattttactgttttttgtttgtttgtttgtttgaagagtcattactttattgaagcacattttacatatataatttattccaagtatacaattaagagattttttataataaaaaaattagctgagcctggggtgacatgcacctgtggtctcagctacttgacagcctgaggtgggaggatcacttgagcccaggaggtcaaggctgcagtgagctgtgattacaccactgcactccagcctgggtgacaaagtgagaccctgtctcaaaaaaaaaaaaaaaagattttttagtaagtttaccaagtgtgcaacctttgccatttagaatattagaatatttccattaccccaactgttaatctctgccccctcttgattaagccaagcatcatctactttttgtctctatttatttgctttttctggacctttcacataaataaaatcatatcagatgtattctctgtgtctgctttcttccacttagcataacaattttgaagttcaccaaaaatcatagcatgaatcacatcatttttattgttgaataatattccattatatgagcatactttattttgtctattcattcaccagtttgtagacatttacattgtttctaatttttggcaattatgaatactactgctagcaacgtttatgtgtaagtctttggacatattgagagaggaggaaggaagaaacccatcaggcaggcaattaaggggggtcctgggttgagttctttcagacaaaagaacagcctgcaggcacagataagagaccttgcacagtggggctagcctgagacatgcccacagcctcacagataagagcggctatacaggagatttgtctagacatgcctgcaatggaaaattctgtcccctgacacgtgcacagtaaggggaacaaaacaatgtggagtaactcaagctaaggacccacatgcacattaggagtgttaccagggggtccttgctcccagagctctcaagatggtggcaggccgctaccaagatagcggcaagcctcttgttctctgacctgggattcttggcctcatggattccaaggaatggaatcttgggccatgcagtgagtgttatagctctattagaagccgtgggtcacggcagagaactgtggaacccagcgactagggttcagctcgattaggacaaacctgggcacttagccatggaggaacaatggcaagcctttagcctgatcgggagtggcaatgggtgcctcactggatcgggagcacagcggacaccctgccagatccggaggggtggaagtcagcggcgggtatgcgagggcggcaaacagcagtggtggatggtgagcaaaagctcagctcgagctgtaacacaaacatggaccaaaacagtgtgcagttgcaagatttaagagtgaaaacagagctcccatacaaagggaggggacccaaatggggtagccgttgccagctcgaatgctgggtttatatcccgatcattgtccctcccgctgtgctctgaggcgatagatgattggctatttctttaccttctgtttttgcctaatcagcattttagtgagctctctttactacatgattggtcaagtgtgaattaagttgcaagccctttgtttaaaggtggatgcagtcaccttcccagctaggcttagggattcttagttggcctaggaaatccagctagtcctgtctctcagtaccccctctcaacaagaaaacccaagtgctgttggggaggttggccgacgaccactctaactgcttcctgctgaattggggcatagtaggagttgtgcagttgagatttccttgggaggggtgccttcgatgtcattaacattggagcatgggctagaaggccagtccaggggtctgcagtagatcttagttatggactgcatctggggttccatttgaagaaccatttatagttttacagtttccattctggaagagacaaacttaacaaggaggttaaagatacagggattgaagtgtatggcctgaagtgcaggggattatttctttggcatgcttcacaggccctgactgtctacttgatagttttgaaaaggcctggtccagtaaataatgatttggccctctgatgggtgctatcaatgcctaagtgaaaggtttggtgaaggattttaagtaatttccattggttaactataagcaaaagtattttttccttttcagtggctagccatcctaaggggaggaaactatgtccttgtgaggttccccattctatttcttctgctgagtactggggcttggtttcccagaggggattaccccatactagtggtccttctataagcatttctaacggagggtctcaccttgaggctcctttggcttcaatatctgcttggctgttcccttctatttccctttcctttccgatgagcctggtagtgtaagactgccacctctttaggtttctgtacagccaataataatctcctaatggcttcctgatgtgtgataggtgttcctttggaagttaggaattccctttctctccatattgctgcgtgggcatggaggactaggtaagcatacttagagtctgtatatatatatttaccctttttccttctcctaattctagtgtataatggcccctgcttttgctagtatgtctctccctaacaaaggagtggggctttcaggcataattagaaaggcatgtgaaaacagtaaagttccccagtcacaacttagtggctgggagaagtatctagtgactgcctgtcctaggacccctcggatagtgacagatctggaggacagttgtccaggacaggagagaaagactgagaaggccgcgccagtgtccaggagacagttaacctcctggcccttaatggtcaaacatacccgggggctctgtgagggtgatggcatgggctggcacttgcccccggcaccctcagtcctgctgctggatcatctggttagtggcttctgactcagaggacctttgtcccccggggcagtgggccttccagtgattcccttgacataaggggcatggatgagggggcggcttatgtctattcagacaatcttttttagtgtccttgtagaccatactggaagcaagccctattaggcattcgatttgcccagactttctgtgttccagagcctccaaagtctgcttgcctgagggccatgactaaagcagtggcctttttcttatctcgtttgtccagttctacctgttcctcctgatctctattataaaaaaccgaggttgccaagtttaatagggtttctaagttttgctccaggcctaaggtagacttttgaagttttttttttaatgtctgcagctgactgagtgataaatttatcctttaagattagttggccttcaatagagtcaggtgacaaagaggtatgcttcctcaatgcctcccttagtctctccagaaaggcagtaggattttcttcctttccctgtgttatagtggacatcattgaataatttataggctgctgcttagttttctttagtccttctagcacgcaagttagtaaatgtctgcagcaccaatctccatgttctaattctgcatcccaatgagggtctacactgggaactgcctgctggcctgtggggaattgttctctttcctctgttgtcgttctatcattgatctgactgagataccagagatcgctgaactctcgggctgcagttatggtggcacttctctcatttggggttagtgtctgatctagcagtaacattatatctctccatgtcagattaaaggatgattgtcctaaccgttataaaacatcaatatagccatcagagttatctgagaatttacctgggtctattttaatttgcttcaagtctgacagggaaaaaggtacatacactctgaccaggctgaattctccagaatacatcttagggtagtttttgtcttggggggaatgtttcccatctgaaaaaaaaagacaaccttgggaggccagcacccctagtcatttcctgatgagcattagtcctagagcgtcctctatggtcctaatgcttattcctttccagggtgcataatcacccatggacctctgcttatcagattagttacgctcaccgacgtagcagtcctgcatcctttttcccacatttcttgaccacaaagaaaggggtctgggctgctggattcgaatggtcctttaccagtgtgcccaacattgcctttgtgctcagggatgagtcctagagcagggctgggttcctgagtatttcataacaacccagttgccccatcaggatgcattcccataaacaacagttcttgtgcaaattcgtttcagagagggtgtaggtaaccttttgagtcaggattgagatagagttttttgattctgtaagtactttaagacttggctgagtgcaaacagctctaacatttgaggagaccaattattaggcaattcttctaactctgcttccacaagagtctccctatcaattactgaatatccattgtggtttttttttctcaatcacctgggaggaaccatctatccttgtcctgaagggagttcctcctaggtctggtcagacctttgattagtaattaatatttaaatctcctgttaggaaacctgctgggttaagggaattttcagtggttaatgttaagtcacctttttctaacagaatagcctcatactttaagatttgagttagtaagctacctttttgcttttttgactaaggataattctgaactggtgaggtgtgctcacaatgaggtttcctctaaaagttatttttctactttcttctgttagcaaagcggttgctgctacagactgaatgcatttgggtcatccgcgggttactgggttaaggatttttgataggaaggctacgggttgtcagtggtctcagtgttttcaggctatgcccttgttttcactgacaacaaggtagtattggagtgttatagggtcatggagaagaccttcaattatcaattataagttttaaatttactctggcttttaaaggaatagggcacacttttttctttactacttctatctttctctttctttctctctttgactccctccttgtctctctctctctctcccctctgtctctctctctctctctctcttttctcctagccctttacaaacatgggggcctggcaagggtggtggggaacaggtcccatataactgcctatgttgagagctgtatgcctaaattgggagggacaacagggacaagactctctgggttcatagcctaggggcctatggatgcagagtagagcttccttagatccctttggaaatacaacttgctagaggaaatgaaagtctgaaccattattacctaggaggcagggattggaggaagtagattcagaggtaaggagaattttggggctacactttcaagaaagttgtggttgggacccaggaggtatgggtcagaaggaaaggtaggggcgcacacatgggcgactgttgaatagagacttctggctgcaccatgatctcaactggttaatgccgggagttcagaacgacagctttctgcctctagtcggcccttggcttccccaggaaaattgaaagtggaagctggttttaggcagaccaacactcccaacccagaagggttgggggttgttagaaagcccttccccagacagcctcacacctgagtcttaagtcccacggccacgctaatcgtttttaacaggctgatgggtgcctgatattttcctccagttctaaggaaggatagtacagaatagcaagtgaaagtggtccaatgttactcaccgctttggaggtccttacatggttgtcaaaatgttactgtggggggaccttgctcccagagctcccaagatggtggcaggccacttccaagatggcagcaagcctcttattctctgacctggggttcttggcctcacggattccaaggaatggaatcttgggccatgtggtgaatgttatagctctattagaagccatgggtcatggaagagaaccgtggcatccagcgactagtgtttagctcgattaggacaaacccaggcacttagccatgcaggaacaatggcaagtctttagcccaatcgggagcagcaatgggcgcctcactggatcaggagcacagcggacaccctgccagatccagaggggtggaagtcagcggcgggtctgcaatggtggcaaatggcagttgtggatggcaagcgaaagctcagctcgagccataacaaacatggaccaaaacagcgtgcagttgcaagatttaatagggtgaaaacagagctcccatacaaagggaggggacccaaagtgggtagccattgctggctcgaatgcctggtttatatcccaatcattgtccctcccgctgtgctctgaggcgatagaagattggctatttctttaccttctgtttttgcctgattagcattttagtgagctctctttactacctgattggtcgagtacgagctaagttgcaagacccttgtttaaaggcggatgtggtcaccttcccagctaggcttagggattcttaatcggcctaggaaatccaggtagtcctgtctctcaggaggatggggtggagctaccagaaatacatgccttatgcaaatgagacatgcagctctcattggtttcttttaaagcctctgtactcagctgtgaaacagcaacccttttttaggacccctctctgtggcagagagctttctctctttctttcccttattaaacttctgctgtaacctcacccttggcatgtatgtgtccttgatttcctcggctgtgagacaaagaacttcaggtggcaccccagaaaatgaggccatttcaatatatttttgtttctcttgggtagatacctaagagtggaatttgctggatcatatgaaaaattgatgtataacttgttaagaagctgccaaactgtttttcaagttggcttcaccattttatgtccctagtagcgatgtataagtgttcccatttctccacattcttgacatttgttactgtatattttattatagccattgtgctgcatgtgaaatggtgtctcattgtgcttttgctttgtgttttcctaatgactaatacaatgagcatcttttcatgtgctttgcttattagacattcatacaccttctttggtgaaatatccatttaaatctttgtccatggtttttgatgggcttgcttatcaagtatgagcattctttgtatattctagatacaagtcactatcagatacgtgttgtgcagatattttctcagtctgttgtttgtctatgtcttttggggcataagagttttttgattttgatgaagtcaaatttatcaatttttttcttttgttttttgcttttggtgttatatctaagaaatttttgccttgcccaaggccttgagggttttctcctatgtcatcttctaaaagtcatattgttttagctcttacgtgtaagtctgtgatccactttgagttaatttttgtgtatggaatgaggtgggggttaaagctcatctttttgcatgtggataccaaattgtctcaccactattggttaatagggctatcctttacccaaggcactctcttggcacttttgttgaaagtaaattgaatgtaaataaaagaatttattgtctggatggtcagctctgttctgtggatccatacatctgttctcataccagaccacactgtcttcataattgtattatagctttacagtaagttttgaagttaggaaattaaagtcctccaaatttgctcttctttttcaaaatttatttggctattcatggtcttttataagtccatataaattttaggatcatattgttaagttctgcaaaaatgcatgctggaattttgataggaattgcatggaaactattcagtttgggaagaatagtcatcttgtcaacactgaattttccgatccatgaacatgaaatgtctctaaaattatatagatttttaaaatttccctcagcaatgttttataattttcagtgtaaaaatcttatacttcttttgttaaatttattcctaagtattttattttttgttgctgttgtgcaaggaattgtatccttaatatctttttcagattgttcattgtttatacatagaagtgcaattgatttttgtatactgatcctgtatcctgagacttactgtgcttacgatatggtttggctgtgtccccacccaaatctcatcttgaatgttagctcccataattcccatgtgttctgggagggacccagtgggagataattgaatcgtgggagcaggtctttcctgtgctgttttcatggtagtgaataagtctcacgtgatctatggttttataaaggggagtttccctgatcattctctctcttgtctgccactgtgtaagatgtgcctttcaccttctgccacgattgtgaggcttcctcaggtatgtggaactgtgagtccattaatataaattaccgagttttgggtatgtcttgatcagcagcatgaaaacagattaatacagtaaattggtactgagagtgggatgctgccgtaaagatatctgaaaatgtgcaagcaactttggaactgagtaacaggcagaacttggaacagtttggagggctcagaagaaggcaggaaaatgtggggaagtttggaacttcctagagacttggagggctcagaagacaggaagatgtggggaagtttggaacttcctagagacttgttgaatggctttgaccaaattgcttacggtgatatggacaataaggtccaggctgaggtggtctcagatggagatgaggaacttgttgggaagtggagtaaaggccactcttgctatgcaaagagattggcagcattttgcccctgccctagagatatgtggaactttgaatttgagagagatgatttagggtatctggtggaagaaatttctttcttttttttttgagacggagtttcactcctgttactcaggctggagtgcaatggtgcaatctcggctcaccacaaactccgcctctcgggtacaagcgattctcctgcctcagcctcccgagtagctgggattataggcatgcatcaccacgcctggctaattttgtatttttagtagagatggggtgtctccatgttggtcaggctggtctcgaacttccaacctcaggtgatccgcctgcctcaggctcccaaagtgctgggattacaggcatgagccaccacgcccaaacatggtggaagaaattttgaagcaggaaagtgttcaagaggaagcagagcacaaacatttggaaaatttgcagcctgatgatgtgatagaaaagaaaaaccgattttctggggagaaattcaagccggcagcagaaattgggtaagtaacaaggagtccaatgttaatcaccaagcaaatggggaaaatgtctccaaggcatgtcagagaacttcaaggcaacccctccaatcacaggccagagacgtaggagggtttcctgggccgggtccagggccttatgctgtgtacaactcagggacttgctgccctgtgtcccagttgctccagctgtggctaaaaggtgccaaggtacagctcgggctgtgactccaaatggtgcaagccccaagccttggcagcttccacgtggtgttgagcctgcaggtgcacagaagtcaagaattgaggtttgtgaacttctgtgtagatttcagaggatgtatggaaacacctggatctccaggcaaaagtttgctgcaggggtggggccctcatggagaacctctgtgagggcagtgcagaagggaaatatggggtcgagctctcacacagagtccctactggggcaccacctagtggagctgtaagaagagggccaccctcctccagaccccagaatggtagattcaccaacaacttgcaccatgcaactggtaaagcctcagacactcaatgccagcctgtgaaagcagccaggagaggtgctgtatccagcaaagcctcaggggcggagctgcccaaggccatgggagcccacctcttctgtcagcatgacctgaatgtgagacacggagtcaaaggagatcattttggaactttaagatttaatgacttccctactgggttttggacttgcatgggacctgtggcccctttgttttggccaatttctcccatttggagtgggtttatttgcccagtgcctgtaaccccattgtatctaggaagtatctaacttgcttttgattttacaggcttataaggtggaagggacttgccttgtctcaaatgagactttgctgaaagaagactttgggggactgttgggaaggcatgatatgttttgaaatgtgaggacatgagatttgggagaggttaggggtggaataatatggttaggctgtatcctcacccaaatctcagtttgaattgtagctcccgtaattaccacatgttatgggaaggacccagtgggaggtaattgaatcatgggggtgggtatttcctgtgctgctgtttttgtagtgaataagtctcacgagatctgacggttttaaaaaagggagttcccctgctcattctctctcttgcctgcctccacataagaaatgcctttcggccgagcgtggtggctcacgcctataatcccagcactttgggaggctgaggcgggtggatcactaagtcaggaaatcgagaccatcctggctaacatggtgaaaccccgtctctactaaaaaatataaaaaatcagccaggtgtggtggcgggcgcctgtagtcccagctgctcaggaggctgaggcaggagaatggcgtgaacccgggaggcggagcttgcagtgagccgagatcgcggcactgcactccagcctgggcgacagagcgagactccgtctcaaaaaaaaaagaaaaaaaaaaaaaaaagaaatgcctttcatcttccaccatgattgtgaggccaccccagccacatgaaactgtgagtccattaaacttcttttcctttataaattacccagtctttggtatatctctatcagcaggattaaagcagactaatagatctttgtattagttctgatagtgcttttatgggttccttgggatcttctgcacacaggagcttgtcatctacagtagacagtattacttttcctttcccagtgtggatgcctttgttccccaccttgtacttgcctgattgcacagcccccttttctctcaaggctgatgctgctgaagctggaacccccaagagagattgactccccgtggccatagacctatgctgtgacctttggtggcccaggaggatagcagcaatgagccacagctgccttccaactttgtgggggtgggaaggcaaagcctgtgctcactgtcagatgtccatcacaggcccatgtggccatggggcatggccccaggtctctggaccctctaatttgggatccctagttctgagagccccactgaagattttgcatctgattcctaccttattcctccaaacacactgtgtagcaagagatgactgtctgggcgccacatggtgaccccaaattgttttaataaagttagtcttacattattccttatcagtgagtgaagcagtgggaatcttaggaatatagcacagagggtttgggaagctgagtatgccagactgtagggcctgtggtgtttagatatatgctccccaaactgaggcaaggcctcatgtctaatattgattttttaacacaggaagagatttagagagggaggttgagggggaatcacttctcatggaaccaaggagcttcagggaaggttaagctgccttcagagggttatttagaatatctgagggggtggagtttaaagaaagaatattcaatactataattttaattttgttttccaaatctgagtttcttttgctgtaatataaacttgaaaattaaattcaacaaaatcatttttgttcttggaaacagaaaatacagcgagtttcaaaggaaacaacagggagtttgggggtttctatggtcctgcaggtggagactgcgctggagaaaacccagcgttattacacccacgtgggtgtggaatgcagaagcctggtcgcataataatacatgatgtttattgagtgttctctgacactcaacaataatagttaatgtttgttgagtgctttataaatgcaaccattataaatgaaggaccactcttgtttagtgttgacggagggtgcagtggaaaaactaaaacacagtccgggagccaaaagttcacaatagtgtcaactctttacttgctttgtcaaaaatggtgacgggatccaaatacactgcacaatgacattcgtaaagagatttgttcacctctccagcccacttcccacaagccttccccacagcacaagctgctcccagacatctttcttcccagtgcacctaccacatccctccctccccatccagtttctgaccccaaagagcagcagggccagaagtcagttctcccaccttggcacaaagaagagcccatgcggaggcctcatttccaacatctcgtagaccaacaggcacaagagtgtcacactggggtctagaagcatgactccatgtgctgtgctgggtgctttatgtgttgatgatgataatgatggtagcttctaacccttgatgttctgtgtggccaggcattgttctaagcgctttatatcctgccctcaaattcttgcaacattcctaagaagcaggcactagcctcactattttacagaggagaaactaaggcttgaagttagataccttgcctgcacttacagctattaaatggcgaaatagaatttgaaaccaggtcatctgcatcagaatccatgcacttaatcacaaggctactactacatctccagctatatttcatctcagttcgttttcacaatagcatttcctttttcacatgataaaacagaggagaggctcagagtgttaaaagtcaatggcccaagtcatagagctattaaaggagtggaataggccggagcgatagtggggagggccggcgggaggctgaaggcggtagtctattgtacaatgctgccatctagtggtaaaatctgaaaccttccttatacgtaccccgcccatttctaaaaatgatttacagttgcttgaagtttcagaagatggaaaccctgtcaaatcctcaaagtattaaaataaaagtgaaaggaaaacaaccatatcataatggaggaatagctgaggcaatagtttttaactgagaacctacttggctctgagtttcctggcagccaaggctaagaaggaaatgtgtgttccattgcttattgcacaataaaaagtcgattaatccatcacaagaccagccttggacttcatttttaattcaacaacaatggcactaaagatgttgtaggtgccctcctgtggacattcatttacctggaaaagccaaccaagggtcccgatggaacaagtatgcttgtttatataggggccctggctcagcctttccccaagcagtcattcctgggatgagaatgacccatgaaggctttcagcaaatgctatccactaggtctttcgggcccaggcaccacccacatttgtggtagttttggttcagttatgtttcgaaggcagcgctgagggcctggccccttggtttggactttgggtggtggcagtgacagtgctctgttgttccatgagctccagagatgtactctagacctgcgctgtccaataaggcagtcacaggttacatgtggctcctgagcacttaaattgcagctggtctgaactgagatgccctggaaatataaaatccacagcagatttcatataaaaaaggaaaaatatctcattaataattgttatactcattacatcttgaaataaattatttcatgctggattaataaaaaataagttattaattttacttatttcttttcacattataaaatgggacttttaaaaaatttaaaattgagtatgtggctggcactgtatttctttcacgtctagagatagaagaaatactctagagagagtatttctctctcttcctggctccagagaggtggactaggcactctggtcaccacgggtaatgccccaaaaccctaagaaccttttgtgttattatgggagaacagttgtctttgtcttctagatgcaggctagcttagagttgaagaatttggctaaagtgttcagtggctccaaacaactttgctctgccagttgggacacgttctctgtgtcagcaggccagggattggggtgggggtgttgtcaacaatgggaaaggaggggcagggggaaggcaagtttgtttctcagaagtagaatgagccacccctgcacctgaagtgggtgtctcttttgaaaaggattctttggtctccaggtatacagtgctccttccatcactggggtccaggtctgggccccagcatttggacttcactcaccaaggccagctctgatttgctgatgtatcagttatagttttcagaagccaatttgcaaatttcctttcagatcttaaaaaggctggaaagcagagagatgagggcataaagctttgtaaattatcaaaatcccaagcacacacatcttcaagcgcacaggaaccacaagtccccaatcattattgtggttctgctttttcccctatattatgtgttacaatattacgagtcaatttcccagaagttttagctgcttttctctggctgcactaattatatcaataacaaactcacaatcacatcaaatgactgtcaacatatcccagtgcgccatgctccatgaaatgactaaataaagcaaaattcctttatggattccttggagtataactgatcacaagtttgagaatcttgggctaaatccaaaagatggcatcaagctcccaggcagctggccaaaatgtgaaggcaatctgcctggatgaacttcttcaaaatttccagtttactcttagcacatctaaggtcactgtatgagtccgttttcatgctgctgataaagagatacctgagactgggcaatttacaaaagaaagagatttaatggatttacagttccacatggctggggaggcctcacaatcatggcaggaggtgaaaggcaggtctcacatggtggcagacaagagaagagagcttgtgcagggagactctgtttttcaaaccatcagatctcacgagacttattcactatcacaagaacagcacgggaaagacctgcccccatgattcagttacctcccaccaggtctctcccacaataactgagaattcaggatgaaatttgggtggtgacatggccaaaccacatcagtcacactccaattcttgaatgaaactgggtaggaccagtgcccacccaaatgatcagaagggagtgtgtgcctcccacacagtaactccccattaaatgtgagttctcacgtcagaggtgcatagggctggggagccagaagtatgtgaggtctctttctgggcttaaagcagggaaggaacccagaagccccctgctgagcagaggactcactgtggggtttgccctttggtaagtctgaattttggtggtcgaattcaaaagcctcctgtagcgtgcaaaggacacagcttcagagccttccagggtggctagctcatggtggtcacgccccacctcctgtggaatgaatggattccacagggcttagttgtctgttactgtcttgtttcctgttaccctgggctatgtctcttaggctgcctccaaatcttcagggcagccttggaggagcctcacaccggactcaggctagagctcccaagggagagcaaagccgtggggtgactaggtgctcagtgagtccccaggggaaagggaaacttggggaacaggatgcagggctgtgctacctggcagccctcctttcaaaggggatgcatctctggccatcataaaagattcagttctgtcaagggccttccaacatgcagagcgtgaatgaggcctgtcaaggggctcccggggcctccctcccttcgcctccttcctccagatgatgtttctttccctggggtcttggcagctggtcctgagctcccggcggcccatttcccggacctgcgttcccaggcatggccacacgagtgcgcccggctcccgctccggatccgcctcaccggggctgagtcaggctagctaacgggccgcgggatcccagggccgggtcccccgaccctgcctgatcatctgaggggcaacttcgctgcgcttggaaatcctcttgacgactttgtctgccaggacgccccagcggggccagctgagcgtcctggcctgcggctacagcctatggtgaggggtggaaacggcgccctcctccagtgctgcagaagtgatgaagattcccgcgacctggaggcaccaagtccttctcaagcgcaggggagagggagggcgcggtgcgggggggtcctggggggctccctcggaatgagggatgggtctcccgacggcgcccccagccagggccagaagcgtgggcgcgccgcgttcccggtgcttccgtgcaacacgtttctgtctctcccgttttccagagggaaaatttgccgtgggaagcaaggattcccgagcctcggtcctgtccacgcggtgcagggcacctgtccaaggtgggcctggcctggccctgcccagattcagccaggtgaccggggctgcaggcagatccagatgacaacgaagtgctctcccctccattctccaggcctctcctgcggggacccagctggaaggcctatgggctcccacccctcagggcaaaggctggacttaagggccaggctttccaggtgtcatttcctctccgaacctctgggtgtcactcacctcgaatttcctgtctttagttgggcattggccgacagagcgcggaatctctgctgccctgctcaggcagaagggcttggcctccttcccacaggccatggtccccaaacaccactcagcacccccaggcaggctgcacatctggatgggcatagggggaataggatcccacactcaccctcaccatggcctcaggctgtgcagagcatgcttccaggtccttgactttgggtttgggcagatgactttggccaatggaatattagcagtcatagggttagcagaggctttcaatgtgcttgagagattggctttgcatccccgcacttcactgattgaacctaaatgagaagcgtttcctcctggtagctgctgccctttcatcctggatcccataataagcacacatagagcaggcctgagcccaacctgcagtgggaagccgagccctgcagtcccactgcccgaagcagagccgacctgctgagcccagccttgacaagcatccagttgtcttcagtgggccacacttacaagcatgggaattagtgcttattgtcatatgccactgagagcttgtggaggttgtccagcaaagctgactgaccaatgtccttttctcagtcaggcctgaatgactcatagcccaattccatgatacaaatgatatcattgagacaatgatattttgaaaattgtgcaagccacagagctgtcttcctaagagcttgtatggtgtgtatggtgtatatgcttgtgtgtgtgtgtgtgtgtgtgtgtgtgtgtgtgtgtggtgtatgtgtgtaggcaggggaggacactatcttcagtcagagttcaggcaaatgccctgcaccaccagtacaaggtgaggggccaggctgctacccagcatcaccccgggatggaattccgcaaagacttgatagaggggcccaacttgatacaacagtgttcttattaattgtctccaaatcttgtagcctccacttatggaacaattgacaccgcatagagagattgtgattttctttccttttctctgttgggtagggctagagcagctgtcttgtctcattcaaagccatggaagacgccaccgccagttacgctggtatttccaagcatcatagctttccttccctgtagctcaagtacaacagcatgttctaaggatcctgatttgcctcgagtttacacacctgataagtggtttcctttgcaagagccataaaacacagtggatggtgacctgcgggcccagcacaggtattctaaagcaattagccaccagccaggaaaagccattatacgaacagtgggctgagttgtgatggacaggtcgtattccatgaagattcccgattagaactctggaaaaggagcgaacagacagattggcaagcctccgcctctacttttacccattagtagccctccgcaggtcacggggtgttacagctgggctttggctactgcagccccctctgcctcccttgctgcaaagctgaacccagtggttgactgggggggatttctggccaggcctggacccctccccctctccactcctccccagcctttactgccctgtgtctttctggggcattgctttgtgcaaagacaagtaataccagggagttgtcaggaaatatgcccctcacagaccccctaggactcactgcagctgacatctgagctgcttctcttctaaaatgttgctcctaaagctcaaaaacaggagcagatttcagcagctgctccagtttctctcggcgtgatgaaataatgagggagaattgccccgtgacatctgatacagaacgttcctgtttccagtttacccacataacaagatagtttcattgataatgagataagcagagagcggtgctcgggaaggcctggtgtcattatggagctatttctatgttaatggcgatgagaggagaatgcagaaacggctgtcacagattgacaagggtgatgttaaatacgcctgctgcaatgcagccgccgtggaaggccccattcaatacgtgggctgaacaaacggtgggtgacttgtatgctttgtggagaagggggtgtttgtgcccctctctgaaccctccttgccctgctcccacaatctttgaagccgtctctctcaccttctcttgtcgggcatttgaccctctctgcctacgggccagcctcccagggttatccaagaagggtctttgagatagatacaaagctcaggtcatcagcctgggaggaggccgatcatactttaaggggcccaaagttgaagatagggaaactgactctaagctggacaagggataaagtcatgagattaactgaagtagatgatggagaaccagatccaaacttgcttaggtgggagcagttcaggtgtggctgatttgggtttgacagaagccgtacggatgctgtttctttccatccttctttacgctcctgtctcctccatgtcatgtctggtctcaggctcctacccctggcaggacagccacaatctgttaggctctagggggagagggagagtccctttctaggaaacccagtaaaggtgtcactccctacctgtgacttagattgggccatgtgttcatctctaaaactgcatcagttgagaagcaatactctgactggccaggcctgggccatggagtctacctgagtcacgtggtctgcaggcaatggtctttcgtaagccattgccagaagtccagtgaatcatactcatcttcttttgggctcacatttttttttttgtttgtttttccttcttgaatcattgttgtctgagaaacgagggacagagaaactgcgcatactgctcctctccctgtcccataggaagaggtctttagcgtggcccagagccttcctggttaggcctctaccctcccaccccagctgcctctccgacccatcccggtcccccaaacagcgtgcttttccatccttgtgcttttacatgagcatctgcccaaggggcccagactttccttctccaaccaaaagactcctatggatccctcaggacccaaattgtctcaccccttctgtgatgctttccccgagttcttccaggcatttgtctacggtctgactccctgtaaaactctttatcacattgttatctcatgaccctaggaggctaggagctcctggaagactgtattttaaagtattctttattttttttagagacaggatctcacctgtcatccaggcgggagtgcagtggcgcgatcatggcttactgcagccttgacctcttgggctcaagtgatcctcctgcctcagcctcttgagtagctaggactataggggtatgctaccacgcccagctacttttaaaaaaaatatttttggctgggcgtggtggctcatgtctgtaatctcagcactttgggaggccaaggcgagcggatcacctgaggtcaggagttcagcctggccaacatggtgaaaccctggctctactaaaaaatacaaaaaaattagccgggcatggtggcgggcacctgtagtcccagctactcaggagtctaaagcagataatcgcttgaacccaggaggcagaggtaatcgcttgaacccaggaggcagaggttacagtgaaccaagatcatgccactgcactgcagcctgggtgacagagcaagactctgtctcaaaaaaaaaggatttttgtagaggtggggtcttgctatgtttcccaggccggtctcaaactcctggactcaagcaatcctcccaccttggcctctcaaagtgttgggattacagggatgagccactgtgcccagccaaaatattcttttcagttttttttttattatgaaacattttcaaacattaaaaaaaacaaaacatttaaatatgtgttcaccacccaaatctaatagatgataacagcttgccacatttgttttacctttgtctctctctttgaagaaataaaatattaaaagaatacaactaaagccccaacactcccattcccttcccctctactcccaggcttctgaagttgagttaaatctctattcaatttcacactcttcagaattattcatgttaatttataaatatgttttgttcatttgtaccgcagtggagtgcttttgattgtaagaataaaccatggttacttatccttttccctcctggggagtacatttgtttctgacttttcaacattgtaaaccttctgcagtgaatgttgttgcctgtatctcctgttgccaaagcaagaatctatcagcaggtacactagtagtggaattgttggctttacatagggtgtgtgcatcctcagctttaaaaaacattgtcaaggccaggtgccttcccaagtgccttcccagctactcaagaattagagcagggaggatttctggagcccaggaggttgagactgcagtgagccatgactgcaccactgcatttcagcctgggcaacatagtgaaaccctgtctcaaaatcaacaacaaaacatgaataaactttacttgagttttctccaagttcagtctgactataagaaaatgaagtcatattttggttcatttttatttgccctatgactgatggggccaagccttttttcatatgctcgttggtcattcaagttttctcttccacaaattgcttgttttcctaattaacgggttgtcagtctctctgtgccctggagccaactcctttgtttgttatacacaaccttgtcttatccatcagtagtacatccctgcatctttctcagtgccagacaaggggccagccattgataaatttttactggaaaagggagaaatgaagaagacaagccctctggaacctgcaaagctgttctgactgtcccctgggggtgacctgcatgagcacaggcctgtttaggagatggatctgcctgggaactcggcactaggtctgagcagatagacagcagtgacagccagactgggcagggagatggccgatggggagggggctgctgagtccagtggaccctttctgggctccaccctccatgaagagtctctaagccttgctgactttgttgccaacaattcttcaagaggccaccctgagatatctggaaggcagtaagaaatctggtcacttctacaaaatgccgggatcccaatccctttcccaaggtgagcccattagccgcaatcctcaggactcagttagacatttaatttccagtttctccaaatcttgctcccgttctgagtcattaaacaggctcccaggctgtctccatttgaacatgcacttggccgaggcagccctgggtgctctgcagggaacatacgctaacagctccccttcgagcactgcctgggagaagtgtggagcccaatccagccctcatcacgtccttaatttccaagcaccacttgcagccatgctgtggcgagaattcaactcttacctgcctgtgaatgattctttaaataaatacagtttacacaaagctttgagaggacaggaatcatagctgacgttgcccagtgtcccagcacctaaaatgtacctggcacttaggaggcctcaatagtgatttatttatttattttggagacggagtcttgctctgttgcccaggctggagtgtaatggcatgctctcggctcactgcaccctccgcctcctgagttcaagcgattctcctgcctcagcctcccaagtagctgggactacaggtgcccgccaacctgcccagctaatttttgcatttttagtagagatgaggtttcaccatgttggccaggctggtcttgaactcctgacttcaggtgatccacctgccttggcctcccgaagtgctgggattacaggcgtgagccaccgtgcccggcctcagtagtgatttatctaagaaatggatgaagggaccagaacaattgacattatcaaggtggcaattctctttgagtttatatagaaataacatttattcgagtaaaatattatgagataaatatcatcttttttaaacatttaatctaatcatttaaaaaatttatctagaacatagaagaatagccactgaaatcttgatatgaaaaatttccagatattaaaccttgcttcagatattaaaacctattataaagggacaataattgaaagaatatggtactggtatagaagtggatatatcagtggacaatattaaattgctgaaatatacccaagtaatgcaataatttagttcatagtaaacatggtgtttcaaaagggtagaaaatgattatccagcctcaaagcggggagtctctgagctcggagctctgaagggccttagcagtttggcgccttataattgcaagaccctatcttatcaagaggtgacagctgttgggtgagatggggggagtttgcaaagctagcagtctctaaatggataaaaaaattgcttgtttgagctattttaaaaataattggatgtgtaaaaattttagctgggtgctggcaggcttttgagctaacagatctcagcctgcagtgcagaaataagcaatccatgggctaatgtacagaggccatctttggctcatttataaaacaagtccctgttggcaacttcagcagctacagctggtgggatcacctccccgctctccagaggagctgtgtataaagggactccatgatgcttcccagtgagagtccaaggtgagcaagcaacttccctttctgtgcgttttcctaccctcctttttcccatcagcctctcatgatggtcatgacaacaggcaacatctgagcattttttttttgccaggcactcggtcagatgctttcatggaaaccatcatcaaatacacaaagcaaatttatgaggtagcaaatttatgtatcatctccattctacaaatgaggaaagtgggcagagaggggctgaacaacttgccctaggtttcacagagagcacaaagcagagctgggttctgatcctgcaggctaactctcccccagtgcccaatgcaggtgggcttcctcacctgcacacctccgcttccctccatccctcacccctagtttgttctcctccttttggtacaagtgtgtttcctgtagccctctgcaaggcctccttctggttctagtccttccttccatatcagtcagggtccccctgggagacagaaccacagcacttatttgagcagagagtattttaatataaagaattgtttactaggcataaaattgtgaactccataactgaaaggacataaaaaagactctaaactatcacagacgtggtgactgcaggaagcagcactcacacctagggctggaggaataagggaagagaatggaattattaaaactcaaggcttgggcaaagcccctggaactggaactcagattgagtagggagtgatggctggtgcttgggtttctgcaatgggtgggagggtagatgggatgaaaaaaactgcagaatgaatccagctgctgctacaggaaggaactgcctttgctggggcgaagaggcattgctagggtgatgctcataagagcagaagccaatgggaaggagcaagttctgctccatcctccagctccccagtctccctgaagtgccccctactggtaaagtccaacagggagcagccggcaaagcagaaacgtggtttgcagcatcctagcctcagcgtcactgagctgagatagaagggtgggtttggagctgagagacaataagtagtacacctttctgtggccaaggttgaagccttatcacttagacttcaggatatgcgcctcaaccatttcctctctgctaagcttttggggagctctgcttccaattcccacagagttattgttcctcttccatggggtacagatggcagagtgccagggtccctctccaaacggaactgagaaatgtacatacctattatgtcctctgcatgcagggcctgagactcggccatgtacacatacccaccctgggtaccttggagtccatattctgctaactgtaagtccccggcatttagcaagtcctttcccagagacactcgggctggcagagagggaggacagctgaggccacgcttctgtcccttccctccccagcctgtccagctcattcctgtcatacatgtttgcctgagcgtggcactgacacctcgtggagtttgacctttctagaaatgaataatttgatttctcaggaaagtagtgaacgtaaggtaagctttagcaatatcaaagcagcacatcgattaaatatctgcctgagaattctctctgggtttctgtattccaaaaggcttacaataaaattaactccaaagttactgaactgagaaatgtacaattactgtcttgttgatgcaataaaatagaaaggactgtttaggcatttaattggcacccaacaacatacgatggtatgttagttagacatcaattatgacagaatgctaattgacatttgataagcattctcactgataaccaatgtttgctctgccaaattaaatgcctcagtgggctgtgtctgacagctgggagggggtttactaaacggctgcaagtgcctggcatcctccagatggctggggctttctctagaacatcctgctactccttgggaaatacttccagggtcaagtgattgacttctcctcgttgcttctgggaaaagaagtcacccttctcagggagcctggcctcgcttaccttcaatgcccaataccttcatcttcccatcacctgtcttctcttctcagtctgtgcagccccacatttcagcccactttctgtagcctttacagtcaagcctatttgaatgctaaacctggctccaccattttctagctgtgggccctgactctgggcttcggtttcccctttctgcaacaggaatcttgcctaagtattaggactaatgggaagaaagtggtgacctcaatttttagcacagagctggagctcagtaactttgattttctgttctctcccctcgttttcccttctggcctcctattcctactcctgggctatggctttgtgccacactgttagactgtgaccctgatgccatggttctcagccctccatctgagctgagaccaagctttgactaccatcagagaacaaatgtgtcttgagcttcagatttaagtgctggtcccaccatgcattagctgtgtgacattgagtcagttgcttcacttctctgttctttggttttctcatctgtgttgtggggatgataataatagtacttaccttcaggtaaggtaagatgcaagcacttagggtggtgcttgtgcatggaaagtgctcagcatatatcagcttgcaaacatcgtaaacattagacccagccatctagggtgatgccactgaatttgattctcaatcaggttttttttttccccacagcaaccagctcttgagtggattcaggcttccacagtctcttgtttctaggtggcaatgcaacaagtggcctcattccctctcctttgcttcctggacttctggatcatttcagaaagactctggctgctgtaatgcggccactgcatgttttgttaaaagatcgcacacgtgtgtgtgtgtgtgtgtgtgcacacttgctggtacacacagtggttaggagttagtgagtcctaattcctttagagtacaagaaatatgtgactctttctttctttgctaccagttagtattctattcttttacctgggaacttagattgcctatggatctaggtcaagtcaatgaaaactaatttactgaatggcttatttgccaaaagccaactccccaagagttaatttgctgaaaatccatttgctgaatcatcaaattactgaatggccaattccctgaacactgtccaacccttaaccatatgtaggctgggtggccgcagacagtttgctgtcagagcaagaaatacatgtagaagtagactcagaaggtaagcaaagagtaaggcaaatgtctccaaaagtaaagaagataggaagctgaatctacgagaaagtctaactgttcacagttaaatgatgtccacttaagaagtgctctgcctttgaaccgtgaaatagacaaggatttcaagcctgggcaggctgctttgtggttaaatacctgtaagaaagtgacactgaaactaaaacaaaaatcaattttcaataatttggtagctcaatcatttacaaattggctgtagcaagcggattttcagtcaatcagtctatttccttccctaccatagcctagccctcaggtatgctaggtaacactaagaaaagcccttttagagagggcggccatctgtccatagagaacggggcagaaggtggcatctggtctgacatctacatctcagccagggctggggcagggaaacctgggagtgggaagtggggcccaatagcctgagctattggtggtggtcaggttaatgattgagccagtggtagctctctgttcctagaggcatgcttacctctaaggcagaccccaaacactgccaagaacaggacacgcagaagctcagaggaggtagccttggtccaagacaataggtagggctatggggcaggatccctcttcagccccagacctctttttaggagcaaaacaaaattatcagaggctggggacagactctggcgctcaacctgagctggggactccaggttccctgaatataggtaaacttattcattaaaaaataattactttgtgctcataatagtaaaaagaaacaatattaactgaatatattgaacattcactgtgtcccagacccagaaccatgctgaacacttgtgtgcattatctcacttaatcatgagagcaactctataaaggagatgccattttaattcctattttacaaagagccaaggctcagagacattaagaagtttggccaagatcacagagctcacaaagaatcagagattgtcttcatatctagatttgtacagctccagatctatgattttgacccaaacctcaccttgccttctaactatgagtcaagcattgctctgggttctgggaacaaatccggcagacccattttcttatctgtagagccatcacatgcagttgccagacctcatcctactctagggatccctccaggtatttgtaggaaagaaggggctgggctttgagaaggcctgagtatggataggacagttgtcagcagcaggtggcactggattcccacatcctacctgctcagcctcacactgcgggcttctttcccagcaagcattctctgacacttgctgattactgccggacagagttaagctggcctgggaaacatctaggaaaaaaaaaaccatggtcagctaaaggctggtgaagacaaaaagattatgggatgggtagtggaaaattttaatcactaaatatggcctcatgtctagttgaagaaatgaggattgtgatgtctatacatattcttcctcaccttgatatgcatatatttttatatattaattaatttcccctttcttctctctctactggttgatattatgtatgttagttggagttaaccttgtaacttttggctacccaggaaagcatactagaattgtaattaacatgaagaatgagtatcactcaaacatggatacaggaacttatgggctctgggccttccctttttggggagagggtttgtacacctttgtgttagttagtacacctttgtactagttgcattacattagatagaagcatgttattatttgcaagtttaaatataggcattttttccttggtgtgtcatacatatgataatatattttaattatattttttatccatcttctttttgatgttattttatgtggggcattgtgtacagaatatcaatatatagaactagaaaaggattgggcattacacagtgagcctagatatggagctgggtaaaatacccaataaggcattgctttagggaacatgagtacatatttctgggggtagttttattatttcagatgagaccattactgttgtgtgattgggaagattaagtatagaagaaggtcatgtgctgtgttggacagttaaaggagtgaactacagtagacatttctcattctctttggccatccagaagcattggatatatttcctgtgcttgaggaatttcccactttatgtatcatggtgagaggtaaagactatctcctccatggatatttcctagcctcccttgtagctgaaaattaggcatttgactctggctttgccacttagttatacttttccagactttgattcagaagctaataacatagaaagaaataccgaagcattctggtagggtttgtggcagatacgtgaagcctgcagaggcagattttctcattgtgacagacagtgctttacatccattgggtcaatgaggcaagctgcaatgtctgtgcccagggaggatggcaatggtgactccactgtttcagttctgtggagtaatttgggggcccttctctgatgaaataccaggtctgattttctggtccttccagagttttcctgtcttttaacacattttatttctgtttaaaatagcttgacttatttgtttacattaagaattctgggctgggcgtggtggctcacacctgtaatcccagcactttgggaggccaaggtgggcggatcccgaggtcaggagattgagaccatcctggctaacttggtgaaaccccgtctctactaaaaaaatacaaaaaaattagctgggcgcggtggcaggcgcctgtagtcccagctacttgggaggctgaggcaggagaatggtgtgaacccgggaggtagagcttgcagtgagccgagatcacgccactgcactccagcctgggcgacagagcaagactccgtctcggaaaaaaaaagaattctgactgctgcaggaaaaacaacaaccagcacaatgacaacaaactagtatagtgatctttgtataattgccttgtatccagtcaccaaatcacattcacttgaattcatcataacagtacttttaaaatgagtctcttcaaggaatactattgtgtcatatataaattaatgctaaacgacgagttaatgggtgcagcacaccaacatggcacatgtatacatatgtaacaaacctgcacgttgtgcacatgtaccctaaaacttaaagtataataataataataaaaaagataattctctttcttttttttcccaagtaatataatggatgaaagtatggttggtagaattaatcaatagtcactattccttgtgtctgttcaactggctgcaaatgctaggttcctgtattcctttactcagggctgtcctgtgagcagactagggattgctgtggtctaagataaagcaaattttggcctggatataattagtaccaaaactctcttgcctgtacagcttggcttggtgatggccaaatgtaaatactataaaatgtaaatggatcctaatgagtagagatggttacctacaaaatgcagctaaaagtagaatgaaccaaagtacttaaagaaggacaagctaaaaaacaagactttattaaagttgcaaaagtcaggagaaagcagagagaaagataagaaagtgaactcagaatcaggaaccaggaaagactgggatgaatcaggaaaaagactaaaagcaaaacgagagaagtactaggtggtgggcaatgatctgtagtctccggtttacctctattaattataagatgaatagtgtgtgaattgcttgaacaaaccatagatgcccagagtttataaactgaacccttattcccacagaactagactcctgctttgactctccactctgcagttagtttgatcacctgcttaaagcagggctaagctcccaaatgggaggaaatgtattattgctctgaattaagcctgtccttagaggtggattggactattatctaatcattgccagaagtaggacattagatcaatattccaaaacccaagtcattattttttataagtgtctgccaaaatttaaaaagtatatggaaacctttttacaaagtttagacattaaagcaagaaccgtctgcatgaatgtgtacatgtgtttttgtatatgtatattgtgtatatgagtgtgatttacatatataaatcactataaataaatacacacggtaaatttaacactacaaaaggtaaaagccttcttctattttcagtactatcccttaaaggtagccactactgacagtttctgtgtatatttcctaaaaggtttatataattatagtgtattaatatatgtaaatatttatacatttgtatcctttcctttttaatacatataagaaatatactatttatccttttactctattcatttaaaaacatgaattggaattttttctgtgcaagcacatataaatgcttcattctttttaaaaagtcgagtggtattccattgtgtgtgtgtcagtccattcttgcattgctataaagaaataacctgagactgggtaattaatgacgaaaataggcttaattgactcacatttccactggctgtataggaagcatgactgagaggccttaggaaacttacaatcatggaggaagtgaaaggaaagcaggcacctctacagggaaggagaagaaggaagagagagagtgaagggggaggtgctacacactttcaaacaaccagtgagaactcactcactatcataagaacagtaagggggaagtccgacccccatgattcaatcatctcccaccaggccctccttcaacactgaggattacaattcaacatgagatttaggtgaggacacagacccaaaccatatcagtatggatctgttgaaccatattttatttaacatatatgagagttccaattgctgtactaaacaatgcttagtattgccaacctttttaaatttagacattctcatgggtgtaaaatggtatttcatcgtggctttaatatataatttcttaatgactaataaaattgagcacattttaatatgtttattggccattttttctatactttttttgtgaagtacttgttcaagtttcccactttacgtatcatgtacataaagctattgcatttttctattgcattatctgcgttattcttattgacttgtagtagatctttatatattctggatttaagcccttttaaaattatacatatataatattatattgtaacttttgctacatacacatatgtgtgtgtgtgtgtgtgtgtgtgtgtatgtatacatatgtagcaaaagttctcttattctgtgacttgtttttgattctcttaacagtattttttggagtacagcagttcccagttttaatcaggtctaatttagcaattacttcctttattgctagtgcctttgggttcctgtttagttaatctctttttatcctaaaataataaaaaaaaatcttaacattatcttctaggatcttattgttttgtttcttttaatttttttattttttatttgtttatttttttttgagacagggtcttgctccgtcacccaagctggaatgcagtggcgtgatcacagtacactgcagcctctacttgccaaggtcaggtgatcttcctgcctcagtctcccaagtagctggaaatatagacatataccaccatgccctgctaattaaaaaatttttttttggctgggcacagtggctcatgcctgtaatccgagcactttgggaggccaaggcaggtggatcatgaggtcaggagtttgaggccagccgggccaacatggtgaaacctgtctatactaaaaatacaaaaattagctgggcatggtggtgtgtgcctgtaatcccagctacatgggaggctgaggcaggagaattgcctgaggaggtggaggttgcagtgagccgagatcatgccattgcactccagcctgagtgacagagcaagactccattttggaaaaaaaaaaaaatttgattttgtagagatggtgtctccttatgttgctgcagcttgtctcaaacttctgggctcaagtgattctcctgttttggcccaccaaagtgttgggattacagtcgtgagccaccgtgtccatcctgtttccttttaaatttacaatctgcatgtttgatttctttgtgaatggtataaagtagaagttaagatccaataatttttccaaatgtttatctagttgacccagcaccatgtttattaaaagaccatcatattctcctccgatatgcaacattacctttgttataaaccaagtagttgtattgtgtgggttttatttctggattccattttccatttcattgacttaattactgctttaattattttggcttttaagtcttgatattgaggagctcatattagccacatagtttttctttctaagatcttcctggttcttcttcctaagtctttccaagatttttataaaatctttaagagggttttcactttttttggccttttgcatttccatatacattttaaaatcagctcataaatttctaagccaaattggaaaaccctgctgatattctgataggaattgcattgaacctatagattaatttggggagaaattaacatctgtataatattctcttccacttcatgaatatggtatatctctccatttatttaggtcattttcaatttttcaaaatgttgtatagttttctgtgtagcattcttgtaccttctttgttagatttattctccagtttttaaatttacaatattataattggaatattaaaatttttttctctatttgtttgttagaatctaaagctaccactgctttttgtatactgaccttttatctagtgattctgctaagtttgcttattaattctaatagtttgtctacaagtttttgtgtattttctattgtgtactatgtagtctatatagtaatctgttatgattgttttatgtctttctttccaattcttaaatctttcatttattgttcttgcttaattgcactagttagaatctctagtataatgttgaatagaagtggtgatagcaagtgtttttgtcttatttcttttttttttttcttttttttgagatggattctcgctctgttacccaggctggagtgcagtggtgcaatcttggctcactgcaaactccacctcatgggttcaagcaattttcctgcctcagcttcccaagtagttgggattataggcatgcaccctcactcccagtcatttttgtcttattttttaatcttaggggaaaagcttttaggattttactgttaggtgtgatgttggttgtaggtttctggtatctataaattaatagatgaagaaggtccccttctaattctattttgctaaaagattttattgtgaatacatatacaatttatcaaatgatttatctttgtttattaaaatgatcatgtgatttttctcccttattctgtttatgtggtacattaaattaattgagttttaaatgttaagttccctttcttggaatatgcacatctagggttgtgatgtattgttatttttataaattgctagatttgtaatgctttcaattctgttttaagagagattggctcgtgattttcttttcttataataaccttgtcagagtttggaatctaaggttatacttctacatagaacaagtagggaagtgtttcccagttgctgttctctggaaaagtttgggtgtgactggcattatctttctttaaatgtttggaagaattcaccaatgcagttatctaagcctaaatcttttgataaaaggctttcagatatgtgtttaatttctttaaaatgtatagtacaattcaaatttctatttctttttttcttatgaattcattctttctatctaaatatgtaaatcagtaaatgtactgacaacagattacacattattttcacttaattttctttttaattcccctttccattcctgatagtggtttcttgtgccttcttttttttaatgattaattttttccagtgatttataaatttacaaatctcattcaagtgttcaaagggcaagccttgattttgaactctggctttcttgatttttctctgttctgcatttgttttccacttcattaatttctgttcttatctttattattttctttcactttgagtttaatttgcagttctttttctaacttcttgagatggatgtttagagccttgacttttggcatttcatcttttctcatatgttcacttaatggtaaacagtttcttctattcataactttaactgaatcccataaattatgatatgtcatattttcattgccattcagttccagatgttttctaatttcctttgtaactttttctttcacttatgtactatatagaagtatactgcttaacttctaaacatttggaaattttctagttacctttttttaagaagtgatttctagcttatttccattacagttaaggaatatactttggaagatattaatttcttaaaaattgttggtgcttgctttatgagttagtatatgactgattttggtaaattttcttttcttttttttttttgagacatagtttcactcttgttacccaggctggagtgcaatggcgtgatctcggctcactgcaacctccgcctcccaggttcaagcgattctcctgcctcagcctcccaagtagctggtattacaggcatgtgccaccacacctggctaatttttgtatttttagtacagacggggtttcaccatgttggtcaggctggtctcgaactcctgacctcaggtgatccacctgccttggcctcccaaagtgctgggattataggcatgagccactgtgcccggcctgattttggtaaattttctatgtgcatttgaaagtaatggtatgccttttggctctctgaccagcaccatggtggttgacaagaacaagcgccttacgaaaggtggcaaaaagggagccaagaagaaagtggttgatccattttctaagaaagattggtacgatgtgaacgcacctgctatgttcaatataagaaatattggaaagacgctcgtcaccaggacccaaggaaccaaaattgcatctgatggtcgtgtgtttgaagtgagtcttgctgatttgcagaatgatgaagttgcatttagaaaattcaagctgattactgaagatgttcagggtaaaaactgcctgactaacttccatggcgtggatcttaccagtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccagcaggtcctgagaaatccggaagacctcttatgctcagtaccagccaaatccggaagaagatgatggaaatcatgacccgagaggtgcagacaaatgacttgaaagaagtggtcaataaattgattccagacagcattggaaaagacgtagaaaaggcttgccaatctatttatcctctccatgatgtcttcgttagaaaagtaaaaatgctgaagaagcccaagtttgaattgggaaagctcatggagcttcatggtgaaggctgtagttctggaaaagccactggggacgagacaggtgttaaagttgaacgagctgatggatatgaactaccagtccaagaatctgtttaaaattcagacttcaaatagtgtcaaataaaaagtgctatttgtgggaaaaaaagagaaagtaatggtatgttttgcagtttaggttattgtattttatatatgtcaggcgatgtatactaaacatgttgtttaagtattctcatttttaaatttttgtttatttactctttcagttatggagagaagtatattaaaaatttcacactacagttatggactctttttttctcttaggtttgttaattactaaattatttattttaatgctataccattaggcacatacaaatttatattttttcaattgtactgattgttgactttttgataattatgaaataccccacattatcacttatagcatgttggtcctaaagttcattttttttttttttgagacagagtctggctctgtagcccaggctggagtgcagtggcgcaatctcggcgcactacaagctccacctcctggtttcacaccattctcctgcctcagcctccccagtagctgggactacaggcgcccgccaccacgcccggctaattttttgtattttttagtggagacggggtttcaccgtgttagccaggatggtctcgatctcctgacctcgtgatctgcctgcctcagcctcccaaagtgctgggattacaggcgtgactaaggttcattttgtctgattttttttttttttttgagacagagtctcgctctgtcgcccaggctggagtgcagcggcgccatctcggctcactggaagctccgcctcccgggttcacgccattctcctgccttagcctcccgggtagctgggagtacaggcgcccgccaccacgcccggctaatttttttgtatttttagtagagacggtgtttcactgtgttagccaagatgctcttaatctcctgacctcggcatccacccatcttggcctcccaaagtgctgggattacaggcgtgaattttgtctgatattaattactacagtcataccagctttctttaaatcagggtttgtatggtacttttttaaattttactttcatctttttaatatccatatattttgggtgtatctcttgtaaaaagtatataatagttgagttctaatccaaataataacctttacctcttaattggaatatttaatttgttttaaatataattactaatatatttgagtttaaatctatcatcttacttactttttttctattggccccacctgctctatatttctttctctttcctttcttgctttcttatagattcatcaaatagtttttatttattccattcttctctattagtttgataggtttatctttttttgcagttttaaaaaaatggttaccttagattccagtaggcattcttgacttattaaagcctagcaaaaatgatcttccacactctggtaattcaagggctttcaagtacttcgtgtatctcttgccttttgtactatttattctcatgtatcttaaaaattgcacgtctgtttttaaaccccgcatgacgtcataattattgctgtttcatacagtcagtgttcatttagatctctgtgtgtgtgtgtgtgtgtgtgtgtgtgcgcgtgtgtatttataatattctttctaatgcttttactttctttctggaaatctatgattccatctagaattgtttttcttctgcctgaaaattttcctttagtgtttagtgtttcaacatgggtctgttaggttttgattatctgaaaaaagtatctagtttgtctttattttgaaggacataaaagacttttatgatggctacaaaatttttagttggcaattattttatttatatgtgtgtatatataaatagtatattatatataaaaatatataaataaatatatattccattgtttcagacattctcccccttgtccctattgggtatcagcagccccatttctctttgataattaggagcagggaacccagcctgtatagtctcctttgttacttgctaattcagtggcatgtggagctcaaaattgccaagtggaagattcaacttccagtgtcctctggtagaaacatttcttccttagtaattatgggctttaaaccagcagagctccccatggtgagaactgagagcatatattttgtattcagtaactgggtaaatatctacagagtgggtttatggacactggccaactgtgaaaatggactaaggcagaagctctctgtatcacctgtcttccaaaacccccagttcgacagttgaactgcagtggtgttttgagtccttggggattactgtcaatttagagtcaatgtccggtaatctctgacaagcccgggcagtcccttctccatgcaccatcagccctgtgcctgaaggtcccatggtgggtatgaaggaagaattactgtgcacacttgtggcagtgtcctaggactcttccacacgggagctggattccctttcagtcaagcagctccacgttggtgaagtagcaaaacactgagaattggatgagaggccaggaatctttgtgctgtcaccagacctaatctttgtttttttgtttattgattaactgaacagaaaaaaattaggactttggtagtccccagtctattccagtcacaggaacagtaagatgatttgaccactgacggatatctccatgagttaaaacattttgaaatcatttaaatctgctgccagttattgtacccgcacctcccttatctctgtggttgagtgcctctacttcctctattcctttcaagtatgctctctggttcccaagttgtgggctctaagccaacaatatcagcatcagctggtaatttgttagaagtgcaaattctccgaccccacccagacctactgaatcagaaacttcgcaagtggggcccatcaatctgttttttacaagcctccaggtgattctgatgcatgctaatgtctcaggaacactgcaatataccaccacctctactgaaagaaaggatcccatttctgtggcagtatcaactaatgtcacccctggccagtggaggacagccactgctgagctttgataatgatgctggtgttcctaatcaatatacttcttttttttttttttttttggagacggcgtcttgctcttgttgcccaggctggagtgcagtggtgcgatcttagctcactgcagcctccgcctcccaggttctagcgattctcttgcctcagcctcccaagtagctgggactataggcacccgccaccacacctggctaatttttgtagtttttagtagagacggggtttcaccatgttggccaggctggtctcaaactcctgacctcaggttatccacccacctcggcctcccaaagtgctgggattacaggcatgagccacagtgcctggccatcaatatacttcttagtgcctcattaaataaagtttctctgtgtcttctgggagacgtatttaggttatgcatgagtagatcacacatgtaaatccactgcaacattgctatgtttctaatctttgagttattttctccaagaaaattatgccaaaatatcttagcacttccacttgatttaatacaggtcatcactgaatccacagtttaggttaccattcttgaagtctaacagagccactgctttatctaatattgcatcggaatgtctagttagagtatccatatggatatattaatttgggatcacaattatgtcctttcctccctggtctagttcccttagtatcccttccataaataatccctaagtatttgctgttataaattagcagaagattggaattcagggtgttagctcctttttaatgtcatatttatatccatacccctaggttaggctgggatctgatcctaattatgggttttctagcaagaaggagtggtgggggctggagaatgagactccttttgttaccagggggtccttgctcacagagctcccaagatggtggcaggccacttccaagattgtggcaagcctcgtgttctctgacctggggttcttggccttacggattccaaggaatggaatcttgggtcatgcagtgagtgttacagctctattagaagccgtgggtcatggaagagaaccgtggaacccaatgactagtgttcagttcgattaggatgaacccaggcacttagctgtgcaggaacaatggcaagcctttagcctcatcaggagtggcaatgggcgcctcactggatcggaagcacagcggacacccttccatatctggagggatggaagtcagcggcgggtctgcgacggcggcaaacagcagtggtggacggtgagcaaaagctcagctcgagctgtaataaacatggaccagaagagtgcagttgcaagatttaatagggtgaaaacagggctcccgtacaaaaggagggggaggggacccaaagggggttgctgttgccggctcaaatgcctgggtttaaatccagatccttgtctctcccgttgtgccctcagacaatagatgattggctatttctttacctcttgtttttgcctaattagcattttagtgagctctctgattggtcgggtgtgagctaagttgcaagccccgtgtttaaaggtggatgcggtcaccttccagctaggcttagggattcttagttggcctaggaaatccagctagtcctgtctctcactttcacaattacaatcctattgattacaggtaagataattgtcagaggcaatcaaatcagagcgactccatcttgaagaagggctggtcaaaatgaggatgaggtcttctgggctgcattcccaggaagttaagcatgataaactcctgaattaggttaggatgagataagaggtcggcacaagatacaggtcaaaaagacccctgctgataaaacaggatgcagtaaagaagccaaccaaaacccaccaaaaccaaggtggtgatgaaattgacctctgatcgtcctcactgcttattatatgctaattataatgctgatagcattataatttagcgtgtctttagcacactaaaagacactcccaccagcaccatgacagttcacaaatgccatggcaatgtctgggagttaccttgtatgatctgacaaggggaggacctcttagtcccaggaattgcctgcccctttcctggaaaactcgtgaataatctgtcccttgtttagcatgtaatcaagaagtaactataaaaatagctaaccagcagccctccatgctgctctgcctatgaagtagtcacccatttattcctttactttctcaataaacttgctttcacttcactgtatggacttgccctgaattttttcttgtgtgagatccaagaaccctcttttggggtctggattaagacccctttctggtaacacagaaagaccctgctttgcttagggtcttgaagcaaggcagagctatgcaggtcaaaactgaggggacatgggacacttctattggtaaaggatgactcaaaagaatttgagagtccaaggtattcaaattaatccaagtctacccaaatgaccccattgtcaggattaattccaactgttaccctaaattttctatcagacacctggtgagggtgtgaatatcactgacatcgtgattctggctcttcacgctacttatgctttaaattaggaaattcaggaaactattatttatctcagaagtactcagccacaagaaaggtaaaaagtaaagttatttgcaagtctgaagagagcagacattctaaaaagggtagagtcataaacaatatgaaagatccaataataggttaaagaatgtgtgcaacatttatgccaacgagattatattcttttaaaaaagtgcttccatacattgatcagtgtattagacagagtcacagcccccaagatgtccatgccctaatcccctggacctatgaataaggctttgcagatgtgattaatgggctctgagatgcagggtttatcctggattatcctggtgggctcaatctaatgtgaccttacatgcaaaagccttttctggctgcagagaacaaaagagacagtagtttgagaaggacttgccttgtcattgctgactttgaagatgatgagagggtccaagtcaaagaatgtgggtagctttgaaaagctgggcaaagcaaggaaacagatctcccctagaatgttcagaaagaaacacgatctggctgccaccttgattttagtccaattgagaccgattttagacttctgacctctagaacataagtttgtgttgtttaagctgctgagtttatggtaatgtattatggtagcaatagaaaactaatacaggaagaaaaagacaacttaacaggagaaaaaaatcccagcaaagattaggagagacaattcacagtgttagctaattaacatttgaagagatgcttaatctcactaatgaagcaggtaaatgcaaacgaaaagaatgagatttcattgttcactcattaaattggcaaatgttaaaacaattgataatgttgatgctcagaaaacaatacccaaaagtatggtgctttggcatgctgagcactttgaattaaaataaattgaaagatcttagaagctgcttccgaaccaaggattttctaatcttcttttgtttctcgcctgtccccaaagtgcagggagaggctctctctctggaatttccttatctgactgaggaaacttctctccaaaagaaatggaattatcttaatccctctccctaggaatctcattaaataaccaggaaagattaaccaccagagaagaggaaagactacacgtcatcaccatacccagacagacttttcatctatttttttttttttttttttttttttttgagacggagtcttgctttgctgcccaggctggagtgcagtggtgcgatctcggctcactacaagctccgcctcccgggttcacgccattctcctgcctcagcctcctgagtagctgggactacaggcacctgccaccacacccggctaattttttgtatttttcgttgagatggggtttcactgtgttagtcaggatggtcttgatctcctgacctcgtgatcagccggcctcagcctcccaaagtgctgggattacaggcattagccactgtgcctggcccatctatttttttgagggcatctccgagattgccttaaaagagtttatctgcataattagatgacctttgttcacagtgcagttctacccctcattttcccacaacttgccagtcccattcaatttcctaaaacaatcatttaaaaactactgtctgctctttggacccattcctttcccttgaaaatcatttactaccccctcaccattgcctacatcacccatcttcctctcccctaagaagaaggtatttaagcctcaaccatctggcccttctttgagtctcatatttcgtatggcttctgtgcttatgcatattaatacatttatatgccttttctcctgttgatctattttcagttcatttcagcagactcaaaccttcagagggagagcaaaattctcttcacccctatagtaacaacaccccatggtagtgagaaataagcactttgaaacattgctggtggaagtgtgaatttctataacctttgggaaactaatgtgtgatgtctagtgatataaatagcacacaaatcctttgatttagtaaaatcagtttgggccatcattctgacagaaataataggtcattattttttctgtaaatatatgaggcaatttatagtggtgtcaaaaaactagaactaatctgaaggttcatcttgaggaatggataaataaattatatgcatccataatgtgaaatattgtgcataaggtaaaattaattagatttctatacagaggtctaaaagtctgtccattatatgccattggctaaaaaagcaagataatgttcatagtatgaatccattgagattaaaaataacacaacaaagcacaaaatgtttgtgtacatatatttacatacatttatgtttgtatagagaaaagtgtggaaagaaacacaccaagcaacaaacattggttatctccatgtatggcattgggtatggaggggcatgggagagggctggagaattaacttgttcttcacacaactctgtttagctttttacaatgagtgcataaaacttttatgaaattaagcttatctaatacagtacataagatggggaagaaaccatgcattatcgaatgtacacatctgcttatcaactgatgaatgaccctttcaacaggtgtttctggcactactcactggccaacagtccagttttggccacagcataccttatttgtccagggcacctttatgcagttgcttaaacatttggtggcattttgtccctgtttcataaaaatgaaggaaagatggaaaaaaatgaaagtgcagatatgtagtgtaagttttgtaaatttaaagcaataaagatggaaattgttaggcgtactgaaattaataaatcttgttccagaatcagacaatcactgggcttgaaccagttgactgtctggttgtgaaggagaagaaaaaagttaaggaatagaggcaaagatactgtatcttttgagagaagtaactggggattacaaaatatatttattttttctttccgagatggaaccacctataaacacacttaaaacatgtaggtctgttgcaggttttcctcacattaaacacgttttcaggcacacgtttgacatgtccaattcaaaatattggtcttaatgcatcccctccccagttcctcatgcatgtccctgatttctacttgtagtcaatcaagacgttcacacaatcttcaggctaagtaagataagtaggaaggaaaatgacaagaaatagtcagatttcagttatttgattcctcaaacaggcttttaagattcaaaagggcagacctgagtaaggcaagatacagaatttatatcacattaagaccggaaagaaaatagaggaagtaggaggccatgcctcccgtgccacttggaagcagagggaaagggtccctgagactagagaggagggggctagtagggggtcttgcatgggagtctgcatgtgactcaggcagggaatggcagctgttggtctttgacttgaccattaatgggtatgtaccttacatttccttttgtttacaaaatggctttgcttacttgaggcaacactaagatgctcaatacaaacatcatttgtcctttaacattatttgtatttttttcccacatcttaccactatgaacattactgttctgatgacccatttgcctgccctattacccacctccttagactctgaagatggaaaggtacagactgtgtcacccacactctggctatcagtgattgaggtcagagctgggcacaagacccagctttgctcaacttggaatttacagtgggacttggagactctacttgctgactgccgaggctgggagcagatgtcatgtagagctggacagctatgtgcgtggagaaagagaaagctgtgtggccagaagactgaagcagggctgctgggagacaatgggctgggagagaagcgggatctgctcctgcagcctagagagacacagaggggagtctagttccagacttttccatctctggtcccttcttgaggctagcctccatctgacaactctttgccatgaaaagtgaagatactgagaggtgacagcatgctggcagccctcgcagcccttgctcgctcttggtgcctcctcagcctcagcgcccactctggccgtgcttgaggagcccttcagcccgccgctgcactgtgggagcccctttctgggctggccgaggccggagccagctccctcagcttgtggggaggtgtggagggagaggtgcgggcaggaaccaggactgtgcctgatgcttgtgggccagcgcaagttccaggtggatgtgggcttggcggaccgcactccaagcggctggctggcgctaccggcccgggcagtgaggggcttagcacccaggccgcagctgccggagggtgcgcggggtcccccagcagtgctggccaacaggggctgcactggatttctagccgggccttagctgcctccccgtggggcagagctagggacctgcagcctgccatgcctgagtctcccccactgccttgcgctcctgcacggcctgagcctccctgacgagcgccgccccctcctccagggcgcccggtcccatcaaccgcccaagggctgaggagtgcaggcgcatggggtgggactggcaggcagctccacctgctgcctggcgcgagatccactgggtgaagccagctgggctcctgagtctagtggggacttggagaacctttatgtctagctaagggattgtaaatacaccaatcagcactctgtgtctagctcaaggtttgtaaatgcaccaatcagcactctgtgtgtagctcagagtttgtgaatgcaccaattggcactctgtatctagctaatctggtggggacttggagaatctttatgtctagctaagagattgtgaatacagcaatcagcactctgtttctagctcaaggtttgtaaatgcaccaatcagcactctgtgtctagctcaggatttgtaaatacaccaatcagcactctgtatctagctaatctagtggggaggtggagaacttttgtgtctagctcagggattgtaaatgcaccaatcagcaccctgtcaaaatggaccaatcagctctctgtaaaacagaccaatcggctctctgtaaaatggaccaatcagcaggatgtgggtggggccagataagagaataaaagcaggctgccggagtcagcagtggcaagccgctggggtccttttccacactgggaaaagtttgttcttttgctcttggcaacaaattttgctgctgtacaatttttgggtccacattgcctttatgagctgtaacacttgccgcaaaggtctgcagtttcactcctgaagccagcgagacaacaaacccaccaggaggaacaaacaactccagatgcactgcgttaagagctgtaacactcaatgtgaaggtcggcagcttcacttctgagccagcgagaccgtgatcctaccagaaggaagaaactccgaacgcatctgaacatcagaaggaacaaactctggacacgctgccttaaagaactgtaacactcaccgcgagggtctgcggcttgattcttgaagtcagtgagaccaagaacccaccaattcctgacacaatactaggatacttatatttattctcacaccagctccactttataaaattagttcaattgttttgtttcattttgaactcattttagatttactgaagagttagaaggataacagtgttcttgtaaacattcatctggcttccccaaatgttgacgtcttacacaaccatggtatgttagtcaaagttaagaaacgaaccttggtacaattgtaatactgttattactagggtaaccaactcatgcaggttttcttgggccttcgttatttttagcactgaaaacttcgcatcctaggaaagccttcagttccagacaaactgggctgttttgattttaaaactgagggcaggtgtggtggtgcacacctgtggtcccaactactcaggaggctgaggcatgagagttgtttgaaccggggaggtgggggttgcagtgagctgagatcgtgctgctgcaattcagcccaggtgacagagcgagattctgtttcaagaaaaaagaaaaaacaaaggcccccaaactgaaagttccatgccccaggatcccctcagtcccagcaaaccaggacagttagtcacccattacagactttatttggatttctgcagtttatccactagtgttttttgtattttgtttttttcttgtttggttttctgtttcaggatccagtcaaagatactgctttgccttcagttgtcaagtctccttagtctcctccaacctatgactattttcagactttccttgagttgcatgatcttggcacttttaaacatttatttattcatttatttatttatttttgagacggagtttcactttgttgcccaggctggagtgcaatggcgtgatcttggctcactgcagcctctgcctcccggattcaagcgattgccctgcctcatcctcccgagtagccagtactacaggcacgtgcccccaagcccagctaatttttgtatttttagtagagacggggtttcaccatgttggccaggctggtctcgaactcttgacttcaggtgatctatccacctcggcctcccaaagtgctgggattacaggcgtgagctaccacacccgtctgatcttggcactttttagagtgtactggtctaatcaggtctccttaatctcctccaacctgtgactgttttcagactttccttgacttgcatgatcttgacactttttagagtgtactggtcaattagtttgtagaatggccttgaatttgaattc

SEQ ID NO: 51 - DNA, 514 bp, Homo sapiens
tccttctttcctttttgctggtagggccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaaaaaaaaaaaaaaaaaaaaa

SEQ ID NO: 52 - DNA, 1259 bp, Homo sapiens
gtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaaaaaaaaaaaaaaaaaaa

SEQ ID NO: 53 - DNA, 1627 bp, Homo sapiens
gggggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaaggtacctctaaagggggaaagggagggtcagataggatttgagataagtggacagagccacccactacactcccacccaggaataacttgtatgatctttcatttcagaataccaggagcgatatggttctcgccccgtctgggctgactaccgccgcaaccacaagggtggtgtacccccacagcggactcggaagacatgtattgtgagtttctgagagtgggatgtggagtgcggggaggccacaagtaacagtaacagcagcactttttctgacgtgtttgaacatccttaactgctgttttttttctctctacagcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacataccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatactcctaccaactcagcttttacacaataaagctctactgtctctggtaaaaaaaaaaaaaaaaaaa

SEQ ID NO: 54 - DNA, 3921 bp, Homo sapiens
gcgagagtgggtttgttcttgggctgcagccgctgccgccgcttctcgccagcgccgttgctgcgggggattgtgggagtctccgcgtcccgctcgctgggagagaggtacctctccttttccctctccctttccctaagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactgcacgccttgctagtttaatgaatcttggaatgagttcttcattgaatcaacaaggagctcatagtgcactgtcttctgctagtacttcttcccataatttgcagtctatatttaacattggaagtagaggtccactccctttatcttctcaacaccgtggagatgcagaccaggccagtaacattttggccagctttggtctgtctgctagagacttagatgaactgagtcgttatccagaggacaagattactcctgagaatttgccccaaatccttctacagcttaaaaggaggagaactgaagaaggccctaccttgagttatggtagagatggcagatctgctacacgggagccaccatacagagtacctagggatgattgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggagtggagtcaacatatcaatggagcaagtcacagtcgtcgatgccagcttcttcttgaaatctacccagaatggaatcctgacaatgatacaggacacacaatgggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtatttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagcaaagaaaaagcttaaaaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttctttgtttttaatgttaaccttttttaaatacaatactgatagttagaagaaaactattgtactcttttgttttagtggagaaataatagatgtctgttcatgtgttaagtgttatagcaaaaaaaatacacatatggttaagttaatgaatagtttttgttttatcagaatggcaacagacagaagtactttgtagagattgacttcctaagctacttaagacaacttgcaccactaagaaaaaaatgtagaaccatttggaaaaatgaaatttagtagttccaagtttcaaagaaatgtcaacattttattccattcaataaagaacaaaaccaatagtgtttttattactttcatctgaaacattccatgttttaatctgagccttgcagactttcatttggagtttgaacccgttttggttgcatttcatttttggagaacttaattaacgtgagattggcaattgaaatgcaggtgcagttttctgttaatgtcatgctgttgtttaggtaataagaaatattaagtaattggctttagattttgtaatttttttccctgagttcctgctagatttcgtattctagtagtcaatgtattttcagtgaaatgcaaaaatattcccgttatctttgaccagtattaatttttgagatcttactgcttgtcacttgaatcccgtgattgtcatacatctctggtataagcaacatttgatttttgaagtgtgtagaccatctcttcatattttcaagatgtaattttacatttctgcatttttaaaacagtttggccataatcctagatgcacgcttctaattcatgtacctgcacatgtgacctttgtgaacagaaatttgcatgtataatttgtgtttacttgtaactttctggttatatactgcttatatctgtggattcaagttactgaagtgaataccaataaaaagaaaaccctaggccatgttaattggttatacatgtttggaatgttaaccaaaaaaaaaaaaaaaa

SEQ ID NO: 55 - DNA, 806 bp, Homo sapiens
  misc_feature 525, 527, 672, 677, 678, 734, 771: n = A,T,C or G
ttttttttggttttggccaaactttttatttagtattctgtagttgtttaacacacacttaaatggtcttattgggggaagggaaaggggaggttcttgcagattcccaaggaaatgtcagaaaggcaaaatggccagcattatccatttgcttttttgggtttactgggtgaatagcactttccttacataggcatgtgatttcaggtttttcgtactgagaacattgagatttcagttggaagacaccctgaaatcttatgagtagcataccccaaccaccctctaatagctagcttgtttgtataggtagaatgattcatctctccattttagatggctagatgttttgtggaagatcttagaattgcctgcctcatttgctgggaaaaatcagataggaagtggcctttaggggatacttttacttggaaagttacaacactagtacaagtcttaacacatttaacatttgcttgttgaaaagcaatgcgaaagtcaaataaaattaaacatgttttactntnttcctcacaagaacataaaaattatggaggggaacttaacagggaatttaaaaaagtaacacaatttttccttttagtagtccttgggtagttatgatagaaatagttccactttttggttctttgaactggggatttggtccanaggtnntgttgttctagtatctgcttctgcctccccctctatcagatcggctttctccacgnccaccactcttgggtgctcgcggttgaaactgtgtangaataccgtgagaggtacccctttcataaaagggg

SEQ ID NO: 56 - DNA, 938 bp, Homo sapiens
tgtgcgctcggaggcgtcagctgcttcaaggatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgcagtatgttgtaagaaagcccttaaataaagaaggtagaaacctaggaccaaagcacccaagattcagcgtcttgttactccacgtgtcctgcagcacaaacggcgggtattgtctgaagaagcaggtaccaagaaaaataaggaagaggtgcagatatgttaaatttggcaggagatgaggaggttagagaggccggacaatgtgcagagagagaattctctctgggagtctaatctatctgatcagcagatagattctcggttaccataatagttccgcttctggaaaaaaaaaaaaactcgggcctttgcgggggggaagggttgacggctggccactgtccgcccttttgcaggggagcgcgggcctagggtgtgttcgaacgctagtgtcgctgcctcgcggaaaagggcccccccgacccccctctttccctgtggtgcc

SEQ ID NO: 57 - DNA, 505 bp, Homo sapiens
ttttttttttttgaaactttaaaatccctcaaaaactgtttattatacaagtgagttttgagtcacgatgggcttatcggtaggatttctggtagcgagcgcgggcaccagggcctccaaactttttggactcgcagcgacgaggatcagctaccagcagggtccggtcatactggatgaggatgtctttgatctccttcttggaagcctcatccacatatttctggtaataggccaccagggctttggagatggactgacggatagcataaatctgggccacgtgaccaccaccctttacacggacacggatgtctacaccagcaaatcgctccttgccgagaagcagaactggctccagcagcttgtactgtagcgtgcgcggctcaatcatctccaggggccgcccgttcaccttgatgagaccatttgcgcgttgcagtggccacagctgtcgctgtcttctgcgtccgaaaactgcaccgcttgacgggaccttggacgg

SEQ ID NO: 58 - DNA, 475 bp, Homo sapiens
cttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagactgcaaaaaaaaaaaaaaa

SEQ ID NO: 59 - DNA, 477 bp, Homo sapiens
ctgaccttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataagatttgcttgtttt

SEQ ID NO: 60 - DNA, 3522 bp, Homo sapiens
acgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgactgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcccttattgatcaaaaaaaaaaaaaaa

SEQ ID NO: 61 - DNA, 2179 bp, Homo sapiens
gcatgaggagagtgtgtaggggccgggttccgtggatgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgatcttctgaaggcagtttgccttgaattctcacccaaaaatactgtcctggcaacgtggcagccttacagtacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatgggtttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaaaaaaaaaaaaaaaaaa

SEQ ID NO: 62 - DNA, 608 bp, Homo sapiens
ggttttgttctttattgaatggaataaaatgttgacatttctttgaaacttggaactactaaatttcatttttccaaatggttctacatttttttcttagtggtgcaagttgtcttaagtagcttaggaagtcaatctctacaaagtacttctgtctgttgccattctgataaaacaaaaactattcattaacttaaccatatgtgtattttttttgctataacacttaacacatgaacagacatctattatttctccactaaaacaaaagagtacaatagttttcttctaactatcagtattgtatttaaaaaaggttaacattaaaaacaaagaaccattattttcgttgaaatcattaaatctccttgcacatcttaagtttccttcttctgtctgcgttcttctgccaatttattcagaaatttctttaatttctgataatgaggaaggctgctgcaatgagtattctttgcaacttcttcatttgtataaaagagtgaacacagcttacagtaaaaccctgttttaggtatcacatagtctataccaacaggaacattgggctgataatggtcaattctatactcatctgggattgtatagtc

SEQ ID NO: 63 - DNA, 649 bp, Homo sapiens
  misc_feature 385, 579: n = A,T,C or G
gtttcctggaagaagtcgggtcccaggctctagttgctggttcttacatgccaccatccacagtccttcagcagattgattcagtggctaatgctgatatcataaatgcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgttaaaaaaaaaaaanaaaaaaaaaaaaaaaaaaaaaaaaaaaaaaactcgagggggggcccggtacccaattcgccctatagtgaggcgtattacaattcactggccgtcgttttacaacgtcgtgacttggaaaacccttgcgttcccaacttaatcgccttgcagacatccccctttcgcagctggcgtaatagcgaaaaagcccgncccgatggcccttcccacaagtgcgcacccctgatggccaatgggcaattggtagcggtaatattttgta

SEQ ID NO: 64 - DNA, 934 bp, Homo sapiens
gaagaagaaggaggttcctgctgtgccagaaacccttaaggaaaaagcgaaggaatttcgcagagctgaagatcaagcgcctgagaaagaagttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggatgaagaaaaagaccacccatttgtagaagtggagatgctggcacggggaggaccagatcaacaggttattagaagaatgactaaggtgtctaccatgatcattttcttagctggtggttaataaacagtactgctctcaaattgaatatatgtggcttgcgattgcgctggtggtagtaggcggcctgtgttcccttaatatatggggcggggggggtgtaaaatagcaaaaagcccttcgggaaagggggcctgtgaaaacacctggctaaaggtttaaaaaagatgggcaagg

SEQ ID NO: 65 - DNA, 1588 bp, Homo sapiens
gggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaat

SEQ ID NO: 66 - DNA, 1614 bp, Homo sapiens
atgtagcccggtccgtgccgcaaagcgaacggcggccgcggcgcgggccccgcgggggttagagtcaccacgcccagcccacagatgtcacttctgcctttccattattactcagttttctgaatgccagttgcttctagcatagtgcctgctctagagaggcactcaggaaccaaggcctatctttctgtgttgttccactctacacctaagttgctgtgatggagccatgtggtcggggtcagggttcccactgcactttctgcagtgctcccagaactcagtatgtactgggaagggcctgctgtcgtgacagcctctctttggggccagcttctgcttttgcccccatctttgcagtacagggggtaaattaaacaagaggatgcctgaatgaacgatatcctgggttcttgagagacaagtgggagctgataattctgaaaattcattagtcaaagcatggagataaaggtggcagcaggaaggggagaggcaaggagtagacccgtgacagttttagaatcttatttgtgccaaaatactttactgcattggcttggacctctaatacaatgttgaattgttaaccatgatagcactgtatcctggtctaattcctgaattgaatggctagtcttaccattaagaatgctatttgcggccaggcacggtggctcacacctgtaaccccaccactttgggaggccaaggcaggtggatcacttgaggtcaggagtttgagaccagcctggccaacatggtgaaaccccgtctctactaaaaatagaaaaattagccgtgtgtggtggcgggcgcctgtaatcccagctgctctggagtctgaggcaagagaatcacctgaacctgggaggcagaggctgcggtgagccgagatcgcaccactgcactccagcctgggcaacagagcgagactccgtctcaaaaaaaagaatgctatttgctatgatttttggatgatatctttataatattaagggatgtcccttccttggattttgctttttaagggaaggtaatgtctaagataagcctttgaaatcttgaaattcagagtgatttgggatttatagagagctgtacagagcattggtgattgttattccttgagttcttaaaacgtaaaccaggcctgggcccttccttcctctgtgcccaactctcatcctctgtggtttgtggtttcagttattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatt

SEQ ID NO: 67 - DNA, 2174 bp, Homo sapiens
cttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatc

SEQ ID NO: 68 - DNA, 1089 bp, Homo sapiens
ggcacagtaagtactttctgtgccgctactgtctatccgcagccatccgcctttctttcgggctaggccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacatagaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggaaaaaaaaaaaaaaaaaaaaaaaaaaaaaa

SEQ ID NO: 69 - DNA, 1416 bp, Homo sapiens
aagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgaaaaatctcctcccctacaggctccaaagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggcccaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctgggaaattactttcctcctccctgtgttaactggggctgttggggacagtgcgtgatttctcagtgatttcctacagtgttgttccctccctcaaggctgggaggagataaacaccaacccaggaattctcaataaatttttattacttaacctg

SEQ ID NO: 70 - DNA, 1693 bp, Homo sapiens
gaattcggggggcgccggagtggagaaaggagccagcggtgggcagcgctgctgggatggcgcgggccgggccggcgtggctgctgctggcaatctgggtggtcctgccatcatggctgtcctctgcaaaggtctcctcgctcattgagagaatctctgaccccaaggacttgaaaaaactgctcagaacccggaataatgtactggtgctttactccaaatctgaggtggcagctgaaaatcatctcaggttactgtccacagtggcccaggcggtgaaaggacaagggaccatctgctgggtggactgtggtgatgcagagagtagaaaattgtgcaagaagatgaaagttgacctgagcccgaaggacaaaaaggttgaattattccattaccaggatggtgcatttcatactgaatataaccgagctgtgacatttaagtccatagtggcctttttgaaggatccaaaagggcccccactgtgggaggaagatcctggagccaaagatgttgtccaccttgacagtgaaaaggacttcagacggctcctgaagaaggaagagaagccgctcctgatcatgttttatgccccctggtgcagcatgtgcaagaggatgatgccgcatttccagaaggctgcgactcagctgcgaggccacgccgtgctggccgggatgaatgtctactcctctgaatttgaaaacatcaaggaggagtacagcgtgcgcggcttccccaccatctgctattttgagaaaggacggttcttgttccagtatgacaactatgggtccacagctgaggacattgtggagtggctgaagaatccgcagccgccacagccccaggtccctgagactccctgggcagatgagggcggctccgtttatcacctgaccgatgaagactttgaccagtttgtgaaggaacactcctctgtcctcgtcatgttccacgccccatggtgtggccactgtaagaaaatgaagccggagtttgagaaggcagcagaagccctccatggagaagcggatagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaaccctgaggcccccccgcccccagagcccacgtgggaagagcagcagacaagcgtgttgcacctggtgggggacaacttccgggagaccctgaagaagaagaaacacaccttggtcatgttctacgccccttggtgcccacactgtaagaaggtcattccgcactttactgctactgctgatgccttcaaagatgaccgaaagattgcctgtgccgctgttgactgtgtcaaagacaagaaccaagacctgtgccagcaggaggcggtcaagggctaccccactttccactactaccactatgggaagttcgcagaaaagtatgacagcgaccgcacagaattgggatttaccaattatattcgagccctccgggagggagaccatgaaagactagggaaaaagaaggaagagttataattcctgcctcagaaaaagcttttccattacactgtgaatgatacctgttttgttgtttctgaatttcccccgaattc

SEQ ID NO: 71 - DNA, 642 bp, Homo sapiens
  misc_feature 587, 623: n = A,T,C or G
tggccaggcaggaggacctctgcgtcctctgtttattgttttgcagcaggaggcccaacatagaacatactcgccagtactcggctgtgcaaaacaggggctagcgctgaagtacaaatgggaaaacgtgattcttttgttttaaataaatacttagaacacgacttggctcctacaagcatctggactctaggtctcagtactggagtgtctcacccatgggccccacgcagggacgccacggttccctcccaccccgtgatcaagacacggaatcggctgccgatggttggatcgcaatgcgccccttttctagagccttccccggccatctacaggcaggatgcggctgggaaaaagacaactggaatttctcgaaggttgatggtccgcacggttgaggattctacgtggttctcttggttcccctggtgtgtgtgtgtgtgtggaggaggccgcggcccttagatcaccttcttgagctcgtcgtacaggaccagcacgaaggcgccccccatgccccgcaagacgttggaccacgcacccttgaagaggccttgcccccctcatctcttgagatcttcctncacagtcgacggttgccgtgtacatgatgtcagctnctttgcgcccggactgcat

SEQ ID NO: 72 - DNA, 1088 bp, Homo sapiens
ctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttaaaaaaaaaaaaaaaaaaaaaaaaaaaaaa

SEQ ID NO: 73 - DNA, 442 bp, Homo sapiens
cttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 74 - DNA, 511 bp, Homo sapiens
ggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaaaaaaaaa

SEQ ID NO: 75 - DNA, 1105 bp, Homo sapiens
gcggccaccgttttaaccacgattggcgaagcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaaaaaaagtgagttggaaaaaaaagtcgaaa

SEQ ID NO: 76 - DNA, 903 bp, Homo sapiens
agataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccaaaaaaaaaaaaaaaaaaaaaaaaaaaaa

SEQ ID NO: 77 - DNA, 347 bp, Homo sapiens
  misc_feature 1, 7, 26, 31, 124: n = A,T,C or G
ntgaggntgagaactttataccaccnttgtnacactacaccgtgattttaaatctttaatcaaattccaaaggttatcagccatattacatgccatgattagctttctataagcaatttttttnactgtgtacagatcggtgtcaatgaaataaaaaaataaaactgtatactagggcaaagaactttattaatctttgtttcaaacttgattcccagggcttcttcgggcttaattaggctgcaaaggaatgaattgtgtataaggcaaaaactgaaaaggaggctggcagtgtccaagggggcttgggggcttaaaaatattaggaggatcccaggattttatcc

SEQ ID NO: 78 - DNA, 596 bp, Homo sapiens
agagtttaccatgtggccaggctggtctcaaactcctgacctcaggtgatccacctaacttggcctctcaaagagctgggattacaggcgtgagccactctgcccggcttatttttctttatgttttgcttcgtaagaggttctgtgagcagtgattgcaactcttgctgacgttgctggggaagctttaaaaaaaaaaaggatgccccacagagattctgattttaatggttctgatttaattgggctgggagtagaattcaggcatggatatctttaaaaactccccagtgttgagaaacaaatttagagagttgagaagtaggtatattaaattacagaatcttactgagtttggtagactgataatacaattggcttgcttttcttaaattgcatgagatgggattgaagcatatggtgctctgtgtgaatgttgaagttgcattgtagaagtttagaagctctggctatgggttgcctaaattgatgtttgaggaagcatattaatgttataaacttcgctgactttgaaggttgtgttgtagcatgaggaacacaaataaaacaattctacatcaaaaaaaaaaaaaaag

SEQ ID NO: 79 - DNA, 737 bp, Homo sapiens
ttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggaaaaaaaaaaaaaaaaaaaaaaaaaaaaaaaaaaaaaaaaaaa

SEQ ID NO: 80 - DNA, 947 bp, Homo sapiens
ctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacaatgatgactcgctcattggtggaaatgcctccgctgaaggccccgagggcgaaggtaccgaaagcacagtaatcactggtgtcgatattgtcatgaaccatcacctgcaggaaacaagtttcgcaaaagaagacgacagaagggcagcaaaatcaggaaaagggtgcatgaacaaaatgaaaatatcaacaaagagaaactgtaaaaacgtatcataatacaaattaaaaagctgaagaatacactgaaatgaaaattcactgtagagaatcaagagcagaccggatcaaaccgaaaaataagtccacaagtttgaggacaggtcatttgaaattatcaagccagaggagcaaaaagagaatgaaaaaaagctaagaaagtctaaaggacttttgggacaccaacaggcagaccaatatacacataagggaagtaaaggaagacagagagaaagataaataattgctgaaaatgtctgaaactggaagaagaaaatggagatgcaaattcaagaagctcaaagacctccaactattgttaacccaaaaacatctacactgagatacattataaccaagctgcctgaatcacagtaaataatcttgaaagcagtaagagaaaagcaactcataacaacacacaagggaactcccataagataacacgcaagatatctcagcagaaatcttgtaggccttgaaagagtgagataatatattatcaaa

SEQ ID NO: 81 - DNA, 3214 bp, Homo sapiens
gggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaaaaaaaaaaaaaaaaaaaa

SEQ ID NO: 82 - DNA, 1430 bp, Homo sapiens
gaggtcttgaggctatcagatcggtatggcattggcgtccgggcccgcaaggcgggcgctagctggctccgggcagctcggccttgggggcttcggggccccgagacgcggggcgtatgagtggggcgtgcgctccacgcggaagtcggagcctcctcccctggatagggtgtacgagatccctggactggagcccatcacctttgcggggaagatgcacttcgtgccctggctggcgcggccgatctttccgccctgggaccgcggctacaaggacccaaggttctaccgctcgccccctcttcacgagcatccgctgtacaaagaccaggcctgctatatctttcaccaccgttgccgccttctcgagggtgtaaagcaggccctctggctcaccaagaccaagttaatagaaggccttcccgagaaagtgcttagccttgttgatgatccaaggaaccacatagagaaccaagacgagtgcgttctgaatgtgatctctcacgcccgtctctggcagaccactgaggaaatccccaagagagagacctactgcccggtcatcgtggacaacctaatacagctgtgtaaatctcagattctcaagcatccttctctggccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccatttcctagtgtttcaactgaataccacagacctggactctaacgagggtgtcaagaatttggcctgggtggactcagaccagctcctctatcagcatttttggtgtctcccagtgatcaaaaagagagtggttgtggaacctgttggcccagttggtttcaagccagagacattcagaaagtttttagctctatatttgcatggtgctgcgtgagcggaggacccctctgaatcctgagacccctcttgcctctctaccacggaagagggcctgggccccgtggagcctcagtgcccgtttggcctgctgctctcgctgacaataaagagcccttcgttgaaaaaaa

SEQ ID NO: 83 - DNA, 1785 bp, Homo sapiens
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaaaaaaaaaaaaaaaaaa

SEQ ID NO: 84 - DNA, 546 bp, Homo sapiens
ctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaaaaaaaaaaaaaaaaaaaaa

SEQ ID NO: 85 - DNA, 676 bp, Homo sapiens
  misc_feature 520: n = A,T,C or G
gctcatttttaatttttattgattttttaatgctgcacaacacaatatttatttcattttgaatttcatttatttctttatttctgttgctgcttttattttatttactgaaagtgagagggaacttttgtggccttttttttctttttcttctgtaggccgccttaagcttactaaatttggaacatctaagcaagctgaagggaagaggggtttttcagaatcactgggggaaaaaggaaaggttgcggtgttgatcatgccctatggtgggtgaccaactgcttgtacaattacgtttcactcttaattaattgtgcttaaggctgaattaaatttgggtgttcccttcttagagcagctcgtattggcggagatgcatgcgctggatgatgtcacggcagtcgttgaagacacggcggatgttctcagtgtccacggcgcaggtaaagtgagggtagcagtagtggcgccatctccactagcagtgctgattctcagaaactcatcccgaatgaangtacttggccgggtcacgcgtgggtcctctcccggctcgggagtcgcatccctacagagtgtgtagcgagcgaactctggaaagtagtcctcaatctcgatttgccaccgggacttctcagcagcaggtcttgcttgtgtagaagagatcacaaga

SEQ ID NO: 86 - DNA, 669 bp, Homo sapiens
ggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccaaaaaaaaaaaaaaaaaaaaaaaaaaaaaaagaaaaaaaaaaaaaaaaaaaagggggggggggaaaaaaaacgg

SEQ ID NO: 87 - DNA, 730 bp, Homo sapiens
  misc_feature 474, 533: n = A,T,C or G
tttttctgagttttgcaatttatttattgaaaccttatacatacattgtttggctgtagaattctaaaatcatgttttccaaaatgtttttatcccaaatcacagaatgattatagcaaaggaatacataagtcattcaatttgcttctcaatgtgttaaccacagagaattatttgctcatttggtaaacattacctcatccgcttcttcaccttcttcatcataatcatcatcatcatcttcaatagcttctccagtaaaatataacactgatcttgggattatacgctcacgtaaaaagtgaccaatttcgaagtctgcagcaaggatagcttcagcatcatcatccagatctccactctcaggaacttcaggaggggcaaaaaagttaaagaaagagtcattggaaactgttttagtcacagtacgaactgtcccacgtcccttgtgtttctgcttcttcttaatagttntcaaagtgacattctttccttttttccaatctatctggcaccctgtacaacccataatntctggtccatcaaaagaaaaaggatcagaatcatctggttctgacctcatcctgtatgtctttgtcagcacttcatttgtaaaatattcattgggttcaaagtgaaattctaagacaaaactcatacgctggccagcatctgagaacttcactttaatatcttcagtgcttcagaataggtcatcgtgtccctgaac

SEQ ID NO: 88 - DNA, 418 bp, Homo sapiens
gcctgtcgacgtgttcttccggtggcggacggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatacaaaaaaaaa

SEQ ID NO: 89 - DNA, 486 bp, Homo sapiens
ttttcattttgaatgactttattgagaacattttgcaaattagattttacaatttaacattttacaattagaaattttatctgctattacataagctgcaaacttttcaaaaacactacagaaaatcttttatttctttggatttttctgttccatgttgagctcctgagatatattttttctttcagcttcattttcatcttccttggaagatgaagaatcacattcctgacatatccatccgtagcctgtctgtttaggagactttttcaaaggaggatccaaacagccaaaatggtagcagagtctgcattcatcacacctgacaagattttcattgtctccagttcccttgcaagttgcacattcagttcttaaatcttcagccttgggcttcttttgcaacacagactgtctttgtcttctctctctaggaactctttcctcatgtttttcttcctcaggaacgaagcttcgttttcgtcc

SEQ ID NO: 90 - DNA, 766 bp, Homo sapiens
  misc_feature 547, 567, 681, 716, 731: n = A,T,C or G
tttttctttgctcacatttaatttttattttgattttttttaatgctgcacaacacaatatttatttcatttgtttcttttatttcattttatttgtttgctgctgctgttttatttatttttactgaaagtgagagggaacttttgtggccttttttcctttttctgtaggccgccttaagctttctaaatttggaacatctaagcaagctgaagggaaaagggggtttcgcaaaatcactcgggggaagggaaaggttgctttgttaatcatgccctatggtgggtgattaactgcttgtacaattacgtttcacttttaattaattgtgcttaaggctttaattaaatttgggggttcccttcttagagcagctcgtactgacgaaggtgcatgcgctgaatgatgtcacggcagtcgttgaacacacggcggatgttctcagtgtccacagcgcaggtgaaatgagggtagcagtagtgacgcccatctccactggcagtgctgatcctcagaaactcatctcgaatgaagtacttggcccgngtcacgcgtgggtcctctcncggcttcggagtagcatcctcaggagtagtgtagcgagcaaatccctggaagtagtcctcaatcttcgatttcccagcaaggactttctcagcgagcagatcttgctttgtgangaaacagatcacagagatggtgcgcagccatctgntgtcccagatgctcntgagaggtcagagcctcctgccagccgttggtctg

SEQ ID NO: 91 - DNA, 762 bp, Homo sapiens
gttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggc

SEQ ID NO: 92 - DNA, 494 bp, Homo sapiens
tttgcaaatcttttatatttccagctgttgagacagtatttttgagggctgatgttacctctagcggcgaaaccagagccagctattaagcagccagaaagctacagtaattgaatacatgaccatttctcttttagcacgttctttgttctcctcttccagaagttgtagacgtctatttagtttgattatctgtcgtcttagtgaagctgcatctacaacagtcaggtcatctgacgttccttcaatggttgtatctatatttgaaatgccatacagagaatcatttctgaccagctgtccattttggcgaacagcattttcactcatagaccgctctctttttagtctgccaactgctcggatttcttcattttgaggggttgtaggaggtctttctaaatccagaaaatctagtggtctttcactcagtgtaagtacacgaggtggtgttttcagtgccaggggtttaaagggagttgactgaataaggt

SEQ ID NO: 93 - DNA, 2118 bp, Homo sapiens
gcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataaaaaaaaaaaaaaaaaaaaaaaa

SEQ ID NO: 94 - DNA, 1096 bp, Homo sapiens
ggagacgcgggggcgccggcggccgttgggccgcgcaagtactgtcaaggacagttttcgggacgggggacgcggctccaggcacccaacagcactgacggcgaacacttcacgggcgcgcgatgcctcgacaaggcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaagttctttgtctaaagggtcttctgt

SEQ ID NO: 95 - DNA, 1125 bp, Homo sapiens
ctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgctagaagtttatggcagagctttacaaataaaaaaaaaactggcttttctgacaaaaaaaaaaaaaaaa

SEQ ID NO: 96 - DNA, 2305 bp, Homo sapiens
gaatctacaataagacaaatttcaaatcaagttgctccactatactgcataagcagtttagaatcttaagcagatgcaaaaagaataaagcaaatgggaggaaaaaaaaggccgataaagtttctggctacaatacaagagacatatcattaccatatgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgaaaaaaaaaaaaaaaaaa

SEQ ID NO: 97 - DNA, 746 bp, Homo sapiens
ccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggatcttgtactaacttatgatagaatgtatcagaataaatgtttttaacagtgttatgcttgagtcttttttgaattgaacatgctaggattatcaggtaaaaattaagccttttggtactttctcaaaacagggaatttatgtgtatacctaggtgctatttaagcctgtaaatcccagcactttgggaggccagggcgggtggatcacgatataaaaaaatttttccaagttattcctgcccattgacctaacatatggattacagtttccctttgcagtgaattaataactccttctaggatattccgaggtagtaagaatacagatagttctgtttgtgacaaaccaagctgttacttcctcctctgcattaaagttctgactgcaagaaaaaaaaaaaaaaaaaaaa

SEQ ID NO: 98 - DNA, 1473 bp, Homo sapiens
ggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagtagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaaaaaaaaaaaaaaaaaaa

SEQ ID NO: 99 - DNA, 857 bp, Homo sapiens
agcgcacctttccgcgggccgcggggatggcggcgcaggcggtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgcctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccagggtcaaacaagacacaagacacacaaaccagcaccaacacagcgagcaaccaacaacgacacagacacacagcacaacacacgacgagggtgacaacacagaacagccgagcacagcaggacgagacaaaacaaaaagggggcgaccaaaaataaccacggggagagcgaaaagacacgacccagtgtgaaagaggcccacagaaacgggacaagacagagcggggcaaacaggggcggaaaagcgggggtgagaaac

SEQ ID NO: 100 - DNA, 994 bp, Homo sapiens
ccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggcaaaaaaaaaaa

SEQ ID NO: 101 - DNA, 803 bp, Homo sapiens
  misc_feature 612: n = A,T,C or G
aacgctacgtcttccctgttgatccaggcgctgtcgcataccgcttctgccgccgccgtgcatgctgcccgccgcgctgctccgccgcccgggacttggcccgcctcgtccgccacgcccgtgcctatgccgaggccgccgccgccccggctgcctgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagcttcggagccaccntctggatgaactgcccccagcccccgccccattaaagacccggaagcctgaatcatccctgtcgaaatctctcgggcttcctatgtcgggtgcggccacgaggtctcgcctcgccctggccttggcttccctgccccgttcttgtcccggctacttccggctcctatgcgctcgattcccgtgccggtacg

SEQ ID NO: 102 - DNA, 5787 bp, Homo sapiens
atgttacttcctgtatggaggcatggccagtttccagcgccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccggggccctggaaggagctgcctgcctgaagcccggagacgccgcgccgcgctcagccccgccgccgcccgccggctctcgggctgtgctgcgctgccgactcaagttggggatcctcggctgctcgccgccgccgcccgcggtccctgtctgccccaggcccggggcatcgccgccggccgccgactccgcgccctgcccgatcggctctctcctttttaaacggaaagcagcctttctccgccgagaggatcgtccccagcgtggctctgcgttcccggtcactttttgagattttccggggggcgctcggcggcttcccggattccaaggggactcgggccgccgagcgcggggggcccgtggagcgggcgagccggggaagcgccccggcttagcggaggctcgcacggaggcaagaacttattcaacaagtttacctccctgctttcctcttttcgatgtgcgttttcggacatgcggaggttactggaaccgtgttggtggattttgttcctgaaaatcaccagttccgtgctccattatgtcgtgtgcttccccgcgttgacagaaggctacgttggggccctgcacgagaatagacacggcagcgcagtgcagatccgcaggcgcaaggcttcaggcgacccgtactgggcctactctggtgcctatggtcctgagcactgggtcacgtctagtgtcagctgtgggagccgtcaccagtctcctattgacattttagaccagtatgcgcgtgttggggaagaataccaggaactgcaactcgatggcttcgacaatgagtcttctaacaaaacctggatgaaaaacacagggaaaacagtcgccatccttctgaaagacgactattttgtcagtggagctggtctacctggcagattcaaagctgagaaggtggaatttcactggggccacagcaatggctcagcgggctctgaacacagcatcaatggcaggaggtttcctgttgagatgcagattttcttttacaatccagatgactttgacagctttcaaaccgcaatttctgagaacagaataatcggagccatggccatattttttcaagtcagtccgagggacaattctgcactggatcctattatccacgggttgaagggtgtcgtacatcatgagaaggagacctttctggatcctttcgtcctccgggacctcctgcctgcatccctgggcagctattatcggtacacaggttccttgaccacaccaccgtgtagcgaaatagtggagtggatagtcttccggagacccgtccccatctcttaccatcagcttgaggctttttattccatcttcaccacggagcagcaagaccatgtcaagtcggtggagtatctgagaaataactttcgaccacagcagcgtctgcatgacagggtggtgtccaagtccgccgtccgtgactcctggaaccacgacatgacagacttcttagaaaacccactggggacagaagcctctaaagtttgcagctctccacccatccacatgaaggtgcagcctctgaaccagacggcactgcaggtgtcctggagccagccggagactatctaccacccacccatcatgaactacatgatctcctacagctggaccaagaatgaggacgagaaggagaagacgtttacaaaggacagcgacaaagacttgaaagccaccattagccatgtctcacccgatagcctttacctgttccgagtccaggccgtgtgtcggaacgacatgcgcagcgactttagccagacgatgctgtttcaagctaataccactcgaatattccaagggaccagaatagtgaaaacaggagtgcccacagcgtctcctgcctcttcagccgacatggcccccatcagctcggggtcttctacctggacgtcctctggcatcccattctcatttgtttccatggcaactgggatgggcccctcctccagtggcagccaggccacagtggcctcggtggtcaccagcacgctgctcgccggcctggggttcggcggtggtggcatctcctctttccccagcactgtgtggcccacgcgcctcccgacggccgcctcagccagcaagcaggcggctaggccagtcctagccaccacagaggccttggcttctccagggcccgatggtgattcgtcaccaaccaaggacggcgagggcaccgaggaaggagagaaggatgagaaaagcgagagtgaggatggggagcgggagcacgaggaggatggagagaaggactccgaaaagaaggagaagagtggggtgacccacgctgccgaggagcggaatcagacggagcccagccccacaccctcgtctcctaacaggactgccgagggagggcatcagactatacctgggcatgagcaggatcacactgccgtccccacagaccagacgggcggaaggagggatgccggcccaggcctggaccccgacatggtcacctccacccaagtgccccccaccgccacagaggagcagtatgcagggagtgatcccaagaggcccgaaatgccatctaaaaagcctatgtcccgcggggaccgattttctgaagacagcagatttatcactgttaatccagcggaaaaaaacacctctggaatgataagccgccctgctccagggaggatggagtggatcatccctctgattgtggtatcagccttgaccttcgtgtgcctcatccttctcattgctgtgctcgtttactggagagggtgtaacaaaataaagtccaagggctttcccagacgtttccgtgaagtgccttcttctggggagagaggagagaaggggagcagaaaatgttttcagactgctcatttctatgtggaagacagcagttcacctcgagtggtccctaatgaaagtattcctattattcctattccggatgacatggaagccattcctgtcaaacagtttgtcaaacacatcggtgagctctattctaataaccagcatgggttctctgaggattttgaggaagtccagcgctgtactgctgatatgaacatcactgcagagcattccaatcatccagaaaacaagcacaaaaacagatacatcaacattttagcatatgatcacagtagggtgaagttaagacctttaccaggaaaagactctaagcacagcgactacattaatgcaaactatgttgatggttacaacaaagcaaaagcctacattgccacccaaggacctttgaagtctacatttgaagatttctggaggatgatttgggaacaaaacactggaatcattgtgatgattacgaaccttgtggaaaaaggaagacgaaaatgtgatcagtattggccaacagagaacagtgaggaatatggaaacattattgtcacgctgaagagcacaaaaatacatgcctgctacactgttcgtcgtttttcaatcagaaatacaaaagtgaaaaagggtcagaagggaaatcccaagggtcgtcagaatgaaagggtagtgatccagtatcactatacacagtggcctgacatgggagttcccgagtatgcccttccagtactgactttcgtgaggagatcctcagcagctcggatgccagaaacgggccctgtgttggtgcactgcagtgctggtgtgggcagaacaggcacctatattgtaatagacagcatgctgcaacagataaaagacaaaagcacagttaacgtcctgggattcctgaagcatatcaggacacagcgtaactacctcgtccagactgaggagcagtacattttcatccatgatgccttgttggaagccattcttggaaaggagactgaagtatcttcaaatcagctgcacagctatgttaacagcatccttataccaggagtaggaggaaagacacgactggaaaagcaattcaagctggtcacacagtgtaatgcaaaatatgtggaatgtttcagtgctcagaaagagtgtaacaaagaaaagaacagaaactcttcagttgtgccatctgagcgtgctcgagtgggtcttgcaccattgcctggaatgaaaggaacagattacattaatgcttcttatatcatgggctattataggagcaatgaatttattataactcagcatcctctgccacatactacgaaagatttctggcgaatgatttgggatcataacgcacagatcattgtcatgctgccagacaaccagagcttggcagaagatgagtttgtgtactggccaagtcgagaagaatccatgaactgtgaggcctttaccgtcacccttatcagcaaagacagactgtgcctctctaatgaagaacaaattatcatccatgactttatccttgaagctacacaggatgactatgtcttagaagttcggcactttcagtgtcccaaatggcctaacccagatgcccccataagtagtacctttgaacttatcaacgtcatcaaggaagaggccttaacaagggatggtcccaccattgttcatgatgagtatggagcagtttcagcaggaatgttatgtgcccttaccaccctgtcccagcaactggagaatgaaaatgctgtggatgttttccaggttgcaaaaatgatcaatcttatgaggcctggagtattcacagacattgaacaataccagttcatctataaagcaaggcttagcttggtcagcactaaagaaaatggaaatggtcccatgacagtagacaaaaatggtgctgttcttattgcagatgaatcagaccctgctgagagcatggagtccctagtgtgactggaatcctgaaagggcacttaatttgtaaacttctgaagactgagaacttttttgaggccttttttgccagactctaggttatacaataacccagttacttttttacactgataaaagttttgatatttattttttgccattttatgtcttaatggtatcctactgagcatttgcacctctgttcatttcacacagtgaaacgcaattttacctagtttgcactatatgatcagtgttactgcctataatcttatacaacagcaaaccctgatgtgacattccatgacgacatacatgctacttttttttagttcaatacagtgaaggtctttgttatgacagtgaatattgcttttattattattattgctgaagtggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgtattacagctttcccagtaaaaaaaaaaaaaaaaa

SEQ ID NO: 103 - DNA, 79419 bp, Homo sapiens
cgcctcggcctcccaaagtgctgggattacaggcgtgagccactgcgcctggccttctttggcataaattctatgaagctaatctattcctatgttgatctgttactccattttcaattcttttccatttttataatactgaaattattttgattgcattcagttctttttcatgtaaatatttatccttcatcagttctttacccacatcacattcttgccaactatagcatctgccattataaatttaattgtggcttttatttttaccattttcaagtctgccagtcaaatttcttaaatttaagttttgtcaagatttgcttctcctcacagttggtgtctccctatgtgcagtttcagccattgtctgtcttgtttgttgttaatttcaactcataatattcattacctactggatgacagaatagtcatttttccctcttggctgatccattagaaaactgaaaacaattttcttcgagaggtctgaaactgctgtggcatcactggtgtccaggttttcttctctcagttattccatactggaatggcctctgccatagcccttctccccagatgtgtcacacatgccctgggttctccttggtctcttgatcagggtccagatctcctcatggtagaatggcaggatcagccaggcatggtggttcatacctgtaatcccagcactttgggaggccgaagcaggtggatcacttgaggtcagttcgagaccagcctagccaacatggtaaaactccatctctgctaaaaatacaaaaattagctgtgcatggttgtgcatgcctatagtcccagctactcgggaggctgaggcaggagaatcgcctgaacccaggaagcggaggctgtagtgagccaagattgtgccacttcattccagcctgggtgatagagcaagactccatctcaaaaaaaaaaaaatggcaagatcagagcatcttgccccaggatgaggcaggcagcatccctagccaagggaatagcattagcagagccttgcaggaacatatgggaaccagccgtgctgagccattgtcattcttctctcctctagaatgcttcagacatgcctgaaacaatcaccagccgggatgccgcccgcttccccatcatcgccagctgcacactcttggggctctacctctttttcaaagtaagtcttttgccacctgttgtgtcatttgatctaaatgactttatcttattttgttttatttttcccatcacaagaaccatgcatgttcatttatagaaaataaagaagaaagaaaaattaataattcacccatagacctacccaaagacaacaactgttagtgtttgggaccctttctcactagtccgtatttcttttctccatgtagctttttgttttgtttttgtgatatcagtttggtttcattgtactgtttatgttgggatggggtatagcttgtgctcagacatacctctaccatactaatggccttttttttttttttaatttatcgaggtttattttcccaataaaagttatgcaggctcagtgttgaaaacctggaaaacacagaaaagtaaaaagggaaaaacagcagtcatccaaaaccccactaccagagacagtcacagtttcccttcggaggtgtgtccttccactgtttctccctgtgcatggtttctccgtagctgtgaccacatggtgtattcagtttgtagctgcttttttcacttcacattaataacatcataaacattttctcatgttactgcaaaccttccttagttgtactattttctggattataaaaatatattcagaaaaactaaagaaagtatatcaatagagggaaaaataaataccacaacacagaagtagtcattaacattttggcatatctcatttcgggctttttatttatttattttaggacagagtctcactccgtcccccaggctggagtgcaatggcgccatcacagttcactgcagcctcaacctcttaggctcaagagatcctcctgcctcagcctcccaagtagctgggattataggcacgcaccaccacaccctgctaatgttttcttttttgagacggagtctcgctctgtcacccaggctggagtgcagtggcgcaatttcggctcactacaacatccacctcccaggttcaagtggttctcctgcctcagccagctgagtagctaggattacagacgcgcgccaccacgcccagctaatttttgtatttttagtagagacagggtttcactgtgttggtcaggctggtctcaaactcctgacctcatgatccacccgccttggcctcccaaagtgctgggattacaggcgttagccactgcacccggccaactttttcttttagtagaaacaagatttcgctttgttgcccagtctggtctcaaactcctgggctcaagtgatcctcccacctctccctcccaaagtgctgggattacaggcgtaagccactgcatccatccctttcagccttttaataagtgtatgtttagcattattataatcataactgtagtgttagatcttctttttgttgtttatgttaggtttttctttgtttattggtttgtttagagacagggtctcactcttgcccagcctggagtgcactggtgcaatcatggctcactgcaacctcaattcctggactcaagtggaaaaccgactgattttgttttattgtattttatttttagagacagggttttactatgttgcccaggctggtaacaaactccttggcctcctgaagcactaagattacagatgtaagccactatgccaggcccttgttttgtttgttttgttttgtttttgagacaaggtcttgctctgtcacctaggctggagtgccatagtgcaatcatggctcactacagcctcaacctcctgggctcaagcgatcctcccaccctgcctccagagtagctgggactacaaggcgtgcaccaccacacctagctaattttcatatttttagtggagatggggttttgcatgttgcccaggctggtctcgaactcctgggctcaagctgtccaccctccttggccttgtaaagtgctggtattacaagcatgagccaccacacctggcccctttttgttctttttaatagtacgtcagcttttttcctggtcattgaaaattcctcaaggatgtctttaatttacatcttaaaatgtaggctggacgcagtggcccacacctgtgatcccagcactttgggaagccgaggtgggtggatcatctgaggtcaggaattcaagaccaccctggccaacaatggtgaaaccctgtctctacaaaaactacaaaaatccatcctggccaacgtggtgaaacccggtctctactaaaaatacaaaaattaactgggcatggtggcatgtgcctgtagtcccagctactcgggagtctgaggcaggggaatcgcttgaacccgggaggcagaggttgcagtgagctgagatggtgccactgcacttcagcctggcgacacagcgagactctgtctcaattaaaaaaaaaaagtatcaattaaaaaaaatatgtacatgtaggcctggtgcagtggctcacctgttatcccagtactttgggaggctaaggtgggaggatcacttgagctcaggagttagaggccagtgtgggcaacatagtgagaccccatctcattcataggtaaataaataaaccgattcatcaataatgtacatcatttaaaaaaatttgttgccagcctaggcaacagagcaaaactccgtctcaaaaaaagaaatatttttttcaacctaaagtacaaatgaaccataatcctctccccaatacagtttcctgtgattctgtcatgcataaatctatacttatgttaaattatatatatttttatatgtatcaaatacatgattcttaccacggaggtatttttatatcaacacagtcaaattaccccattctttcattctttttttttttttgagacagagtctttctctgtcgccaggctggagtgcagtggcgtgcgatctcagctcaatgcaacctccgcctccctagttcaagcgattctcctgcctcagcctcccgagttgctgggactacaggtgcatgccaccacacccagctaatttttgtaattttagtagagatggggtttcaccatgttggccaggatggtcttgatctcttgaccttgtgatccgccttccttagcctcccaaagtgctgggattacaggcatgagccatcgtgcccagcctctttcattctttttaacagctgctcatggttctgttttacagtgtaccctgagggtatttaggtctgtccagtgttggggtatcatagcagtattgtcgtgaacacttcatacacataatttgtgcacttattttcttcaagtctatctgcagtaggtctaccaggtcaaatgcatctccatttgtaattagatagtgccaaatcaccctccaaaaagattgtgccattttacattcccactgacagttacaagtgtgctggcctacccaggcgctcacctgcattggataacaccaaaatttttagttttttccagtctgtgagtgaattaaaaagattttttttcttttttgagatggagtctcactctgttgcccaggctggagtgcagtggcacattctcggctcactgcaacctccacctcccaggttcaaacgattctcctgcctcagcctcccaagtagctaggattacaggtgtgtgccaccatgcccagctaatttttgtatttttagtagagacggggtttcaccttgttggtcaggctggactcctggccttaggtaatccacctgccttggcctcccaaagtgctgggattacaggtgtgagccactgcgcccagccaaaaacataattttttaacacctgtttcctatttcatagctccctcattttggatcggaatttttttttttttttagagatgaggtcttgctctgttgcccaggctggaatgcagtcacataatcgtagcttactgaagacttgttctcctgagctcagatgatcctcccgtctcagcctcctaagtatttgggactatagacgtatgtcattacatccagctataaatcctctttttttgttgttttttgttgttgttattgttttgttttgttttttgagacggagtctgtcacccaggctggagtgcagtggcatgatcttggctcactgcaatctctgcctcccaggttcaagcaattctcctgcctcagcctcctgagaaatgctctttttaatggttacagggtatccccacaagcaaccagcctgggcaacatagcaagaccccatctctagaaaacatttaaaaattagccagacatggtggtgcaggcttatattcccagctactcaggagattgaggctgaaggatgacttgagcacaggagttcaaggctatggtgagctatgatcacaccactgaactccagcctggacacgaatgttaccctgacaataaaagcagaaaaacatccctataagcagatacagcacagttgacttaaagcatccccctcactttaaacagaaaatgtcattctgatttttactctaagaaataagagtgcactaaataacattggctattcacagattttttttttttctttttttctggacctcaggtaaagagctgaatttaggccgggcgcggtggctcaagcctgtaatcccagcactttgggaggccaaggagggtgtatcacgaggtcaggagatcgagaccatcctggccaacatggtgaaaccccgtctctactgaaaatacaaaaactatcagggtgtggtggcacacgcctgtaatcccagctacttgggaggctgaggcaggagaatcgcttgaaccagggagtcggaggttgcagtgagccgagatcgtgcccctgcactccagcctggtgacagagagagactccatctcaaaacaaaacaaacaaacaaacagctgaatttatcaaatgccttggttcatagcataccatccttggtccatgccaggcccccctacttttttttttttcccacttcactccaatatccacctccatttcccaccttcatttctctctctgccagaggcagctgctttaatgcatttgacttctgtccttagatgtgtatgtttcttataaaatatgtagtgttggtatatctgtgtgtatgagtgggaattgcatttccataaatagaactgtgcattgatctccctctgtttccttttccgctctctgtaccttaagatctctccgtggctctgtgtacatccagccattgcttctgcctttgcttttggcagatatttctgaagtcttgagagaccttctaacatttttagtatttaggattctttccttagaccagatgctcccaaaaggaatttctggcagcaatgggtgtgagcatttttatttaaggcactggcttcctgttgctcagtctttcctcctctctgggcaggtaagcctcagtctgcctcgtgccagaagcacagagtataccccatgcctctagagtgtccccagtaagatttctgaaaggcagctgcctggacagcacagccactgggctcctcctggcctcccccctgacatctggctggttggtttgcttaacagaaaaacagcccaccacagcggctctccctcagcccttttcctcccctcctcctggttggggcactggagtttgtaactgcattgaacatttttaaaacttcagggctgagtgtagtggctcacgcctgtaatcccaacgctttgggaggccgaggcgggcagatcacctgaggtcaggagatcaagaccagcctagccaacatggtaaaaccccgtctctactaaaaatacaaaaaagttaaccgagcgtggtggcccatgcctgtagtcccagctacttgggaggctgaggcaggagaatcgcttgaacccaggaggcagaggttgtggtgagccgagaacatgccactgcactccagcctgggtgacagagtgagacttcgtctcaaaaaaaacaacaacaaaaaaacttcatattttcctgatgcctcaacatcccacaaataggccatgaacactttgcccaggtgaacaggtgccagtgtgataaggctggtccctgcgacaagttccctttcttgccctcctctactctgacctagtgacattcagacacatcagtgagatccccttttgcttgtgtctttcaccctgagccccaaagaaggcacttggccgtgggtctccttctgtaggacctgtgagtataataaatcctttcatttcatatgcctctctctcaaggactttcacactgagtttagaatgatcccatcctcatcaccaattgtgttgtaaaaaagatgttccccttgtgaggtttttttgtccttgtttttacaggcagggtcttactctttcacccaggctggagtgcagtggtgcgattgtagttcacaataactttaaactcccaggctcagttaatcttcccacctcagccccctgggtagctgggactacaggcatgcaccaccacgcccgcctaatttttttttattttgtagagatggggtcttgccatgttgcctatgcttcttgaactcctggcctcatgcaatcctcccgccttggcctcctaaagtgctgggattacaggcgcaagccactgcacccagcccactttatgaagtctttaaggatcactcgcacacagccacagaaactatgctcagagaggcttatgaaattacaggatttactatactcacatgttctagagaaggaggcatgcatgccacacagggggccatatgggaggagctccaaggaagccactcaaccaagcaggtagggagaagggggagaggacagaaggaaggaaggagaggggaggacccctgggcaagtgcctttgttagggctcagggtagtacaagcaaagggcatgaggggatttaccatgtgtttgaatggtattaggtcatagaagaagaagaccagaggctgggcaccgtggctcacgcctgtaatcccagcactttgggaggccaaggcagcagatcgtttgagcccaggagttaaagatcagcctggccaacatggtgaaaccctgtctctacaaaaaatacaaaaattagccaggcgtggtggcacacacctgtagtcccaactacttgggggctgaggcaggaggatcacttgaaccctggaggtcgaggctgcagtgagccaaaatcaggccactgcactccagcctaggcaacaaagtgagaccctgtttcgaaagaaaaaaaagaagaaatgggccgggtgcagtggctcacgcctgtaatcccagcactttgggaggccgaggcgggcagatcacgtggtcaggagatcgagaccatcctggtaacatggtgataccccgtctctactaaacaaaatacaaaaattagccgggcgtggtggcaggcgcctgtagtcccagctactcaggaggctgaggcaggagagtggcgtgaacccgggaggcacagttttcagtgagccaagatcgtgccactgcactccagccttggtgacagagcaagactccgtctcaaaaaaaaaaaaagaagaagaggagggccagaaggagaacctgggcagaatgttcatatcctatttgtggggatgttgaggcatctgtaaagtaagtttttaaaataagttttaaatttgcacaatatagtaatatttcacaaaatcatagtatttactttatcccaccttatttaaaattgattcctttgaggcaactcaaaaaattaaatccaacagcataagaaaaacagaagaaatagagttaaaggagaaaattaaaataagataaaacaaggcttgggtgaggaccacacccataccccatgctctaaagcctgtactcttgctagaaatgggcttagttgtggctctggctttttagcagccaaaacacaaaggaaagtgagacctggtgcccaatccacatgggtcacagtgaaaccaacaagaagctcagaggtgtggcctgagagtgatttgtcccaagggctcagactgaaagaatgcaatgtgagaggtatgccacatcttcataaataaagcacaatccatatgcctacaaagtctgctcataggtctttttcttgtagcactaacatggaccaccaatttgcccttccattcagtcattctgcatttattgagagcctgctacatcaggccctggctgggtactggggatactgaagtgagaaaaacagctgaccatccctgtcctcaagaagcatcttgttaagtggtagagacagacaccaatcacacagatagatgtgaagttacagctgtacaaagtgctgttaaggcgaggtccatagcaccaggaaagcatggaagaaccagctcagggtgaacctacacccaaggtgaactgcccaagccccttatccacaacagcacctgcattgacctagctcagccgaaactccaggagtcatccttctccctgtccccccaagcccttgtatccagccccttcacacgtcttgcagctccaattccagaacggatctggaggctgggtgcggtgggtcacgcctgtaatcccagcacttttgggaggccgaggcagttggatcacctgaggtcaggagttcaagaccagcctgaccaacatggtgaaaccccatctctactaaaaatacaaaattagccgggcatggtggtgcatgcttgtaatcccagccacttgggaggctgaggcaggaaaatcacttgaacccaggaggtggaggttgcagtgagccaagatcgcaccattgccctccagcctgggcaacaagagcgaaactccatctcggggagggtgggggtcaggggagcagaacagatctagaatccttccactgctcatcacttcccctccatccccccaagccagggcaccgtccccctctcctgctccctgcttccactctagccctgcagggtcttctacacagcagcagagaagtcctctcatgctgtctgatcatgtcaaaccctgccatcagcactccagtaccagcctgtctcatgcaggcaaatctaaagactttcccatggcactgcagggtctggctcccttttcccgcccagcctactttcctgacactgtccccatgctcccttagctctgggctcacaggccctctgtagtccctgcacacatgaacattcacccacctcaggacctttgcacctgctcccttcgtttatgacgctcctcctatgtcctctcctccagaaccttccctgaccacctgtctaaaatagcagctctgccctttcattctctatctccctgccctggtttgcttttcttagtgcccattaccacctaacaatacatgtaactgtttctttcgagattctttctccctcactggcccatgacctctaggagagcagcgactttgcctgattccttgctgaatcactggtgtctaggacaatgccttgcacgtagtaggcaatcaatcagtatgggctgaattactgaggggttattgtctcatagaaactatgtgagcaaagcttccctgatctgggagctaaagaaggttgagtaagggtggcctcagtgaagagagaagagaggagaacatctcaggcagcaggagagcttgtacacagctgcctgtgggtgggcatgtagcacacacatcatactgcaaaaaggccagtgtggctgcagtgtgtagagcaagagcatgtgtgagccaaggctcaggagacttgtggtggccaccacgagggcaagaggccaacaggtggatgtgagctttcggcttatgagagcagaggttagctgcggagaggcttccagtaagggagtgacatgatctgacagatgttcagcagattccaaaacagccctgcttgagagtggccaggttccctataccccacacaacagcacattattcccttattccctccaggttagagaccacgatagtaacaaattcatcagggatgcagcaaacatggtgtaccatggcatagcctttccaaagtctagaattaacatgtgaccattgactggagcattgtgacagaatatttctcaagtttcacctaacgacgaaaagaccaagaagcagctgtcagggatgctgtcatagcttcagccatcactgcaggaggagtcatcacaaagcagaatgtggagaatggagtgggacagatgtcttgtaactagcatgcttgcggcctgggtggccactctgtaggggatccctggatgattaaacagggagaaggaaatgtggaagagcgagttctgaggttccaacagctctcctggggctctatactgaagactcccttatcccttcagaacccctgtgcagcactttgagcacaaacataattgcctccctccagataatggagccactaaatgtaaacttacaaacccctttgcgaggtacagctgggggcttgaggtttctcacctttcccccacagctgcagaaactagaatgccactagtattgtctgagactcttcctgactgtcccccgactcaagaagggtgagaccaacctccagaagagacgcagggactctggtttcctcacagccactggcaaccctaacttcctgtttctctttgtatttctgcctcagatattctcccaggagtacatcaacctcctgctgtccatgtatttcttcgtgctgggaatcctggccctgtcccacaccatcaggtcagaaggcatctctctgcaacatttgaagcagctttctcgggaaccagtacagggtcttggatgagaacatgacttttggcatcattcagagccaggtttgaatcctggctataaaactcaagggactctttcccctgcacactgtagatgactaggacaagaacaatgacctctctgggccacagtttccttatagacatgatgaggatctggtgggtgtttccaccaccacagctgttgggaaagtgatttgtgagcagtaatgtcatgttagttgtgacagtactcaggtgagtaacaccagtaccacctgccgggtgttgtggcctagctgtgtgctaagtgccatgttgggctcctcacacatgatcgtgtttcgtaaggagccagaggcagcatagtgaaaagttaggagcgtgggctctggcatttgactaccttactttgagtccagactctgccacttaatagctctgtgatcttgggcaagttacttaatctctctggcctcaatttcctggtgaatgtggagaaaaataatagtgcccttcccatggggtcatgtggaaagcttttagcacagtatctggtgatttaaagtgttcagtaactattagctgttactgtcattatctgtgttaacctgccagacaaccttatatgggttgcttttgctttcacacctgtatgatagtcatggaaactgaagcccagagaggttaagaaatttgctaggatcacaccactaataagcaacagagccaggattcaaacccaggtgtggctccagagcccatcctcttcccactgctaccctaactcaaactgccacatgctcgtgtcctttcagtggggagagtggttcattagagggggttgctacttttattttggacaggccagttctccattctgcaggactatcccatgtattacaaacagttggcaaccttgccctgctcaccaaatgggagttgcataccagtattccccagcttgtgactacagagatgtcccagtatgtttctttctgccccgttgaagaggtgcagcctcaggctgagaaacactgatagaccaagaggtggccagggttcccagaaggaaggaactcaccttgaacttagctttctttgaagggtaggaaacctggaagacgtacaaaggagggagaggtcaggtgctagaaagtttgtgcacattgagggcatgggcagaatctgctcccaaaagcattgaaagccaatatgaggccaggtggtggctcatgcctgtaatcccagcactttgggaggccaaggcaggcggatcacaaggtcaggagattgagaccatcctggccaacatggtgaaaccccgtctctactaaaaatacaaaaaaattagctgggcatggtggtgcatgcctgtagtcccagctactcaggaggctgaggtaggagaatcattgaacctgggaggcggaggttgcagtgagccgagattgcaccactgcattccagcctggcgacagagtgagactccatctcaaaaaaaaaaaaaaagccaatatgaatgtggcttcattcttctaggcacactggcaggacagtgtggtagtcaggagcacagggtcaagaggcaggcagccttgggacaaacacctggtgctgccagctctaatatgtgtaaattactcaagctctgagcatagttcttctacctataaaatggagagactacaggtacctcctcagaggtgtggggagggtctagtgagccccaggctgtaacatccctagagcacagtgccaagcacacagtgagcctagtggctggcccagggttacacagctgagacttcacctctggtcttcccactgaggtcattgttgtcctcacctgcactgactcttcacccacaaaattctattctagctagcttgggagaattctagtccagccccgcatcctgaaaaatggaggcccagggaacctgagtgacttggacccaaccaagataatggcaggcccagtcgcccttgctcacaggacaaaccattcctttcgtggtggacctggggtggggtgggggcagtcacttgcagacattgggtgtcctcctttcccatgctgattaggatcctccccaactgtagcccatcctaccccagcatctgtgagacgcttgagacccccaagtctccccacagcccagcctccacctcagagagcccagtgggttttgaaagccactgttaggctgtgtgctgaggaactgattatttaatgttatagcaacaaccctacaatgaagatcttatctctacccagctgcctaggcagggtattttgaacctttatcatcttgacaccaaagactttttttcccttttagaataataactaagggacattgtcccaaatttctcatagatgagtaatctatgtcaagaaataattgagggtgggcacggtggctcacacctgtaatcgcagcactttgtgaggccaaggcaggtggatcacctgaggtcaggagttcaagaccagcctgggcaacatggtgaaaccttgtctactaaaaatacaaaaaagtagccgggtgtgatgacgcacccagctactcgggaggctgaggcaggagaatcacttgaacccaggaggtggaggtcgcaatgagtcaagatcgcaccactgcactccagcctgggtgacagagggagactccatctcaaaaaaaaaaaaaagaaataattgtctatctgtcttttagccacttcataatttttagagatagatattatcaacagaaaataaaaccaacagcagctaaaactgcacatggtaaaatgtatgagtgactagaaactaacagaagaataattttcttaatgaaatttagagcaacaaaatttgacctgggaaaaccataccttttaaaaataatggatcacctgggcatggtggttcacacctgtcatcccagcactttgggaaccctaggctgttggatcacctgagctcaggagttcaagaccagcctgggcaacatgttgagaccctgtctccacaaaaaatacaaaaattagccgggtatggtggtgcgtgcctgtggtcccaactgctcggtaggctgaggtgggatgatcgcgtgaacctgggaggcagagaggttgcagtgagctgtgatcatgccactgcactccagcctgggtaacagagtaagaccccatctgaaaaatataaaaaaaaaaaaaaaagaataatggatggccataggcagaaggtatgcttaccatatggggttaaagctggtccactaaaaaatttgatggggaccaaaaactgtcagatgaaggaaatcattattgtaaaattaacatgaaaaagaactgaatccagtgaaaataattttagtaagtaggggatgatttgatcatgctttttagaaagttggtctaccaattaaatggatgtttcaattaaatcgagttttcttaaatattttctcaaggaaagtctacagtgttgttagaattttgatcagctgcctgtatccacaaacttagaccttcctcaggatccaaacaacagatccaaaggtttaagacagggaaattgggctcagaggggttatgtaaccaccaggattcacagctggtaagggcaaagtgaggttttgagctcaggtctgtctgactccaaaacccctattctttacagttttggcaaaagtgaagtggggggagcttaaagagggtgggctggccacctcctgccattgagcctgtggtctcccaaggactggcagaggagaggcctgctgaaaggctgcagagagctgcacccgagctgtgacagcacaggctgaggttctcaggattccctccacctccaccaccacttcctagcccacattaagcctctttggaacaaaccccagcctgggggattggaggaaggcaggggccgcagcctgccttaccttgtgtagtcaccaagattcaaacccaagacatccttcctgcaaagggaacctcggcttacttcatcatctgtgtctgagctcgtgccccacccagctgaccttagagggaaaaaatgcccagaaggaccagatctgccaccccagaggaggaagccacatcaccagtttcactgaccctgccttccacccccaggggagaagggcaccaggatgtggcttgtcagtgggaagcaatgacctttacgtttgacatgagccatcaagggccaggaagaatctctgcctgctacaaaagtctgcattcagagtcattcagcaagcattttagcagatgtctagcaggcaccaggtatcttcaccccagggtagggtgaagatgatgagacggggcctctattctcaagtccacaggctcgcgctagccaggttgcttgactcctcccctgtgtagtgctaagcagcctctcttttcttggaataacaaagatatcaatctagagacttgctacttgaagttgaagctgcagttaagtttatagggtgccaagtgctcatttaatcctctcaatagccctacaagaaaggtgttgtagcattccagatgaggaacagttgcacagagcagttaagtaagtttcccaagatcagaccactaataagtggcagagttaggatttgagcccaggaagtctggctccggagtccatgtctttaactgtcacactctgctggttgagaagctgagcaccaagctcctaaggaagaggccggctaagatgggcagagttcttatccatacctgcactcacaccctggcttcagactcccccaaaactgattcagcaaactaatctgaaagtagcttcctgtcacccacccagcttctgcctcccaccgcctcagaaccctgctgtgggagcccatttccgattctggccttgcacctgctgcgcttctcttcacaaagccctcccatcattcataccacagccctacaggctaggagggatcggctctttgacaagtggagaaatagaggcccagagatggttttttgtttttgtttttagagacggagtctcgctgtgtcgcccaggctggagtgcaatggcacaatctcagctcactgcaacctctgccccccgggttcaagcaattctcctgcctcaggctcctgagtagctgggattacaggcacctgccaccacgccgggctaatttttgtatttttttaagtagagatgaggttttgccatgttggccaggctggtctcgaactcctgacctcaagtgatccgccacctcagcctcccaaatgttgggattacaggcgtgagccactgcacctggccagagagggttcttgaatctacatcttgctccatgccaccagggtctttaaagagagttcccttggccgggcgcggtggcttacgcctgtaatcccagcattttgggaggccgaggtgggcgaatcacgaggtcaggagatcgagaccatcctggctaacacagtgaaaccccttctctactaaaaatacaaaaaaaaattagtcgggcatggtggcgggtgcctatagtcccagctactcgggaggctgaggcaggagaatggcatgaacccaggaggcggagcttgccgtgagccgagatcgcgccactgcattccagcctgggcgacagagtgagactccatctcaaaaaaaaaaagagttcccttttccctccctttatcactgtgacctgggtacctcctggcctgcctcatccctgctaaagactccatgccaggcaaagcattcatcctgccttctttcatatcttcatagcaatgctctgagacagatggtattgttagccctgtatacagatgagaagattgaggtccagggagacagagccactgaaatggctctcccacagccacatggcagagcaggcctcagtgctgggccacccaggcatgtagccactccacagtactgccaccaggctgggtcaagaggccttggtttgctaatcttgctctgaaaaaagtccagaaaaggtctctgcttccttcctggctgggaggtggggcatgctgggtaatcagagagaatgcttctagagacgaggccaagctggtcttaaacaactgaggccttgtggaaggagtgaatgtgatggtgatcctgcccaggggctatgattcatctggctgattgattccagctgagtctgtaaaaatctcagtcctgctgttggaaagcagaatgtcaagtcatggagtggggtgggggtgactgtcaggtcatctaacttgataggtttggaagggagtccacaaatatgcttcttgacaagggactcatataggtggcatgtgggccagactttgggatcctctgctctcccaaaaatggtattttgccttcagtctatctgcttctgctttgcatttctttgatgttaacaaaaaggcagtagagaaatcactatgagtgcaaaaacctaggtttgagtcttagctgagatataggacccctgtgtgactctgggcaaatcacttaccttttgagggcctctgttttcacatctgtagagtgggaacagtaacacctacctatcaggacagctgtaagggtgccagctgtaaatggggcaggggtgtgttaaggctgactgcccatgggggctctgtttgccgacttgctttgtctttccttccagccccttcatgaataagttttttccagccagctttccaaatcgacagtaccagctgctcttcacacagggttctggggaaaacaaggaaggtcagtgctaaccactttcccctgtagtgtgccttgggtgtcttcctccaccattccctttgtctctccaatattggggttctccaatagagcaactgatgaagtgggctctggaattccatggcctggattcacattccaactctgctattgtctagacatgggaccctgggtgaacgccttacctctctgagcattgggtgtttttgtttttgttttttttcccatctgtaaaatgaaagtgttaatctagtacctccttcacagtcatgttgttaagatggcgagtcaataagtggaaagcattcagcatggtgcctggctcatagtaagcactcaaagtcggccttcatgattattttattcgtatatatttttagtgtgatcactgcctcacctaaggtttgaaaagggggttccacagctcttttttcaaaaataaaaactggccagaaacagtgtctcatgcctgtaatcacagcaatttgggaggccaagacaggatgatcacttgaggccaggaatttgagaccagcctaggcaacatagtgagacctcatctctacaaaaaaattgtaaaaaaatgcaaactatggggaagtgtggagatcctgggatttgtaggttagttagggtatggattcaaatgctgtaacaagattatcaatgcttgaccaaacagcaggtatttctttgttttttgttttttgagacagagtcttgttctgtcacccagggtggagtgcagtggtgcgatctcagctcactgaaacctcagccaactgagtaattgagattacaggcgtgtgctaccacacccagctaatttttttgtatttttagtagagatggagttttgccatgctagccaggctggtctcaaactcctgacctcaagtgatctgcccacctcagcctcccaaagcgctagaattacaggcgtgagtgagccaccacgcccagcaggtatttctcttgtatacaatactgagcatgtgaaatctagcacttttttttttttttttttttttcgagacagggtctcgctctgtcgcccaggctggagtgcagcggcacaatcttggctcactgcaagctccaccccctgggttcacgccattctcctgcctcagcctcccgagtagctgggactacaggcgcccgccactacgcccggctaatttttttgtatttttagtagagacggggtttcaccgtgttaggatggtctccatcccctgacctcttgattcgcctcccaaagtgctaggattacaggcgtgagccaccgcgcccggccgtagcactctctcttactggtgcctagcacatgctgccttgtccctaatcggcagcaattttatgtgattgctttgtgcatctctaaggaacctctgttaaacaattgttgattttttttttttaaagactgagcttgggccaggtgagatggctcacgcctcccagcactttgggaggctgaggcaggcggatgacttgagatcaggagttccagaccagcctggccatcacggcgaaaccccgtctctactaaaaacacaaaaaaaattagccaggcatggtggcgtgtacctgtaatcctagctactcgggaggctgaggcaggagaatcgctttaacctgggaaggcggaggttgcagtgagccgaaatcgcgccactgcactccagccagggcgacagagtgagaccctgtctcaaaaaaaaaaaaaaaagactaagcttggccaggcgcggtggctcatgcctgtaatcccaacactttgggaggctgatgcaggagggtcacttgagccctggagttcgaggctgcagtaagccacggtcagtgcactccagcctgggcgacagagcaagaccccgtctaaaaaaataaataaataaaacagtaaaaaggctaggcttataccacagtcttcaaggtcccaggccctctctatctcatgctccgccatatacagcactggccctcgggtcaggatagtgtcatcactccactgtccagccagaaggaaggagaggcatccatattccctgtccatttagctataagagaagctggaaaatggccgtgagtcggtctcgtgtccagttagaactaactcatcagggtgcgcatctgcagtcttctgttccggcaaggagaaagcattcgtatcatttctagcttgtcaagccctactgtttcagcgatcctcattggagaggaatcagcagtcgaaggaacagcgggccaagcgcagtcgtgacgtggcgttcagagagcggaagttgtcagatttcaccgggccgtaaagcgcgctggctgtgtcatcttccggttagcgacaacggctctgaccgtctggcaggccgcgtggcgcccgcgccggccttcctgcaggggactccaccggagccttgccaattccgtttgtttccctgttgtcgcccgcttcaccctggatcatgttcaagaagtttgatgaaaaggaaagtgtgtccaactgcatccagttgaaaacgtcagttattaagggcattaagagccaactggtagagcaatttccaggtattgaaccatggcttaatcaaatcatgcctaagaaagatcctgtcaaaatagtccgatgccacgaacatacagaaatccttaccgtaagtggggaattattgttttttagacaaagaaaggggcctttttgtccaactctaaggttgcttcacaaatacccttttatcctgccacaccagcaggttgataaaggagctatcaaatttgtactcagtggcgcaaatattatgtgtccaggtttaacttctcctggagctaagctgtaccctgctgcagtagatacgattgtagcagtcacagcggaaggaaaacagcatgctctgtgtgttggggtcatgaagatgtctgcagaagatattgagaaagtcaacaaaggaattggcattgaaaatatccattatttaaatgatgggctgtggcacatgaagacatataaatgagcctcagaaggaatgcatttggggggctaaatgtggatattgattgtgtcgtatgtgtgtttgtgtctgtgtgtgacagcgtgaatacaatgcctctgtggttatgctaaataagtttaacagatactttatagaaaacaaatcagggtgctcttaccacagatgaaaaaacaaattaggggacaagcagcaagcagtctgctaacactctggaatgtgaaaggagtgtctggactctgtgactcccggcaaactccacagcctctagttgtcttcttaggaagcttggaagcaattgagaatggtctaacatcaagatgtctaccacagggccccccacaaaagcagcctcggggactccggcctttccttgagacctgcatctcttcccttcttcatcgcctgctagtgaactgaggctgccgctaaccttcttcatcctttggtggcaaagtagaaagattccagaattaactcgacctttctaaagacctgggctcagaggcagctggcactgactgagcacccactatgtgccaggcactgtgctgaatgcattgtaaggactgtcttacttattcccccacagcagccctaagaaggggtgctgttatcccctttttacagataagaaaactgaagctcagagagggcactgccttccccaaggtcacccagctacaagtaacaaagcctgtgcttctaacaccaaagaccacttcccgctgacactgtgccaggcttgtaagtctctctctgggcctccattccctcctgtaggaaattggaggggttggggtggctccagtgagctctccccttctgaaactcatactaatctggggcagccaaggcttagccccgccagcctgtgaacctctcacagtgcccacagccatgccctcctccgtccaggggctgacaggtgggaggggtagccctgcctcagggagtggacttacctggcctctctgctcagagatcatcaattatgaatttgacaccaaggacctggtgtgcctgggcctgagcagcatcgttggcgtctggtacctgctgaggaaggtgagtagtcaggacctgggcagaaggggaggatggggttgacagggcagggtgggtcacagcaagctggtctcactccccgctttcctcagcactggattgccaacaacctttttggcctggccttctcccttaatggagtagagctcctgcacctcaacaatgtcagcactggctgcatcctgctgggcggactcttcatctacgatgtcttctgggtgagtcaggcagggatgccaaggatgtctggctccggggccatctcatctcatcaccctgcctctctggcccaagttgcagtcatctgacggagaagagctgttttgggctgaagttccggaccgcagagcaagtcctctctgggcccatctgtgagatggagccagagagagcagattctacctctttctgagagcacactcatgcccggtgccttccgaccacctgcctctcttccttgctagcaggggtgttacctaatcccatgtctccttggcaagggagttgagactcaaagaagttcaggtaggggtggaagaatgttgatgaatgggcccagcaagggcattcacattcactctgagaggcatcacagagggactgacgtcagcctgactcaggtacccttttcctggccccaggcagcctcttcccctctcaagtgggtagcgctgggggactttatcacttgggaggaacagaactgtgaacaaacataggctgcctggcttgggccatcagaggtcttttctatactccctcgaatttcccctttgttgcccagaaccagtatcagtggccacctcacctcagcttcagatctgcactggagcccctcccagctcccctcagatcccaggcagcagcacatctagaagcccagggacagccattcttccccccacagcccctcacttcccttcatactgctctttttttctccttctaggtatttggcaccaatgtgatggtgacagtggccaagtccttcgaggcaccaataaaatgtaagtgaccaccctgccacagggaaccccttcccccacccctgccgggccatgcccccacagcccgtttcagtcagtgcatctccctatctcttccccatgtacctcttcctcctgtggctccccagcctggtttccttatcctcaattgattcatctggctgtgttcatcctgcccaggtcccggcccctggccacttggtcgtggtgcagcatggcgtgaaatgagccaaaatgggagcgagcatggaggggaagtgtttaacccagcccggggggcacgcgcaggggctttccaggagagaaaacctctaagccgagacccctcactggggtccccttggcacctgagtgtcgggtgctgtctatcccgtgcctctcaaactgccttggttttgttcttcagtgtatccactgtttataagtaatagaaaatccacctacaggttgagcatctctaatccgaaaatctgaaatccagaatgttccaagacccaaaagtttttgagcactgacatgacaccacaagtggaaaattccacacataaggacttaacacatgtgaactgtgtttcatgcaggaaatagcattttaagattgtataaaactctttaggaggctgaggcgggaggatcacttgaggccagcagttcaagaccagcctgggtaacagcaagaccctatctctacaaaaaattaaaatattagctaggagtggtaacacacatctgtagtcctagctacttgggaggatctgaagcaggaggatcacttgagcctgggagttccaggctgaagtgagctatgatcatgtccctgcattccagcctggatgacagaatgaggccctgtctttaaaatttatatatgtataaatatatatgtgtgtgtacatatataaaactaccttcaagctattatgtataatgtgaatttcatatttaaacttaggttttatccccaaaacatttcattatgtatatgcaaatattccagaattcaaacaaagtttgaaacatttctggttgaaccatttcagatatgggatactcaacctgtataactgtctttaaacaagggggaaattttgtcatctcacactacagcaagcccaggggtagaaggctcagagtgagttaatgaccctctcttcaccaagagccaaggttacttcaggactcccaccccagcattctcagcatgtccacctgccccttaggtcatcccttcatggtcccaagatggctgccacagctcccagcactgactcctcacatagctgtgtccagaaaaagaaaggggaaattatgtctcagggagggatggtttttcccaagtctcctgtgcagtctccctcatactttattggccaaaactgtgtcacaggcccaagtctaaaccattcaccagtgagggggataggaaacatgattggcttagagtttaagctttagactagtggagaatcacctgctggtattacaaggctcagagaggggaacagaatccgtcaggcatgctagcaaggaagagaggaagatgctgccgggagggcaggcaacagtgagtgcatgccatggaagcactggctcgtggcgacaggcagtcgttgggggagactgggggagattccactcaggggatcaagaaacagctgtctttctcgtgactcactctaccactgcggacagcctttctccctgcgttgaggagagcttcatggccacaaacagctcctgaattctgtggtcccagcttagtgaccccagaggaaaacaggtttctcccagctttggcctgaataaacctacaagacctggcctggcccatgagccagacactcccactggagagatggaggatcgtgatggacaggccagggtcactgccctctccagggcctgggggcagagtattggaattggcagcccccgagaaccaagtgtacacggggagggcatttctccagagcaagggaacagatgctgggccagccagagcaacagctattccccagtgccttgatggttgagcctgggggtgtgtaagcccagagaacccagccagggtgtcaggaaaatcttttctgggtcatgaaggatgaatacacatttcccaagcatacaggggcaatatgggcatttgaaagataatgtacagcttcagcaaagggctggaggcaggaaggtgcatggaggggcctgggagcagagaatcagggagtgggcatagctgagttcagggaaaagaggctggaaagaggtgggcagaggccagatttgggaagccaaggatgccactctaaggagcttggacactgccccgtaggccactggaagactccgagcagggaagtggtgctgtcatatttggtttctgatacttagggtctggttttctgggctagggagaagacccactgccttctactgctaggactagtgctcagtggcagaaaggcagaacagtgaagtgctcatatgctgacatcaggctgcctggacttgaatctcagctctgccacttgctgaccgtgtggccttggggagaagacttgtcctctctgagccctggtttctagaactgtaaaatggtgacaatagtctctgccactcaaaattgaatggtaccaggattgagagagaaaatctgtaaatcactgcgttgtacattcaaggcaggaagaggcaggcagggcaagggtacctatccatgtattagggaagcacaagcttattcagaatccctgtgcacgcacctctgtgtacctgttgttggccagatgaaggttgcagtgagccaagatcacaccactgcactccagcctgggtgacagagtaagactccgtctcaaatatatatgtatatatgtataaagaaataaaaattaaatggccaggcgtggtggcttacgcctgtaatcccagcactttgggaagctgaggtgggcagatcacaaggtcaggaattcgagaccagcctgaccaacatggtgaaaccctgtctctactaaaaatacaaaaattagccaggcatggtggcgcatgcctgtaatttcagctactcagggggctgaggcaggagaatcacttgaacccgggaggcagaggttgcagtgagccgatattgcgccactggactccagcctgggcaacagagcgagactccatctcaaaaaaaaaaaaaaaaaaatgttggccagagctgaccccctacctgcaagtaaggaattcaaggaacaggattttcctgattggcttagtcttgcaccacacttatcacctgggaaggctgcctaacacaaaaccaggactggattagtaaagaaggcatgaggtagcagttaactgtgtacaaatcatctaatcttcactatcaccctgaggggtcagttctgttgtctacccgtttcacaggtgacaaaactaaggcaggtaagtaacctgtgcagagcacagaactaggattcagacctacagacccacaagtcagcctctaaggcccacttataactgctcttctgcttgcaaggccctatggatgaaatccagttataacctccttttgctataactagacacagagggaggcgtttctccctaatctgtatttatccagacaagctgtccagcaagatttctgagtgaggggctttaaggaagcaatctgcgggtgtgtagccttttctccctcagcaaatacagaaggagcttatagcccgggctcaccctgcttcagaacaagggccaacatctgtccatacccctgttatagtgagatgggaaaccttgtagatgttggcactgtgtggctcttttcttttatatactgggctttagggtcaatcccatttaaccaaagggttcaatagctataaaaaggcgttgaaattgtatggttatttgagttatagctcagtaaaggcattaaatcttcagcctagatgaccctattcctccccactctaaccagctgtgactccagatggagacattgccctgcatcctctcacgtccccatcccccacatcccacccagaaacaaatgtgtgagtttcatacaacaagaatggggggttaggagtcaaagtaagctgggaatacaaaaatggggcgggcgtctaaaatcccagctactcaggaggcaggagaatcacttgagcctaggagacagaggttgcagtgagccaagatcgtgccactgcactcccgattacagtcctcattgccctgggcaatagagcaagccccgtctcaaaaaaaaaaaaaatacaaagtaggccgggagcggtggctcacgcctgtaactccagcactttgggaggtcgaggcgggaggatcacgaggtcaggagatcaagaccatcctggctaacacggtgaaaccccgtctctactaaaaatacaaaaaattagctgggtgcggtggtgggcgcctgtagttccagctacttgggaggctgaggcgggagaatggcatgaacccaggagatggagcttgcagtgagccgagattgcgccactgcactccagcctgggtgacagtgcgagactccgtctcaaaaaaaaaaaaaaatgtaaactgggctccagctgactcctcacattcccgcctcccgcttcagtggtgtttccccaggatctgctggagaaaggcctcgaagcaaacaactttgccatgctgggacttggagatgtcgtcattccaggtgagcctgctggtgtgggggctatgtgaaaggggtggagagggtattccccggagcaaggggattactgctaaacagacaggcttaccagctgagaaagagaaaaggtaaggctggatcaggccagggattggtgaagggttcccccttaacatccgtttacggagggccagtcaggtgccatgccccaagctgggtcctggtcaggtgtcagtgaacaagactgtcttcacagagcctctggtctaggtgagcagatgttgctcaagaactacaaaagtaaaagtctaatgacagattgaggtacactctgaaaaagcacgtttcatgacaatcttaacagactggacccctgtcacacacacccacacatacacataccccttcccagcatctgcaagcatcacagatgtaccagaattgccctagcccccttgctcctcctccctgtgccaagacatctccagggagaacacacacatgggctcctgtctgcactctcagcagaggagcatgtgcgtgcacacctgcttatctgcagaggctggcctttgagcccctggatctgcgtgtgggttctagtcagtgtgtctgtgggtatggacacgggccctgtccacaatccaagcaggatagcacatcctgcgcaaccacagcctggcctcactttggggcaggagcagctcaaactaccagtcaggaaagagactaagggcaaagctgagctgctgaagtggctgaggctcgggtgtgtctgcttatctgggcccagttgtgggggcagtgaacccaagggacatacttgtcttcctagcctcagagtgagagggttagaagcttgcttaaaagaaggttttagctgggcacagtggctcacacctgtaattccaacactttgggaagctgcgtggggaagatcacttgatgccaggagttcaagaccagtctggacaacatagcaagacctcatctctacaaaaaaaaaaaaaaattagccagtcgtggtggctcatgcctgtagtcccagctactctggaggctgaggtaggaggatcgtttgagcccaggagttcaaggctgcagtgagctatgattgtgccactgcacttcagcttgggtgacagagtgagaccctgtctcttaaagaaggaggtctggcctgggcaaattgtgagaccatatatatatataaaattattatttctcctttttttttttttttgagacggagttttgctcttgcccaggctggagtgcaataacgcgatctcggctcactgcaacctctgcctccctggttcaagcgattctcgattctcctgcctcagcctcccaagtagctgggattataggcatgcaccaccacgcccggctgattttgtatatttagtagagatggagtttcttcatgttggtcaggctggtctcaaactcccgacctcaggtgatccacctacctcggcccccacaaagtgctgagattacaggcatgagccaccacgcctggccgaccccgtctatattttttaaaagaagaggaattattttaaagcagcagattaaaggctgacttactttccagggtaggatattatagcaattctgatcacctagggtgatacaggcacttctatttgtgacagttgcattttgtgacacatggaggtgacacagaggctttccctgttttaccagtgaggaaactgaagctcagaagtaaagggaatgatacaaattcacacactagtaagcaacagggccaggactcagaccagcactgtccaactgcaaaaaaggctacgctgtcagaactgctccttacagcagcactagcagtaataagacggtaatcacaacagctaccatttatcaagcacctgtcgtgtaccaagaatggtgctaggtggccggccgggcacggtggcttaagcctgtaatcccagcactttgggaggctgaggcgggtggatcatgaggtcaggagatcgagaccatcctggctaacatggtgaaaccccgtctctactaaaaatacaaaaattagccaggcgtagtggcgggcgcgtgtagtcccagctactcgggaggctgaggcaggagaatggcatgaacccgggaggtggagcttgcagtgagccaagattgcaccactgcactccagcctgggccacacagccagactccatctcaaaaaaaaaaaaaaaaagaatggtgctaggtactttttatatgtcatctttacttctcccagcagtccagtgagatagagggcatttccattttacagataaggaaactgaggtttgacttgcctgaggccacgagggtatgggcttgcacccatgtgtcttcataatttgcagtgctgtgaggcagggagacttgcttccccagtagaaggcatctctgtcagacaaaagaaatggagtcctgtaaagcatctggctcactcttaagggcacggtctgtcattcacccacacaaacttcccctgtgtccttgtcataagttccaggcttgagacaggcacaggacatctcggcatatctgtcctttccccaccctctatatatatccccagtagtcccgcaatcacaataaatgtaagttgatcacagtggagcgttgtttggaaggccagatgcactttaggagtgaaaatccctggcagagctctgacccctggattagttggagaacactcgtagaaatcagccgccagggggcactgagttcccagcttgattccagaataactgcagttgtctgctctatccccaaccaactccctactcctacagagtattcattgagaactaattcatttccctctttaaaattaatcatatgttgacagttgacaggcagtgcttcttttttttttttttttttttttttgagatggagttttgctcttgttgcccaggcagtgcaatggcacaatctaagctcactgcaacctccacctcccaggttcaagtgattctcctgcctcaacctcccaagtagctgggattacaggcatgtgccaccatacccagctaattttgtatttttagtagagacggggttgcaccattttagtcaggctggtcttggaactcctgacctcaggtgatccgcctgcctcggcctcccaaagtgctgggattgcaggcgtgagccaccgcacccggccaggcagtgcttctcagcgccttccttcaagtaaatgagactcagagcccagagcccagtaagggaggcgacacacagggtgtgcgtatagcacagggacaggactggttggctgtgttttggggttgcttaggcttccgggatgtctctttctttttcttttttcttttttagcagaaccattgcttacaattggcttggttttcaagtttcagagtgcagtgggtggaccgaggtaaccctctcctgtgctcctgtggagccttcaaatagcccactgcttgcccctcctcctcccccctccagccacgcactgccacaggggcctttttcaaaatgtgtttaggttgttctgctcagaactcctccagtgcgtctcttcactcaggataaagacccaactcctccccatggtcctcggggccctgcagggctggtctatctcctcatctcctgccagtaggcaagctgccttagtgacccctcagtccctgccacatctcctgagcactctttctccaggacctttgcacatgctgttctctcctcctggcgtgtggcatttccaagaagccttccttctttcccctccttcacccctgcccagcctaggtctcatcctgttacaccttcttacaacatgggaagcacaattctcctgcctcagcctcccaatagctagaattgcaggcgtgcactgccatgcccagctcattttggggttttttgtattttgagacagagtctcactctgtcgtccaggctggagtgcagtggcgtgatctcggctcactgcaacctctgcctcctgggttcaagcgattctcctgcctcagcctcccgagtagctgggactacaggtgcctgccaccacgtctggctaatttttgcttttgttttttgttgttgttttgttttgttttgtttttttgagacagagtctcgctgtgtcaccaggctggaatgcagtggcgcgatcttggctcactgcaacctccacttcctgggttcaagtgattcttgtgcctcagcctcccgagtagctgggactacgggcacatgccactatgtctggctaatttttgtatttttagtgagacgaggtttcgccatgttggccaggatggtctggaactcctgacctcgtgatccacccacctctgccttccaaagtggaagcactctttaacagtcacaatctcacaatgatttccgtgactatttgaggtatgtcatagtgtggctaccctgtccccctggctgagctctgtgggagcagcgattttgcctactcctacatttcccatagtgcctggtacataggcacttgataagcatttgggcagacacggtgtgacatagtatgatgcggtgaggtgctgggtcattgtagtcccaggccaaagcaaaatcctgggcccctctcattgttctaggtagagaaatgggactttctgctgtcacttgagagtattggccacacccttggtctccaatgattgctccaagatggaacaccaggttggggaccaggacccagtctcctgttagttcactgccctgctgcttccctgccactctctaaccccagctttctcccacagggatcttcattgccttgctgctgcgctttgacatcaggtgagtgagtgagggcctgccccagcatgggcttctccagggattctccagtggccttcaggagcccagagaaggtacctcaggagaccagaccctccacccccacagcagccagagcaattctgattttatctgcattttgcatcttgaagttctaagtatttgaagagcctgtggtcaaaaaattgttttaagaatcataggccaagagatttaaacccacaagggcctggtggtactcacagtgctttctcactgtgtgaccttgacaagtggcctgaccttcctgagcctctggtttctcatcttgagttaataacaagagttcctaccatgaaaatctggagagagtgctgagcacacactgacctcagtcgctcttggttgaatcctggttgcagtcatcatcatcatcttttatcagcctagcgtcaggtcaccatgtctcagctgctctagctgttccctgccctctctttactcagacatttttcagtctgttgtagacagtgagcacgagggggagaaggtgggcaacttaggtcagcgtttaaaacacaagaaaggtcttatccaagttaatgcacctatgcaatgggacttgccgtcagcagggggcgccagcaacagctccatcattttatgccccgtcatccctgtgagggctggcaatgttgcacttaactttgaggtggtttgtgaacttctcttgatttcctcatgcctgatagttgcaaaagcagtaataacagtgacagtggtaatgagaaacttactaccagcatcattgaaatccagtttccatgtgaaacttaggtttttcccactcacatacacctgggttatttgtgtagtgccacttcaaaccttaggagcatatgggctcacagtcacctttggaagagacctggccagtctgtaagtagagggatgtctgtgccagccgtctctactcctggctgttcagaggtaatacaaagtgaaacccataagaagcccccaggctatttgctggagacagattcaactgccagcaccctcagagacagagtctcattttttagcctgggctcacagcataagcagctcctcagctgatttccagaatcagtgcaacattcccaaagggagtcacttgtatcccagttctcaagataggtgagttctcaaggtacttgcagccgaaggcttagaagcacccaggacaaggagagaagggggtcagaagcactcattcattccacaaatgttaattgagtccatagtactggctgggcacatcccaggtgctggggacatgcagaggttacggagctggcattggagagggaagtcacgtaatggcaatgccgggctgtatatgattcatctgttctgaagctgatcttggatgaatcacctccaggaagccactggcatttattcatgcagccagcatctagttagtaccacaaataggctattgaactattacgtccactgcacttaaaagtagtaacttatctttgcagtttctgtatctgtgtttctcaaagcatgatccaacggtatgagattcacctcagatgtttttttcaaaatgcagattcctgggccctgctctagagctattagatcagactccctgggggtgggacctagaatcctgcattttttcacaagctttccagatgatttttatgctgactaaagtcttacagccactgttataagttgcagcatttgatattcataactaccaaggagatgagctcattttcccattttgcagatgagtaaactgaggctaagagaaggaaagcaacttgtccagagacacatagctgggggcagtatcagcgtgcacacccacctccagactcccagcccagagctcagtcacccccccacaacctctagggtcttccccagctccctcagaaggggtattactagttcagtccctatatctaaccctcctcctctttcttcacaccttccctgcagcttgaagaagaatacccacacctacttctacaccagctttgcagcctacatcttcggcctgggccttaccatcttcatcatgcacatcttcaagcatgctcaggtgggcaggacggtatcagagtgtcaggaatgcctcactgcaaatagagggacttacagagggatttatttgtaaatgcaagcagtccagagataggcactccccactggtgttggagcagtcatgtctgtgattctcttggccttccatttgtggttgcaagatggctgccactgctctaggcagcatgggcacgttagaggcaagaaggagggaaaagcgtaacagccatgcctgctgccttcatcaggaaggcaggaactttcccagaaccctttcagcatctcatgggccagactggggtcctaaagccaccctggctacaggagagtccaggaaagaggatttggcttctcagccttggtagtgggaagcaggcagagaagaacaggattggagtgggtgttgggtattggggcgtccctccccctactccctagtagaccaggctctgcctccttctcccaccaagatgaggatggagtactgagctgccacagaatgaagcaacatagcacaaagactgggagccctcagtgtggcctggagaggggaagattcaggggaaagtgagcagacaggattgccctactttctactggaaataataagagctcctgtttgttaagcacttccacatgtcaggctctgcactcatgaggatccttgtgaacaggtggggaaactggagttcaggtgacacactgcaagtatgtggtaaagccaggattcaaacctgggtcagcatggaaaccacacccaggctctcaagccctggccatgggaaacgcagcattgaacaggggctaagggagccctgttgtgaatcccagcaccacccagtaaccatggaactctgggcttgctgcttctgtcccctttccccttccccagggcccaaatacagacgagccatctttgaattaatcacaaaagctggggtttttttaatcactctgtgccaggcactgtgctaaactcttttgctaataactcatttagtcctagtacagtattactttatagaaggtcaaaaggcccctagcccataattagaaaaaccaagaacaaccattgtggaactgcctctcacttctgctcaagggcttcaatggcgtgtaaggtgagagtaacatgcgtatggcaagggtcacagagagtgactggacctggtttggaggactagttaagagaccttttggaggtctctgcagctcccggccccttattggagtccaagcccagagccaattcccccagtggccataaggtggcagcctcaccctctgcctggctggactgagaagaggctcccattcagagctctggcacacaggagtcctctcctttatcggaaaactgcagcgctgagagaacgcgaacactacatcaggctgggccctgggtggcgatctggactccagactaatgaactcctgaaccctgccccaaggcctgtgttactccccagcagcagcccagcccttctccccagtcatccaagtgggtacctctctgaaaatccttggaaaggggatccaggacatgaggggaccctgtcccatggggtcccctgctctccaacacacaggtagtcccagtgctagcattggtctaggtaagggtcacctctgcctttgtgcagtggtgtgatctcagctcattggagctccgcctcctgggctcaagcaattctcctgcctcagcctcccaagtagctgggattacaggcgtgcaccaccacacccagctgatttttatatttttagtagagacagggtatcaccatgttggccagtctggtttcaaactcctgacctcaactgacctgcccacctcagcctcccaaagtgctgggattacaagcgtgagccaccacacccatcctacttagggattgttagattcaataatttaatatacataaagcagtattgatcacagcccacctatgacagatggcaagaaataagtctgaatgttaggatcaagggcatgcgggaaagacttctttgttctctggccaagggctggctttacgttaagaatgaagtctccggccaggcgtggtggctcacacctgtaatcccagcactttgggaggccaaggtgggtggatcacctgaggtcgggagtttgagaccagcctgacctacatggagaaaccccatctctactaaaaacacaaaattagccgggcttggtggagaatgcctgtaatcccagctacttgggaggctgaggcaggagaatcgcttgaactgagaggcggaggttgcagtgagccgagatcgcaccactgcactccagcctgggcaacaagaaggaaactctgtctcagaaaaaaaaaaaaaaagaatgaagtttcctcaccctctccaggacaatctcttcacttcatgagcacccatgaagacgcaccatgaaggagccattcactgagtatttaccaggccctcttcagtatgcagggcacactacggtgagcaagacagctgtgggcccgccctcactgaactcaccacctatggggatgttccattacaaattgctggggaggccaggcacgatggctcacacccataatcccagcacgttgggaggcaaaagcaggtggatcacttgagctcaggagttcaagaccagcctggggaaaatggtgacaaccagtctctacaaaaaatacaaaaattagccaggcatggaggcgcacacctgtaggcccagcaacttgtaggactgaggcgagaggatcacttgagcccaggaggtcaaggctacagtgagccatgttcatatcactgcacttccgtctgggagacaaagtgagaccctgtctcaaaaaaaaaaaaattgctgaggaatgctgtgagggaaattagagggacttacagagcacgtagcaagggacctgactccatgtgaaagaactcaagtgcaccagcctggccaacatggtgaaaccgcatctctactgaaaaatacaaatattagccgggcatggtggcgcatgcctgtaatcccagttactcaggaggcggaggttgcaatgagccaagatcgcaccattgcactccagtctgggagacagagcaagactctatctcaaaatcacaaaaaaaaaaaaaaagaaaagaaaagaaactcggccaggcgcggtgtctcacgcttgtaatcccagcactttgggaggccaaggcaggcagatcacaaggtcaagagatcgagaccatcctggccaacacggtgaaaccctgtctctactaaaaatacaaaaaaattagccgggcatggtggcaggcacctgtagtcccagctactccggaggctaaggcagaagaatggtgtgaacctgggaggcagagcttgcagtgagccaagatcacaccactgcactccagcctgggtgacagagccagactccatctcaaaaaaaaaaaaaaaagaaagaaactctttgggctgggcgtggtgcctcaggcctataatcccagcaatttgggaggccgaggcaggtggatcacctgaggtcaggagttcgagaccaccatggcgaacgtggtgaaaccccatctctagtaaaaatacaaaaattagccaggcgtggtggcaggcacctgtagtcccagctactcaggaggctgaggcaggagaatcgcttgaaccctggaggcggaggttgcagtgagccaagattgcaccattgcactccagcctgggcaacaagagtcagagactctgtctcaaaaaaaaaaaaaaaaaaagatttgggtctctgagtcctgggctattttccctctccttgtgaagcattggtcttcctcctctgcaaaaggataaccatcatgggatgtggcagtgggctgacttcctgggaaggctaagctcagtgcctgcacagtagatgttcatgaacagggtcttagtataaccgtccttttctccaaacccagctttaccaggagtctcagcacagacatgccaaattgcttgggtgtgaatcctgggggagccagtgaccagctaggtcaccttaatacaggctgcaacaagtagttattacatagcagctgtggtgtcatcatcactataatagcatctcctggagcatttgctaaaatgcaggtgtgagccccagacctcaggaagcagagtctctgggagtaggaccaaaccaggaagttgctttttgaacctggtgacctaggtgattcagatgctgccagccaaacccctgggaacccttgaagccctgcctacttgagtttcttagttttcttgcattccctctcgggaggagcaacccttgtctgggagttaggagccctgggttcaggcccagccactgacttgctatggtcctggaccagtcactgtccttcagtccagcccagaaggggtttggggtgctgggcacggccctgaggcagtgccgtgcccagcatggcttcaccagcctgtgtcctctcatagcctgccctcctatacctggtccccgcctgcatcggttttcctgtcctggtggcgctggccaagggagaagtgacagagatgttcaggtaaggcagagtggggggcagatgtcctcatgggcaccagtgtgcctgctggcagtcagtggaacctgctgggggtatctttacacctctccaggggaacattgttcctgccaccagccccaccccttgcctttttcagcagtacatgggtacctggcctgtggacaccagtgggaaccttaccctgggccaggagccaggggagcgcaaggcatcagagccctctaggcatcccccatccaaatgttagctggatcttaagaatagctgttgtggatttttctctgcctactgtcagaagtcctaggtgactctgcccccaggtgacttcaggcatgtcttcccctcccatggcctcagttttcacatgtgagtaatagaacagggggcgtgtgggatgccctagtgtggtagaaagtgccccgagtagaaggcaggtgtcagtccctgttcattcacctctgtggctttaacccacagctcactgctttctctatatctgtatctcacacagataccccttccccagggccatatccacacctaccacaccctgcacacagccccacccataccgcaaggcctgcgtgactccaacaggtgtctgcccccagcactgccgaccctgcctgccagggacctagaaatagctgtcagttgcgattaaagctgcctactcgggtgccttccgcccagttccacctgcctggcctccaagctgtccctagagcgcttgccagggcctcctgtgcacctggctccccgcaggggagcctgtgactcacccctcccccggacctgcctctgccctccctgtcctgtctagaatccccagccccccgcctgcctgcccacattgcctcgcccagcaaagctctgtggtctgaggcaagtgggggctaggggtgaacttggggacaggtctcagggagctttgggagcaggcatggcacccgatccctgagcttagcacccatccttcaccctccctctgcttcccatccagcccaggtttccctgcccctccccttggggtaaccacccaatgctattgtgccctcatcaggcaaagctctgaatacacaaggcagagggtgcccctggcctttacctgcttggtgctaaatgctctgccatacaggtaccctgcccccactgtttgccctccactcccaccctggacattcttagattggggtaaaaagcaagtgatctctctctctctctctctccctcctttctccccatttctctcccaattctccacctttttacttttcccttctattctcctcctttttttattgatttacttatttttatattggtaccacattcacatagttaaaaattccaaagctgtaacagagagagcaccctcatgctccagctaccccacagaggccagcagtgttacacagacattcagacacctgtgcactgatgtgtgtatactttttcttgcacagacggtggcattcttggagcattctgcacattgggtttctacggtatttcttagaggtgtttccacagcagcacatacacttctagagcatgcttgttcttctgcacagtggcctgatgtgcctttgtctaggtgcatctttcttttttcattctccaaataatatcagcttctttccataaaatctggaagtgcaaaaataggtaaaaacaagacagttctgctctctgctccttggaaaggaagtctctgtcctcccttagtctttccctatccatctctttttttctgtctcttctctctctctcacacagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatgtaatgcccagcgggtgcccacctgcccgcttccccctactgccccggggcccaaggtagggcagacactgcagctccagtgcatagggcagggaccattgccaggagtaggccgcaagagcagctcctccacaaccaccaggcagtggttgcaccgagccatagggctgggaagcaggacaaccccgaagcttcctgccctcaccagtaatgcggggcccacatcatagtggatggaaatggcccttgtcatgcagtagtagatactgttaccattcaaggtatatgtataaccttaggcaagttactttcttcatctgtaagtgggcacattcctgcctcacggggtttatctggtgaggaaagatttgtattatctttggcatgaactcagttgcttgaaaaatgaagcccatagaagaagctaagccagggtgtctgtcttcagagcagcaccttgccgcttgccagtacagcagtgccctcacctctggggctgagctgtttgattcatgctgtgtgccctgggaggcagcctatctccatctcttgtagccttgtcatggccacccctttttccacgctacagcagaaggttcaggaagcttgaaatcagcccacacaagcccaggcccaacctctcttccattggctgctgcccttgctgcctcctggtacccccaggctcagagaaagcagagcagcctgcctgaggagggcatgtggtagggctggggccaggcgctgttaggtgctgggcagtggacacagggctgacgctctgcatgtgaccaggcgctttcctaggatgggggtgggggaaggggacaaccaaggttctgctcaccctctcctctaaatgaatttttattgttgtttttttttttttggtcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgctcctggaagattctctgtttaagcacccagtgtcttgccctgggttttctaggtctcacctgcccacccaaaatcttttctgcaagccccttaagggtgcccaccccagtgcctggccagccctgcacccgtaaaacaccttttagccagtagagggggcccacgagccctctctcaccagctagcacttttctcaccaccttcctcgaaatacttgggggcagcaagggtgttggcagatgagagtctcccactcaccatggtgagagtggtggggagtacccagggctgacctgactcacaagggaagcagtaactgtagaacctgccagcctccctggtccctgtgcccatatggcttcggctgatgagggctcagactctaggttgccctgaagatcaaggctttgtctcccattctgcccattcctgggtttcttcccaaaatgactactgtggggccagtcatggcacaagggccaggacctctagaggctggggtggggaaggactgagctagtgattcttagaggccttctggggcctaagagctgaaatctcagcgcccgggtttccctaaagtttgctgaagacagcagccccggccagcaggagaccgaccgggcaccaccccaaaccaggcaaacggtggccacaaccctcatccacccacctggtatgaggtcactgagtggggaaacagacaggagcgggtggccaccatactgacagacccggggctctcccttgcccaagcttcaggttcaaaggctgaaaataacagtggcttccagtttggaagtggccaaaggacaatcatgaccagagactcaggagtatgactgtaataccctcactaggtattgacatgcactaagcaccttgatataggatttcacttccttctgagtcttgggctgtatgtgctattattcgctccgctgtgcagatgagggaattgaggcagcttgcccatggacatcgatttgaccttagccaagccaaacaattccaggttcctaaggaccgcagctcctccccagacccctgggaccaagtcactggctggtgtgctgggcatccctgagccccagccacccaattttactggctccagggttctataggaaggaaaaggggtagaaaatttcaaaaggcttcttcctttcagggaggggggttccctttcaggggcttctggaatctctacccactccagccaactctgaggccatgtggtcctggaacaaggcccctctgaggcagatggggcaggcggcccaggcacatagcatggttggctctgcggcccagggcgcacaaaggccttattgagtcaccaccagcccccggcagaggctgaggtggcagtggcgccgagcgcctgccacctaatgactgtcctggtccagccagatgttccacagacctccggagcagcggactagggcccgcccggccagccggcaccgcagaggccactgtaattccaattaaccagcttcagctgagcaaacagcgggcagtggtggcccagcccaggcggtaggcctggcccgcagagcctgcgagtctagactccagatgtgaaccgccaccatcagagtcccatggaaaaatggcaccaggccgggcaaggattgggcctgcatgctggggagggggtgtgggtggttgggcagggccccgagtgggctagatgccagcctcacctggtttggggtggattattaggaaactgctctagaacccaagttctaccctgctttattagattctgtttctgtgcctcagtctcccatgactgcgacaagagagagggttccaaggggaaaaccagccctgctgagaccccagtgtgcactgactgtatttcacgtgactagcattatgctagtgcaactgacccttgaacaacacagggattaggggcaccaacccatcatggtcgaaaatctgtataacttttcagtcccgcaaaacaactaatagtctgctgttgaccagaagccttacctgataacataaacagtcaaaacatcttgtatgttatacgtactacactgtctaccatagagtaagctagagaaaatgtaattaagaaaatcctaagagccaggcatggtggctcatgcctgtaatcccagcattttgggaggccaagatgggcagatcaggaggtcaggagatcgagaccatcctggctaacatggtgaaacccccgtttctactaaaaatacaaaaaattagccgggcatgatggcaggcgcctgtagtctcagctactcgggaggctgaggcaggagaatggcctgaacccgggaggcagagcttgcagtaagccgagagaggcaggcggatcacaaagtcaggagttcgagaccagcctggccaatatggtgaaaccccgactctactaaaaatacaaaaattagcctggcatggtggcaggcgactgtagtcccagctactcaggaggctgaggtgggagaatcacttgaacccaagaggcggaggttgcagtgagccaagattgcaccaccgcactccagcctgggggacagagtgagactccgtctcaaaaaaaaaaaaattattcagtgaaagtggatcatcataaataaagatcttcatcctggtctctgtgttgaggaagaggagggggttggtcttggtgtctcaggggtggcagaggtagaaaaaaagtccacgtttaagtgcacctgcacaattgaaacccgtgttcaagtttcaaatgtatcttaagatttacttaatcgttgtaacaacactttgaggtacctacatcattcttacgatggggaaactgaggcagagaccgtaagggcgggcccagggggcatgtgaacccagagtgtctggcttccaagactcgtattcaccgtggtgccgtttgacatgatcaggataatggatccctggttccttttgggggcagcattggagaagggggtttggcaccgtcagtctgacagcagggctggctcctgcagtgtgaatgaagcggtcttgtgctcgactgtgaaggggggttaggacctgcttcccagggcgggtccagctttctgagggaaagccttcagagcctccatcaggccggcaccaggtaccagttaagcactgggcagggaacagaagtggtcaaacgccgcttgccgcgacttgaaactgctgaataaatggataatgtcaagcgctatggcttagggcagtagtacctccggttcctacgatcgtgtctggggtccctgaggagcaaggcaagagtcggccattcaggaggtcagagttcagctgttcttgcacaagcagggaagctgagtcaccccaaacacgggcaagactagcggtggtatcaaatggctatcaggggcggggcctcaggggcctgcccctgcctccccgccctgcgtttggattccctccagcattccgggccagggcgcgggaggcggaggccgaggagaggacgggaggaggctgcatcctgccctggtgcgtcaggaagggccgagcgagcgggaaggaaagcaccaccccccacccccgccgcggccacacctgggttctccaggcgggcaggggggcccccgggccggcgcctggctccagcaagtctgggccgcctccccgcgccgccccgcgggggccgccagatgggctgcccgcccgccagctcagcgacgcaggcaggaaacgccggccgggctgccaggaacgcgcgcaggggagggggcgggcccggccgggccacgcccgccggaggggaaggaggggccaagcaccgcccggcggggactggtgagctccaagagcctgcgatcccggtccctgcctttactagatgggtttccttgggtaggtcgttttacttctctgtgcctcactttccctacctgtaaagcggggctgcctgtctccgctctttttcccttttctcttttatttgtgcagcagggtttcactctgtcgcccaggctgaagtgcagtggcgcgatcacggcccactgcaacctcgacctcctgggctcaagcgatcctcccacctcaggtgggaatataggtgtgtcccaccacgcctggcttttttttttttcccctagttgaaacggcggttctcactcttgctcaggctggtctcgaactcaggctcaagcaatcttcccacctcggcctcccaaagtgctgggattagaggcgtgagccaccgcgccgtgcctcagctattttcgtgtgaccgtgtgatctcaggacactttctttcccttctcttccttggttttcttacctgaaaaatggggtgaacaattgaacctccctcaaccatgggctaagcctttgttttcctctccaccgtagccccaacacttggcccattgcctgaaacatgaaggcactcagtatttgttgtaagagtgactataaaggtttgggacaatcctgagggcctggctacagcaggcacttcataaatggacacaaattatcaaattacctagagtctaatgtttaccaacctgcggcttcaggcaagtgacttcccatctctgagcttcactttcctcgtctacataatggctgtgaggattaagtaaaataaataaatacatggaaatcacacatagtgtgttctcaatagatatttatggaagagtctccaaaatattaaaaaaagggagatactattttgagtaaatttgagggcaaggaatatacaaaggagttaggtggcttggaagaagatttttgctatatatgtaaactaagctgtgtgtgggtgggtattttgcttgttggtttttgagacaggctctcactgtagtccaggctggagtgcagtgtggcagtcatagctcactgtaaccttgaactcctgcactcaagccatcctcccacttcagcctcctgagtagttaggactacaggtgcgtgctaccacaccctgctcactttgcattttttttttattttatttatttatttttttgagacatagtctcgctgtgtcgcccatgctggagtgcagtggcgcaatctcggctcactgcaagctccacctcccgggttcatgccattctcctgcctcagcctcccaagtagctgggactacaggcgcccaccaccaccctggctaatttttttttgtatttttagtagagacggggtttcaccgtgttaaccaggatggtctccatctcctgacctcatgatccgcccgtctaggcctcccaaacatgctgggattagaggcgtgaaccaccacgcccggcctcattttgtatttttaaaactttggcccgggcgcgctgtggctcacctctgtaatccagcactttgggaggccacggcaggcagatcacgaggtcaggagttagagaccagcctgaccaacatggtgaaaccctgtctgtattaaaaagaaatatggtcaggtgcagtggctcacgcctgtaatcccaacacttcgggaggccaaggcggactgatcatttgaggtcaggagtttgagagcagcctggccaacatggtgaaatcccgtttctactaaaaatgaaataaaattagctgggtgtggtggcacgcgcctgtagtcccagctactcgggaggcagaggcaggagaattgcttgaacccaggaggtggaggttgcagtgagccgagatggtgccattgcactccagcctgggcaacaagagtgaaactccgtctcaaaaaaaaaaaaaaaagaaaagttttttaattaggctggacatggctcacacctgtaatcccagcacttgggacgcaaaaggatgtagaatgcttgaggccaggagttcaagaccagcctgagcaacatagcaagactcctcccaatctctaaaaaattttcttggccgggcgcggtggctcatgcctgtaatcccagcactttgggaggccgagacaggtggatcacctgaggtgaggagctcgagaccagcctgaccaacatggtgaaaccccgtctctactaaaaaatacaaaaattagccaggaatggtggtgggtgcctgtaatcccagctacttgggagcctgaggcaggaaaatctcttgaacgcgggaggcagaagttgcaagtgagccgagatcatgccattgcactctagcctaggcaacagagcacgactccttatcaaaaaaagaaaaaaaaaaaaaggtcgggcacagtggtttacgcctgtaatcccagtactttgggaggccgaggcgggtggatcacgaggtcaggagtttgagatcagcctggccaacatggtgaaagcccatctctactaaaaaaaaataacaaaaattagccaagtgtggtggtgggcagctataatcctagttacttaggaggctgaggcaggagattgcttgaacccaggcgggagaagttgcagtgagccgagatggtaccactgcactccagcctgggcaacagagggagactcagtctcaaaaaaaaaaaaaaaaaaaaattaggctggacacggtggctcacatctgtaataccagcattttgggatgccgaggtgtgtggattgcttgaggccaggagtttgaaactatcgtcggcaacatagcaagacttcatctttacagaattaaaatttaatattagccagaaatgatggcacacacctgtagtgtcagctactcacgaggcagaggcaggaggattgtttgagccaaggaggactgcttgagcttgggaggtcaaggctgggtgagccatgatagtgccactgcacttcagcctgtgcaacagaccaagaccaggtctcaaaaaaggccgggcaccatggcttaagcctgtaatcccagcactgtggtaggccacggcaggtggatcgcttgagcccaggagttacagactggcatggacatcatggcgaaactatctctacaaaaaaatacaaaaattagccggatctggtggctcacacctgaggtcccagctactcgggaggctgagatgggaggatcacctgaactggaggtgagccatgatcgcaccactgcactccagccttggtgacagagaccctgtctcagaaaaaaaaagaaaattagatgtaaaaaacattgaaaataaaacagcacatttggccacccatagattactttcagatttttttctatgctttttttttttaacccaaatcagatctaaatgaagtattttttccatagttaactttcttcccatttcagtcagttgccatttcatctcacacccagacagcatccaacctttgtcattttaaggcagacaggtgtgacaaacaaggctatcttcatgtgaaggcagacccctgcagagaatgcctggtggagtctttgatgggccctccctactgccttcccaaaaccatgggtcccagctctgtgccccctgggatcagcccagttgggggtacccagcgaaggtgctgcttcaagacccccatgggcctgtccacctcagacaggtgctttcctttgctgccagacccccatgggcctgcccacctcagacagatgctttcctttgctgccggaagctggccacccaccccctctcaggctaccccaggtcccagctgggctctgaagtgcgggaggggaggtggaggcactggtaacactcagatgcagaggtggtgagggaaaacccagggtactgagtctggaaaacagatttcttaggtgtggactttgggggagaagctgagcctctttctgcctgaccgggatcctttcttcttgacaggttctctatgcaactatgcgtgcatgttgcggggacggggtaggtgtttgactgacagtgtctgctcctgtgagaatctattctgatggaccgggtttggtggctcatgccagttatcccagcactttgggaggccaaggcgggtggatcaccttaagtcaggagttcacaaccagcctgctcaacatggttaaactaaaaatacaaaaattactccggcgtggtggcacacacctatagtcgcattgtgtctgtaattggcaggttcttggtctacactgacttcaaaaacgaagctgcagaccctcgcagtgaatgttacagttcttaaaggcagcgtgtctggaatttgttccttgtgatgttcggatgtgctgggagttttttccttctggtgggttcgtgatctcactggctcaggaatgaagctgcagaccctcgcggtgagtgttacagttcttaaggcggcgtatccggagttgttcgttcctccccgtgggtttgtggtctcgctggcttcaaaagtgaagctgtagacctttacagcgagtatcacagctcacaaaagcaatgtggaaccaaacagcaaaaaaaaaaaaaaaaaaaaaaaaaaaaaaaaaaaaaaacaccaccacacacacacaccccatgcagaaaggaaccccagtacattaccactgcagagccgggcagcctgcttttattctcttatctggccctacccacatcctgctgattggtccattttacagagagctgattggtctgtttcacagagagctgattggtccgttttgacagggtgctcattggtgcttttacaatccctgatctagacccaaaagttctccacgtccctactagattagctagatacagagtgctgattggtgtatttacaaaccctgagctagacacagattgctaattggtgcatttacaaaccttgagctagatacagagtgcctattggtgtattcacaatcccttagctagacataaaggttctccaagtccccaccagattagctagatacagagtgccgattagtgcatccacaaaccctgagctagacacagggtactgattggtgtgtttataatcccttagctagacataaaggttctccaagtccccactagactcaggagcccggctggcttcaccctgtggatcccgcacaggggctgcaggtggagctgcctgccaatcccaggccgtgtgccgaccgcactcctcagcccttggggggtcgatgggaccgggcgccatggaggagggggcggcgctcgtaggggaggcttgggctgcacaggagcccatggggcgggggggcatggcgggctgcaggtccccagccgtgtcccacggggaggcagctaaggcccggcaagaaatccagcgcagcgccggtgggccagcactgcttggggacccggtgcaccctctgcagctgctggcccgggtgctaagcccctcactgcctggggcggcgggccggccagccgctccaagtgcggggcccgccaagcccatgcccacccgggactctagctggcccgcaagcgccaggcgcagccccggttaccacccctgcctctctctccacacctccccgaaggctgagggagccggctccggcctcggccatcccaggaaggggcttccacagtgcagcggcgggctgaagggctcctcaagcgcagccagagtgggcgccgaggccaaggaagccccaagagcgagggagggctgccagcacactcacctctcgccatctactcaggaggctgaggcaggagaatcacttgaacctgggaggcggaggttgcagtgaactgagatcgcaccactgcattccagcctgggcgacaaaatgagactgtctcaaaaaaaaaaaggagagtctatgctaatgtttgggtttctacaagttgtgggtaatggtaaagttgaaatcttacgtggaccagtgctgtagatgggtttctatatggttgtgattgtgaatgcatgattgtgtgtttgtgtctaagtatgtttaggagtatgtgtttctgagaacatttgtgagcaagtgcctgcattggtgggtgggtgtgtgtaattggtgtgtgggtataagagagacagatcatgtggaagtgtttgggttgataaaagggcttttgcaagggcattgcctgtgcgagtttgtgaatgtgtgctgtcccatctgcttgcttgcttgttttttttcttttttgttttttgagacggagcttcgccgttgttgcccaggctggagtggaacagcgggatctcggctcaccgtaacctccgcatcccaggttcaagcgattctcctgcttcagcctcccgagtagctgggattacaggcatgcaccaccacgctcggctaattttgtatttttagtagagagggggtttctccatgttggtcaggctggtctcgaactcccgacctcaggtgatctgcccgcctcggcctcccaaagtgctaggattactggtgtgagccactgtgcccagccctttctgcgtgtgtgtgtgtgtgtgtgtgtgtgtgtttcaggtcttgtttctttggttcatgcttccctttgcctgggtcatcccccagtggtgcagtcacagctcactgcagcctcaagctctcaagctcctggtctcaagcaatcctcccacctcagcctcccaagtagctagaactacatgtgtacaccactggcctggctaattttttttttttttttttttttttttttgagacagtgtctgcctctgttgcccagggtggagtgcagttgcgcaatttcggctcactgcaacctccgcctcccgggttcaagcgattctcctgccacagcctcccaagtagctgggattacaggtgcacgccaccacgcccggttaattttttgtatttttagtagggacggggtttcaccatgttggccaggctggtctccaatttctgacctcaagtgatgcgcctgccttggcctcccaaagtgctgggcttacaggcgtgagccacaacgtccggccaggctaattttttaatatttttgtagagacgggatctcactgtattgcccaggctggtctcaaactcctatcctcaagcagtcctccttcctcagcctcccagagtgctgggattgcaggcatgagaccccgcacagtctgtttctacagcggcctctctgcggcttcctctcttctggcctcatggagaaaccccagaaagagcatagactctggaattagagaaacagggtttggaattctgtgccattctctccctgtgtggtttggccaactgattcaaaggctgtttcctcatttgtaaaatggagatatatagtcagtggtccttgttattatctccctgctacctgcccccttcccaaacaccagccagtcttctctgctctggccaaattgataatagcttttgtttttcaagcctaaaaccagcttcttccaatttgctcagcagctatttgctaatcatccagagtgacctaggacgtatttacatgagcggaagagccactcggggagagtgctgctgggaatgcctccacagagatgctgattgtacgcatgctgcgtaagcctcagatttttctgttcaggcccaaatgcgcagcacaatctgtgggaaagttgcaacagagaaagcaaaaaaaaaacaaaaagcaaaaaacgagtttttacttccttaataaaattggttttggtgctcactttggcagcacatatactaaaattggaactagacagagattggcattgcccccgagcaagaatgacacgcaaattcgtgaagccttcaataaaaaataaaataattttgttttcccaatctgtgtctcttttaagccccacaggatagaaatgtcctaaaataagaaattaaataagaggggaagccccatgatctgttctggtttttttgggtggtggtggtggtggtgttttttaatgggtctctcaggattccaccagacccacttcccagccgctgtgtggtctgggcctgagaacaccaagccccccgacctgcggcccacgcccacccaccacccagcctcggcagtgctttcccaggattcacatggtaatgaaggcatccatcttctcccagacacacactgggccctgcgaccctcccagggcccacacaatggcccacagcgccgcggccccaccacctgttggattttcccagggaagggagtgagggggtggaggggaagggcagtccgtctcttcccagcccccagccccatttgcaccctggtcgcaagagtcagtcagcgagggcacccatgtcctcggactctcagtccatcctcagcaccctgtttcctcatcctcaaactgcaaggtggttgggaggattctaatgggaatggtagtaaggacacgctcaggaactgtggattgccagacaaagagagcaaaaggccgggcgcggtggctcacgcctgtaatcccagcaccttgggaggccaaggtgggcggatcatgaggtcaggagttcgagaccagccttgccaaaatggtgaaactcccatctctactaaaaatacaaaaattagccaggcgtggtggcgcgcgcctgtaatcccagctactcaggatctgaggcaggagaatcgcttgaacccgggaggcagagcttgcagtgagccgagatcaccccattacactctagcctgggcaacagagcgagactccatctcaaaaaaaaaaaaaaagccatcaataataatgaacttgataatgactaattaataataaacaggctcatgcctgtaattctgacactttgagaggccaaagttcaagcgggaggattgcttgaacccaggagttcgagactagcctaggcaacatagcgagatcccctctctacacaaagtacaaaataataataataaacaataataaggccggacaaggtggctcacacgtataatcccagaactttgggggtggaagcaggtggatttcttgaggccagtaacttgagaccagcctgggcaacacctgtctctaaaaaaatacaaaaattgggctgggcatggtggcttccgtctgtaatcccagcactttgggaggctgaggcaggcagatcatgaggtcaagagatggagaccatcctggccaacatggtgaaacccaatctgtactaaaaatagaaaaattagctgggtgtggtggcatgcacctgtagtcccagctacttgggaggctgaggcaggagaatcccttgaaccaggaagcggaggttgcagtgagccaagatcgcgccactgcactccagcctggcaacagaacgagactccgtctcaaaaaaaaaaaaaaaattggccaggctgcagggctcatgcctgtaatcccagcactttgggaggccacagcaggtagatcacctgaggtcaggagttcaagaccagcctggcgaacatggtgaaaccccatctctactaaaagtacaaaaattaactgggcgtgttggagggtgcttttaattccagctactcaggaggctgaggcaggagaatcgcttgaatctgggaggcagaggttacagtgaaccaagattgcaccactgcgctccagcctggataacagggtgagaccctgtctcaaaaaaaaaaaaatatatatatatatatatatatatatatatatatatatatatatacaaaaattagttagggcccggcgcagtggctcaaggcctataatcccagcatgttgggaggccgaggcgggcagatcacgaggtcaagagatcgagaccatcctggccaacatggtgaaaccctgtctctactaaaaatacaaaaattagccgggagtggtggtgcgtgcctatattcccatctactcaggaggctgaggcaggaggagacttgcttgaaccccagaggcagaggttgcagtgagcctagatcacaccaatgcactccagcctagcaacagagtgagactccgtctcaaaaaaaaaaaaaattagctgggattttagatgtgtaccaccatatccgactaatttttatatttttagtagcgacggggttttgccaagtaagccaggctggtctcgaactcttaacctaagtgatctgcccacctcggcctcccaaagtgctgggattacaggtgtgagccaccacacacatctgagttgtacaatttaaatgggtgaattgtatggtatgtaaatcatctctcaataaacctgttaaagaaaaaaaagggggctgggcgcggtggctcacacctgtgatcccagcactttgggaggccaaggcgggtggatcacgaggtcaggaaatcaagaccatcctggctaacatggtgaaaccccgtctctactaaaaatacaaaaaattagccaggcgtggtggcatgtgcctgtaatcccagctactcaggaggctgaggcagaagaatcgcttgaacccgggaggtggaggttgcagtgtgccaagattgtgccactgtactccagcccgggcgacagtgcgagactgcatttcaaaaaaaaaaaggtaaattctagaaatgctcctgtttctgagcatccagtacaatgataaggcaatcactacctccaaggtccccacttcccatatccctcccccactgcactcccatcccacttccaggtggctatgactgagcaactattagacctaattaatcatgggtccaggtgagttttgcccacttgttgttcacagatgtctccaaactacacaatctcagagtgggtaaaaaccccagggccatagggctttttttaatcttttctggatccagacctctcccctttatattttaatttcatttcatttttgaacatgtattacctaatacatgttcctgatacaacgctgaaaaacaacggatgtctcccttcttccctattggaggcagccacagtcatcagtttcctagtgagatacaagcaaatacatatgtaattttgtttgtttgtttgtttttttaagaaactgggtctaggctggcctagaactcctgggctcaagtgatccttggcctcagcctccaaagtagctggagctacaggagcatgccaccatgctccacttcagacacaagtggtgtttccatacagggtcagttaaaaacaacaaaaaacactgatggtgatgagacatgaatactaataggtggtcacatgagaatagaaaattgcaggctaggtgtggtggctcacacatgtaattccaacgctttgggaggccaaggaaggaggacctcttgaggccagaagtccaagaccagcctgggcaacatagtgaaactccgtttctacaaaaaaatacaaatattggccaggcgtggtggctcacacctgtaatcctagcactttgggagactgaggtgggtggatcacttgaggtcaggagttcgagaccagcctggccaacacggtgaaaccccatctctactaaaaatacaaaattagccagacgtcgtgaggcacacctgtaatcccagctacttgggaggctgaagcaagagaatcggttgaacccaggaggcagaggttgcagtgagcttagattgtgctactgcactccagcctgggcaaagagcaagacaacatctcaaaaaaacaaaacaaaacaaaaaaaaacaaaaaactagccaggtgtgatagtgcaagcctatagtcccagttcctcaagaagctgaggcgggaggataaattgagcctgggaaatcggaagccttgactcccatttctggatgggagaggtagctaaattttttttttttttttttttttttgtgacggagtctggctctgttgcccaggctggagtgcagtggtgtgatttcagctcactgctacctctgcctcctgggttcaagcgattctcctgcctcaggccctgagtagcttggattacaggcgcctgccaccacacccggctaatttttgtatttagtagagacagggtttcaccatgttggccaggctggtcttgaactcccaacctcaggtgatcctcccgcctgggcctcccaaagtgctgggattacaggagtgagccaccccgcctggcgcctaatttttatcaccagatgagatcacagatattgcacttactgtgttgtcccccacagaataaaaaccgcacaagactgagacttctgttgattctgttcactatatacaagcgtaaaaccaaaaataaaatgctaggggcccccaaccatctgaacggacccctcctctctgccaagagcattccaaaatgaatttgaaaaatgagtttaggccatgatggaagcgggtgagggggaagcgtcgaacttgtctcattacaccctccttccttttggaattcaggaaaagctgactagcattaacatcaacacagacgttaagtctgataagaaacatttacagtctattcttacttaaacctgccacctggaggtttcatctgcataataaaaccttggtcgccacaaccacttattgtaacccagacattcccttctacaaccctgggcacactcctgaggctgtgtcatgggtacatccttaacctcggcaaaacaaaagttctttttttttttttgagacggagtcttgctctgtcgcccaggctggagtgcagtggtgcaatctcggctcactgcaacctccgcctcctgggttcaaatgattctcctgccccagattcccaagttgctgggatgacaggcgcgaaccaccatgcccagctaatgtttgtatttttagtagagatggggtttcaccatgttggccaggctggtctcaaactcctgacgccaggtgatccatccgcctcgatctcccaaagtgctgggattacaggcgtgaaccaccaagcccagccgtttttgtttgtttgtttgttttattttttcaatgtagagacagggtctccttgtgttgcccaggctggtctcaaactcctaggcccaagcaatccatctgctttggcctcctaaagtgctactattacaggtgtgagccactgtgctaggccaaaataaactttctaaattgattaagacctgtttcagatgcttttgggttcacaccagtcataatagattagtacaacaacaatattctgctcactgtaatatgccagcgctggcccacagcctggcaagcaagagatgctccacagcttccagaatcctggactccagccccagccctgcctggtactcgctgccaccgtggacaagttacttatcactcaggagctccctgttcatagtccctcacctgaaagggatttttttttgagacggagtctcaccctgtcgcccaggctggagtgcaatggcgagatctcggctcactgcaacctcagcctccgggttcaaacgattcttctgcctcagcctccagagtagctgggattacaggtgcccgccaccacgcccagcttttttttttttttttttttttgtgagacggagactcgctctgtcgcccaggctggagtacaatggcgtgatgtcttctcactgcaagctccgcctcccgggttcacgccattctcctgcctcagcttcccgggtagctgggactacaggcgcccgccaccaccacgcccggctaattttttgtatttttatagagacggtgtttcaccgtgttagccaggatggtctcgatctcctgacctcgtgatccggccgcatcggcctccgaaagtgctgggattacaggcgtcagtcaccgcgcccggcctacgcccagctattttttatatttttagtagtgacggggttttaccgtgttggccaggctggtgtcgaactcctgagctcgtgatccgcccgccttggccttccaaaatgctgggattacaggcgtgagccaccgcacccggcggattgattttttttttttttttaactttttcattctgtctcggctgcttaaatcagaatagagacgaccttcagcacagagtggctgtaagaattaaataagataatgctttaaagcgctggtaagagctttataagtatcagcgaacactgctgccactatgctcatggtggtgtggcagacagcggggtgcagaagaagaggggtggggggaaggcggtcacatagggcaggggggttcagaccagattcctgagatgtcatttttagtactctccagcaagaaggtgggacggctggtgtggtggaggaggctagaggtacaagcttcacctgagatgtccttagaccctgacctcagctcccaccgtcctagtggtgccgggcggcggccacgccagccgcaccttcccccggccagcccagagctgccgctggggaagggcggagggaaggcaagctggtttttcccaggctccccccgctcctggaacatctggccgcgaacatctgcccttcgcttttgtggcgcggccgcaggccggcctcgcacccatctgccgcctcaccggcccccgccccatctgcgcgccgctcccctggggcggttcctggcgccctcgcccccgcccgccgggcctggttcccacgggccgagtgcgggaagccggggcggcccatctgccgcgagcggctgccaggcgcggcgagtccagcgccgaggcgtccccaaagggcgggaccggcgcccagcaatgtctttcaggcgggtgcgcccccgaacaaagtcggggtgcacggcctctccccgcgcggctggacccaaagtcgctgcccggggctgctgggtccaagagcggccgccgcccctcctgcttctccccagaagggcccgcgtgcccccgctgtccgccgcccaacacccgctcttcctcctgcaccgaacacttcgggctcactgacgcgccgtctccatcctaagccccaaaccttcaaagtgcaggagacaactgtcacgtcaccctgcaaaaaatgctaacgtctgataatataaaatgctggtgtggacgtgggaaaatagaaactcccaactgcgttggcccctcagcctggaataccccttgtcctcattgcctgcttaactcttgattttgtgaaatataaaaagtaccgagaaatatagcgatttatgttcctaataccacattcccaccacccaggactgacaactgtcagctgtatttgcgcctatttctcctcctccaaagaacaaacctttacagatagtgctcctgtctttttgtgttttttgttttgttttgctttgttttgttttgttttgttttgttttgagacagagtctcgctctgtccccaggctagagtgcaatggcgcaatctcggctcactgcaacctctgcctcccgggttcaggcgattcccctgccccgtagtcctccccagtagctgggactacaagcgcatgccaccacacccagctaatttttgtatttttagtagagacggagtttcaccatgttgtccaggatggtttcaatctcttgacctcatgatccgcccgcctcagcctcccataaagctgggattacaggcatgagccatcgcccccggcctttttgtgttttttgtttgtttgagacagagcctcactctgtcacccaggctggagtggtgcagtggtgtgatcacagctcactgcagccttgaactccagggctcaagggatctgcccactgcagcctccacagtagctgggactagaggtgcccatcaccaggagcagctaatttttgttttgaagagacaggtctcactatattgcccaggctggtctggaagtcctgggctcaagtgatcctcctgccttggcctcccaaagtgctgggattacaggcatgagccagcaaaccgagccactagccttcttttaaccagggccctcttcccttttctctaagactatttgccaccccacccaccatgcaatcccccaattactattaatataatgacttgggtgttttcttccgggttatgtttcttgttacttttactacatgtaaatatattagcattgtgtgtttttttaaatttatacttctaaaaaaatcattctgcattttccctaagcaacattatgcaggtatctagcagaatacacacagacgtagctcattcctgttcaatgctgggtacgattccatcaccatttccctgttttcttgtcattggacaagtaagtagttttcaatttttgggttttttttttttttaattaaaatagacatggagtctcgctatgttgacctggctggtcttgaactcctggccttaactgatcctcccatctcggcctcccaaaatgctggggttacaggcatgagccacttgcaaccggcctagttttcaatttgttgttgttgtagaaatggctgtcacattcttgcccacatctgctttcttgtgtgcaggcctcccagggtatgtccgtgggagtgaatcactggctcatagggtgttttcaaatgttcacttttggtggatattgccaaattgagttcccaagtggtcataccagtttacacacccaccagcactggatgagtgttattttcccacatgctcaccaacattttttttttctttgagatggagtctcgctctgtcgcccaggctggagtgcagtggtgcgatctcggctcactgcaagctccgcctcctgggttcacgccattctcctgcctcagcctcccgagtagctgggaccacaggcgcccgccgccacacccagctaatttttttgtatttttaatagagagagggtttcaccgtgttagccaggatggtctcaatctcctgacctcatgatctgcccgcctcggcctcccaaagtgctaggattacaggcgtgagccactatgcccggcttcaccaacattttctatattatcagactttaaacttttgttttattaatttttttctttttgaagacaggcctttattttaattttattttttgagacagcatgtcactttgtcacccaggctgaagtgcagtggcagcatctttgctcactgcagcctcaacctcccaggctcaagtgatcctcctgcctcagcctccctggtagctgggactacagacatgccatcatgcctgtctaattatttccttaaactattttcttttttttttttgagacggagtttcgctcttgtcacccaagctggagtgcaatggcgcgatctcggctcaccgcaaactccgcttcccgggttcaagcgattctcctgcctcagcctcccgggtagctgggattacaggtgcctgccactatgcccgtctaatttttgtatttttagtagagactgggtttcaccatgtaggccaggctggtcttgaactcctgacctcaggtgatccacctgccttggcctcccaaagtgctgggattacaggtatgagccaccacgcccagccctttaaaatattttctggagatgagatctcactgtattacccagtctggtctcaaaatcctgcgttcaagtcatccttccaccttggcctcccaaagtgctggaattattggtgtgagccacgtgccaagccagactttaatgttttttgcagggtgacacagcagttgcctcctgctgacatcccagatatgcaaatgctggggctcaggagcatcggcctaacccttcctcactttgtctgtctcagctggactatcacctcctccttcaggaaggcctccccagtctaccttagctgactggcagcttcccataacctcgcgtgctttcccatcacagcactgggaacttgaggggtgactgtctcattatggtctgtcttccccagcggactgtgagctccccaggaagaggtcacatttgcagggccattgaacaggctgaaaggaacacaaagttgctacaaatagtacttttgtggaaggctccatctacttgaagtaaggagttcctttctctaattcctacaaagtacgcccttgggatggcagtagctcacctacccaccacacctctgtgtcctcagcatctggatacagcagcaaggaagcaccacatggctggtggtgtttattcccatttgggtaccctcaactaaatgtagctctgaagagcatgagcctaggtcatgttctttccatgctttgcctagcacaaagcaagtgtacaataaccatttattatttaatgattctaaagctctgtatttcagtggtggaggatatacccaattagaggtattatagtcactgtaataataactagtgcctactgaatgctgactgccaggaacctgtgtggtttttttcttttcttttccttcttttttttttttgaaacagaatctcacccacgctggagtgcagtggcgcaatctcagttcactgcaacctccacctcctgggttcaagcaattctcctgcctcagtctcctgagtagctgggattacaagcactctccaccacacctggctaatttttgtatttttagcagagacggtttcaccatgttggccaggctggtctcaaactccagacctcaggtgatctgccctcctcggcctcccaaagtgttgggattacaggcgtgagctactgccccggccccagctttaacaaaatttttttttgtagagatagggtcttgctgtgttgcccaggctggtcttgaactcctggcctcaagtgatcctcctgccttggcttcccaaagtgctgggattacaggtgtgagccacctcacccagcccctcttttttttttttttaatacggtctccctctgttgcccaggcaggagtgcaatggcaagatcggggttcactgcggcgtcaactcctggacttaaggaatcttcccatctcaacctccccagtagctagcactacaggcatgtgccaccaggcccagctgatatttttttttaattttttttttttttttctgagacagagtctcactctgtcgcctaggctggagtgcagtggcgcgatcttgcctcactgcaagctccacctcctgggttcacgccattctcctgcctcagcctcctgagtagctgggactacaggcgcccgccaccacacctggctaattttttgtatttttagtagagagagggtttcaccgtgttagccaggatggtctcgatctcctgacctcgtgatccacccgtcacggcctcccaaagtgctgggattacagacgtgagccaccgcgccgggccttaatttttaatttttattattaatttatttatggagaggtcttgctatgttgcccacgctggtcttgaattcccggcctcaagtcatcctcccacctcagcctcttcaagtgttggtattacaggcattagccaccgcgcccagacttaaatcacataaactctttttttttgagaccaagtcttgctctgtcgcccaggctggagtgccgtggcacgatctcggtttactgtaacctccaccttcctggttcaagcgattattttgcctcagcctcctgagtagctgggactacaggcgcgaaccaccacgcctagctaatttttttttttttttttgagatggagtcttgctctgtcgcccaggctggagtgcagtggtgcaatcttggctcactgcaagctccgcctcctgggttcacgccattctcctgtctcagcctcctgagtagctgggactacaggcgcccgccaccacgcctgtctaattttttatatgtttttagtagagacggggtttcaccatgctagccaggatggtcttgatctcctgacgtcgtgatccgcccgcctcggcctcccaaagtgctgggattacaggcatgagccactgcacccggcctttttttgtattttcagtagagacagagtttcaccatgttggccaggctggtcttgaactcctgaactcaaagcctgccttggcctcccaaaatgctgggatcacaggcatgagtcaccgcacctggcctatagcttccttttaaacagcacatcgttgcttttgcatcagccagaaaaaaaaaatactttttagaagaaaacgtacattatcatgagtcatagtatttgaggagtacagctctgaagcggcctgaggtgagggtgcagctggaggcgccgccccctggtgactgggtactcagggttgggttgagccaggagggtggtggttgcctcaggctctgtgaggtgggcagggagctgggcagggagctgggcggggtcctgagacattcaacctcagctggttcctgggttccgggccctggagcagtgagggaagccagttatatgggaggcaggtgagtcaaaggagggtcaggctgggtgccagagaggagggccactgcttctgtgagggggcctctggggccttccgtccatcacccagtgggcatatggggacaccaccgaggcccagagacctcttgcccagtctccccactctcacctcagaggtccttgcagctaggggcagtggcctctgctgagctttgcccagggtgtagccagttggcctcagggcactcctgactggtggcatgagcctcccaggctgccagggtcaggtcagctcccacgcctccaccctgggcagggcccaggcctgcattcatgggtgcaagaggagagagaggcctgagccctggatgggtgtggttgtgtgtccttggggctgatgcaggattttttttttttttttgagacgatgtcttgctctgttgcccaggctgcagtgcagtggcacgatctcgtctcactgcaacctccatctcctgggttcaagcaattatcctgcctcagcctcccgagcagatggagttacaggcgtgcaccaccacgcctggctaattttcgtatttttagtagagagggagtttcaccatgtgggccaggctggtctcgaacttccgacctcatataatctgcctgccttggcctcccaaagtgccgggattacaggcgtgagccaccgcacctggcctttctgcaggattctgaattgtgtatgtgtggagagtaaggggactgtgtgctctagaagggctgtggtgggaggtctctggcctggtgcaggtgggtgttggttgggtctgtgcactgtgggagtgggtgcctgcaggaagccagtttatccttttgcaggcagtggacttctctaaggctgcgggcatgtgtgttggcatcttggagtcccaggtgttttggcgtgagtaatactgtatagatgtaagtgtgtgtagtgtttgcaatgttgtagtgtgggtgcatgtgtctgtgtgtcctgtttgttgagaggattcattgcatgtggttctgttaggagtgataatggggtgttttgagacatttcctccttggtctctattttttggtgtgttggttatgcagatttggtgtttcggtagtgtgcgcggaggtcagtgtgttggttgtatattatggtgtactgttgtgcgttgtgcatttggcaggttgtgtctattggtgtgtggctgttgggtttgtctgttgtgtcagtcgtacatataaatgccacgttgggcgtgtgggtgtgtgcatttgtatattgctctgtgggtgtgcgaagcagtgtgtttgtgtaaccctgcaggtttggcctatgctgagtaacctaagatgggagctccctgagccttggctctgcccttgcctttggctgctggagaccctgggcagcaatggccctttgtccagccacaggaaaaccccacccccctccatcggcaggggacttgggaggggcccagactggtaggctccagcctcccgtccattgttctggggcctctctggaaaacaggatgggaggtgaaaggtggacacaggcctggacccccacactccctgaaacaacccaggggcacagcacagaatccttaggagggagggcctggggacagtccccattttgtggatgagaaaactgaggggtttcattcctattaaaagggagagagcctgaagccccacaccctttatgtgcccacccacagcctcctgccgggtttgggggatggaaaaatgacaccccagaatggaaacaaaacggtctattgtggtttccatttctgaatgcttaccatgtgctaagtgcagaagtgtcataactctgcaggttaagttcatattttgtacccattttgcacaggagtacactgaaccataaggcaacaatttattcttcaaaggacactactctaaacattactgtatttcaagtagtacgctgtgtgaccttgagcaagttgcttaccttctctgggccaggccctagttcagctctgggacacagcagtgaccaaaggagccgtggttcctgctctcttagagcccatagcctgggcagggaggaggaggcaaggaatggcaaatacacaagaaaacaaagatcatttctgatggtaatgaattcagtgaataagagcaggagaatgtaaaagaaagtagcctagggggatctgagaaggcctctggggaggcgacatttgacctgagacttgaagaatgaggagtctggcaaagacctggggctgatcagtgttctaggaacaagtaacagcaagggcaagggccctgaggcaggacagagctattaatagtttaaggagggaggcctctgggctggtgagagaaagggaaggggcccagttgggtagtgggcaggggaggagtttggatcttattctccgtgagatgtgctggttctggtggtagtgggggggcctgtagtctcctgttacaagggttgggggtgtggggacagccagagccaaaggtctctcccccacagctccggcagtcccagcccagaggcgccggcctggcggctggaagattgcactgtgggcacatctggggagcagctgccgagccagggccagagtgggtcacgtggcacagggcaggaccgtcctggagcctacaaggccaagactcctaggaggggcagtggagaacactctggacgagaacagtgcgtcaacgaggaggaactgtgcactgtagacgtccaggcacacggccccctgcagccccacacagcccctgcctcaggacagagtgcctgggttcaatgccacctcccagctttgtgatctgaaacaagtcactcaacctctctgggtctcatggcctcagctgtgaaggggacatgatattactaccacagttccacaggctgttctttttttttttttttttttttttttttttttaattttttgagacgcagtctcactctgttgcccaggctggaatgcagtggcaccatctcagctcactgcaacctctgcctcccgggttcgagcgattctcctgcctcagcctccctagtagctgtagtagctgggactacaggctcccgccaccaggcctggctaattttttcatatttttagtggagatggggtttcaccatgttggccaggctggtctcaaactcttgacctcaggtgaaccacccacctcagcctcccaaagtgctcccaggctgtttatttctaattcaacaaatattcgttgagcacttcccacatgccaggtgctgcatgaggctctgcgtgacagcagggaacaggacctccgtggtcccttcccttctaagcacacaattaatgctttagaaccaggcctggcattgaggaaactcttagtaaatgtaagccatttgcctggagctctggaggccagaggaggcaccctggaaggcagagaaggaggtgtggtgacagaaaaatcctaaggaaagtgcactcccttttatcaccaggtgctgcagttggctcctggtatggctcatttcactctcacaaccaccctacgaagagggatgagcattagctccaatttatggatgaggaaactgaggcccagtttgtcaatggcacagccaggactggaggcagtgaagggctggtccctttttctctctggggctcaatattcccatctgtgaaatggggcattacaataatacagctgcaccagctccagggagcagttgtgaaatcagatgtgccaggtatgtgaaaagggcttcctgagagactatgaccatgaatgctgggttgggaatatgggggttcatttaaggagccctccgaacttcctggccaccagaagtgtcggttttcctaaggtgactcaggaaaggaggactgggaagaaaatgcacactcaattcacactaccaacaaggccagaaaaatgcccatctgacaacaagataagcaggcaatctttatttaaactccttgtcaggccttaaacatgtaaaagataaggccaggtgtggtggctcatgcctgtaaatcccagcagtttgggaggccaaagaagaaggatcacttgagtccaggagttctaaaccagcctggggcaacatagtaagaccccttctctacaaaaaaataaaaaattagccaggtgtggtggtacatgccagtagtcccagatacttgggaggctaaataggaggatcgcttgaccccaggaggtcgaggctgtggtgagccgtgattgcaccactgtactcagcctggtggacagagaaagagcctgtctccaagaagaaaaaattgcatagaactgaaaacacacacaaaaattagtgcatataaattgggtgaaaactgaatttcatgccatgcgcggtagttcatgcctgtaatcccagcaccttgggaggccaaggcgggcagatcatctgcagtcaagagttcaagaccagcctggccaacatggcaaaaccccatttctactaaaaatacaaaaaattaaccaggcgtggtggcgtgtgcctgtaatcctagctactcgacaggcaggacaattgctcgaatctgggaggcggaggtggcagtgagccgagatcgcaccactgcactccagcctgggcgacagagcactctgtctccaaaaaaaaaaaaaaaaaggccacgcgtagtagctcacgcctgtaatccggcactttgggaggccgaggcggatggatcatctaaggtcaggagttcaagacccgcctgaccaacatggtaaaaccctgtctctactaaatacaaaaaattagccaggcgtggtggcgcgtgccagtaatcccagctacttgggaggctgaggcaggagaatcgcttgaacccgggaggcaaaggttgcagtgagccaagattaatgccattgcactccagcctgggcaacaagagcgaaactccatctccaaaaaacaaaaaagaaaactgaatttcacctgaattctggttgtgatattgtactgtagttatacaacataccaactgttggagtgttagagaggatgtggaagaactggacctctcaaatactgttgataggaatataaaatgatacaaccacctttggaaaacagtttggctgggtttttttgttttgtttggaggcagggttttactctgttgcccagggtggagtgtagtggcacgatgatcttggctcattgtagcctcaacctcccaggctgaagcaatcctcctgcctcaacctcccaggctgaagcaatcctcctgcctcaacctcccaagtagctgggactacatgtgtgcaccaccacatctggctaatttttgtactttttgtaagagatggggtttcaccatcttgcccatgctggtcttgaatacctgagctcaggcattctgcctacctcggccacacaaagtgctgggattacaggcatgcactgtgcccagtgagtttggcagttcttttgtaaagttaaacaaatacggccagttgtggtggctcacgcctgtaatgccagtactttgggaggccgaggtgggcagatcacttgaggtcaggagttcaagatcagcctggccaacatggtgaaactccatctctattgaaaatacaaaacttagccagtcgtgatggtgggcgcctgtaatcccagctactccagaggctgaggtgggagaatcgcttgaacccaggaggcggaggttacagtgagccaagattgtgccactgcactccaggctggacgacagagcaagactgagtatacattcacataaacacctgtatacaagagttcatggccaggcacagtggctcacccctgtaatcccagcaccttgggaggctgaggcaggcggatcacgaggtcaggagatcgagatcgagaccatcctggctaacacggtgaaaccccatctctactaaaaatacaaaaaaaaaaaaaaaattagccgtgcgcggtggcaggcgcttgtagtcccagctactcgggaggctgaggcaggagaatggcgtgaacccaggaggcggagcttgcagtgagccgcaatctcgccactgcactccagcctggacgacagagcgagactctgtctcaaaaaaaaaaaaaagttcatagcagttttattttactaaccaaaaactacgaacaatccaaatgcccctcaccaaatgtctggataaacaaatggtggtatatccatataatggaacactacttagcaataagaaggaatgaccgccggcccggtggctcacgcctgtaatcctagcactttgggaggcagaggcgggtggatcaccacctgaggtcaggagttggagaccaccagcctggccaatgtggcaaaaccccatctctacgaaaaatacaaaaattagccaggtgtggtggcaggcccctataatcccagctactcaggaggctgatgcaggagaatcgcttgaacctggaaggcagaggttgcagtgagccaagatcgcaccactgtactccagcctgggaacagagcgagactccgtctcaaaaaataaaaagaaaaaaggccgggcacagtggctcactcctgtaatctcagcactttgggaggccgaggcaggtggatcacaaggtcaggagttcaagaccagcctggccaagatggtgaaaccctgtctctactaaaaaaaaaaatacaaaaattagctgagcatggtggcgggcacctgtaatcccagctactcgggaggctgaggcagagaattgcttgaacctgggaggcggaggttgcagtgagctgagatcatgccactgcactccagcctgggcgacttgagtgaggctctgtctcaaaaaacaaaaaagaaaaagaaagaaggccaggtgcagtggctcatgcctgtaataccagcactttgggaggccgaggtgggcagatcacgaggtcaggagatcgagaccatcctagctaacacggtgaaaccctgtctctactaaaaatacaaaaaattagccgggcgtggtggcgcgtgcctgtagtcccagctactcgggaggctgaggcaggagaatggcgtgaacccaggaggcagagcttgcagtgagctgagatcgtaccactgcactccagcctgggcgacagagcgagactgcatctcaaaaaaaaaaaaaagaagaaaagaaaaacattagccaggcgtggtggcgggcacctgtagtcccagctactcaggaggctgaggcaggagaatgtcatgaacccgggaggcggaggttgcagtgagccgagaccgtgccattgcactccagccttggggacagagcgagactgtgtctcaaaaaacaaaaaacaaaaacaaaaaaagaccgggcgcggtgactcacgcctgcaagtgtagcatttttgggaagtggaaaagggcggataacctgaggtcaggagttcgagaccagcctggctaatgtggcgaaatcccatctctactaaaaatacaaaaattagccaggtgtggtggtgggcacctgtaatcccagctactcgcgaggctgaggcaggagaattgcttgaatctgggaggtagaggttgcagtgagcggagatcgtgccattgcactctagcctgggtgacagagcgagattccgtctcaaaaaaaaaaaaaagtggatagaaggatatgcataggttttatacaaatactatgtcattttatttattttatgtatttatattttgagacagggtcttgctttgtcacccaggctggaatgccgtggtggcatcttggctcactgcaatctccacttcttgggttcatgaaattctcttgccttagcctcccaagtagctgggattacaggtgtgcaccaccacgccctgctaatttttctatttttagtagagatgaggtttcaccatgttggccagattgatctcgaactcctgacctcaggttatccacctggcttggccttacaaactgctgggattacaggcgtgagccactgcgcctggccctgaattaatttctacagcataattttctctcttatttttatttttttgaatcagaatctcactctgtcgcccaggctggagtgcagtggcttggtctcggctctctgcaacctccacctcctgggttcaaatgattctcctgcctcagcctcccaggtacttgggactacaggcgcccaccaccacacctggctaatttttgtatttttagtagagactgggttttgctatgttggccaagctggtttctctggaattcattgcagtaaacagaattgctggatcaattaattcacagttgaaggccaggcactgtggctcacgcctgtaatcccagtactttgggagtctgaggtggagagatcacaaggtcaggagtttgagaccagcctggccaacatagtgaaaccccgtctctactaaaaagacaaaaaatttagcctggtgtggtggcgggcacctgtaatcccagctacttgggaggctgaggcagaagaatcgcttgaacccaggaggcggaggttgcagtgaaccaagactgtgctattgcactccagcctgggtgacagtctgagactctatctcaaaaaaaaataaataaatagttggtgatggccaggcacggtggctcatgcctgtaatcccagcactttgggaggccaaggcgggcggatcacctgaggtcaggagtttgagaccaccctaggcaacatggcaaaaccccgtctccactaaaaatacaaaaattagatgggcgtggtggtgggtgcctgtaatcccagcctgaggcaggagaatgacttgaactcaggaggtggtggttgcagtgagctgagatcgcgccactgcactccagtctgggcaacagagcgagactctgcctcaaaaataaacaaaaataaacacttggtgatgaattaatactctaatttcctctggttgactgttgttcttccaattatttggcaattcttttgagcagcaaactattccctcccatcattaatttaggattgctaaacaaggcgtagggagtttagagagttttggtgtgtgtggtaaggggatgaggagtctggctaattaattgatgatgtctctctcttttgaagctggtctcactgattggtttggttttcctggtttcctgatgtggaggcagaaggctcctttacttttccctcatcccccgaacttctgtgggaaaacggaacctgctgataactcagtgaattaattgctgcggggtagtgcggtggagcggagcagggagggaccataatatcaccctccactggtgagcacagatttttacccctgctaatgttgtgtggctttgggtgactaatctgagcttcggtttccccacctgtggcatgtccaggactctgcagtcagactgcctgctctcagcaggaagcggttgcattacaacactgtaccctccttataataacacaactatggttatgacttaggcgtcgtgtggagcctcagtttcctttgtataaagaaaccaaagagctcctttctttagagttgtgaaaaagactacagaagttgatcaagccgggtgacagagtaagaccctgtatcattattattttattttgaaacagagtcccactctgtcgcccaggctggagtgcagtggcataatctcggctcactacaacctccgcctcctgggttccagcgagtctcctgcctcagcctcctgagtagctggggtattacaggtgcgcgccaccacacctggctaatttttcatttttagtagagacgggatttcaccatgttggtcaggctggtctcgaactcctgacctcgtgatctgcccaccacggcctcccaaagtgctgggattacaggcgtgagccactgcgcccggccccctgtatccttttttttttttttttttttgagacgagtctcactctgtcgccaggcttgagtgcagtggtgcgatctcggctcactgcaacctccgcctcccaggttcaagcaattctcctgtctcagcctcccgagtagctgggattacaggcgaacgctaccatgcccggctaatttttgtatttttagtagagatggggtttcaccatattggtcaggctggtctcgaactcctgacctcaggcaatccacccgcctcggccttccaaattgttgggattacaggcgtgagccaccgcgcagcccttcattttttaaaataagaaataaatgaaaaaagatgatcaagacaaactcttcatacagtgcccgctgtacaaagtaagaaattaataatggtcacgtttgtgattattatttaaacaccaagcagatattaaatattagggctcagagagggcatgcgacccgcctgaattcactcagctgcagagctggaaagagaactcaggcctttttccccacgctggaaggggtagctggggcggagaggtggggggagcggtgaagaaaccccaagcggcccaagctgtgggtctgggttgggagactcgcaggtgtggggcggggaggtaaggtgacccttgctcagcgaccgcgcccgcaagaaacgcattcccaggcctcccgcccggggtctgcaggtgacgggctggggggagcacgggaactagctagaccagtttgtcgtctccatggcgaccgcccgcgcggcgccagcctgacagtccgtccgggttttatgaatgggtgacgtcacaggcctggcgtctaacggtctgagccgctggttcagacgctgacacagaccggcccgggaagggaggggggagactgtagctccgcagctgccgcgccgtgggagggagaccctgctctgaggtctttgagaagaaaatttaaaaagcagccaaaaatgggaaaaaacattaaaaaatcacgaactgttgcaggttcaggaaatttttgcaaggagctgcaaattcaaggtggaatcgaatgcagcctcactccactgcgctctatctagttcacttcccagccacccagccccaaacttactagactttcccgaattaattgctcccacccgggagggatctgggtaggccctccgggtctcaggaacacgaacagcaacattatttaggaattgagaaagcccaggggagcagatgtaaaggagcgcccgctttaaatttcggtcctgatatttgtagatcagggtccgagaagcatcttccaagagggtccggaaacccaggctctctgggctatccagagccagccgcttctccgttcgggcctcaatttctctcatctgtgaaatggagctggagaagtgagaaagtgaatatgggaaaaactgattcctgaggtcttttcattataaggcaatgcctgcttagcttccttgcctccttccagaggagcccagtgcggccctcgcctctacccgctgccctgcccggtgccctgccaccgacccacccttgctgttctgaaacccgggtcgtctttccacactgcgagcaggcactagacgagcaggaggctggacctaggagcgcgggtcacgcccccatgccgcccattggctgcttttgaacgttctgagcccgcccctccgggggccgtggcgtgtttataaaagacaagctgtggctccgcactctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatc

SEQ ID NO: 104 - DNA, 945 bp, Homo sapiens
gcgcgaagagccgttagtaatgccggtgtggtggcggcggcggagactgcgggcccgtagctgggctctgcgaggtgcaagaaagccttgaggtgaaggtgtatgaaagtcatcataacagatgttttccaaaaacttgtagaaggttgtgaaaaaactactaggatcacgcggcatgtatgagcatataggttgctgtagatgaatgttcttagctgtcatgtttaaaaatacttctgcttcgttacctcaagtgtggcatgcagcatttggaaggaaaattgaagacgtgttcaagaaaacatgaacagaagcaaatgatgaaaatgagcattttacttgatgttgataacatcacaataaattatggagaaaaatacaaaaaaaaaagaaaaaaaaaagaaaaaaaaagagggaggaagaaaaaaaacaaaaaaaagagggggggggagccaacagccaccccggtggggccaagcgagtggcaacacgaccaccagaccgacatcacgaccgacggtagcacccaaaggagaggactaaacagcctcaccatgcatagcccagtacaaactagaacgcccgagaggggcacacaatagccgtacgggatgacaattgaaggaaacacagcgaccgaaggaataacaaccggcgaacaaaccacaaacaatgaccccaaggcacacacacacgcaacggtggcgccggggaccacgagctccaacgcgagcggacgtaaagaaggctacagggaaagtcgaaaaacaaccggccgaggacgaagaggagacgcggaggccaaccggcgcagccccacagcccccgacccgcacagggagacccggaccaccagacggaaagagccgacaacccaccagaacaggacgacgcacgaacacacacgacaccgacatcacacacaacagcgaacggaaaggcata

SEQ ID NO: 105 - DNA, 1320 bp, Homo sapiens
gcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagaggtattcacaatgcctccataatgaatgctgaagctgctgggggttacaggtatataagtttggagagacaggttctattggtttttggacagacacttggaggaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattaa

SEQ ID NO: 106 - DNA, 701 bp, Homo sapiens
  misc_feature 581: n = A,T,C or G
tttttggcccagaaacccgcattttattgacagtcattttcccacagagaatcttagaaagatgtcgcgttttcttttaatgaatgagagaagcccatttgtatccctgaatcattgagaaaagcaacagatacaactgacagtcacactttttaaaatcaaacagtcactaccttcagcccacacctccacacccgcatctgcctccccaatggctgtcagttcggtaaagtcaccctctccttctactctggtattaccacgagaattgaaatttttaagcagaaaaaaaaagaagtcaagttacaaataaatgagtggcgaaccaagggaagccctttgactatgatttccaattttctgttcaatccacactgcagagatacaaggataaaccaccattttggttcccaagttttattcaagaactcatacaaaattttccagataaatgaaatttaatcctcgtcttcctcctcttcttcgtcctggttaatctggaagtaacgtaattcgtaactctctttgctgttagcaactacgcgcaaccagtcacgtagattattcttcttcaaatattntttggtgagatatttcaaataccttttggagaaaggcacctcggatgtcacggtgatcttgctcttgctccttcgatgggtcacaccccttcagcaaggtcccagctttttcgttcactt

SEQ ID NO: 107 - DNA, 568 bp, Homo sapiens
  misc_feature 539, 551: n = A,T,C or G
ttttttttttcaccaccttatcaaatttattattccaatggcactagtacagctggaggtgctcatggtgacaccgcacaggacttcctgcctgctagaaatcatctacccgcgtgttcctttcccctttctggggcaaaagccactgcgggccatgtacccaaataaacctcttaatgcgtttgttaaaattagtttggacatctgagtttccctctgaagaaatggaaaaagtgttgtggttgagtgatggcacgcagcgggccccagaaacctctcaagggagcgtcgctgtgtcgggacagtctccaggtgtcgtctgagaattcgaggacgtggtgctgtagggtgctgcgagtccccggggcggcaggcgctgcaggaagggctgcctacaatttgtccaggaagttgtccagggcagggatgccttctttcaggcccttgcgctttggggtctccgccaccacctggctggggcggctgctgttgtcgaggggtctccgggcaggatctgccagtgtcaaacacacactggnggaacgcctggnccgccgtgtggaactca

SEQ ID NO: 108 - DNA, 582 bp, Homo sapiens
tttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaa

SEQ ID NO: 109 - DNA, 1226 bp, Homo sapiens
gtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaaggaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatgaaaaaaaaaaaaaaaaaaaaaaaaaaaaa

SEQ ID NO: 110 - DNA, 3163 bp, Homo sapiens
ctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaa

SEQ ID NO: 111 - DNA, 786 bp, Homo sapiens
tcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtcaaaaaaaaaaaaaaaaaaaaaaaaaaaaaaaaaaaaaaaaaaaaaaaaa

SEQ ID NO: 112 - DNA, 1279 bp, Homo sapiens
gaattcgggggttgctcttttgctcataagaggggcttcgctggcagtctgaacggcaagccggtaaaaatattgcttcggtgggtgacgcggtacagctgcccaaggggttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtgcgaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcgcgagtgatcactgtcctatcaccctatacctagcactgtgacaccacccctaaatcactttgagcctgggaaataagccccctcaactaccattccttctttaaacactcttcagagaaatctgcattctatttctcatgtataaaacgaggaatcctccaaccaggctcctgtgatagagttcttttaagcccaagattttttatttgagggttttttgttttttaaaaaacccgaattc

SEQ ID NO: 113 - DNA, 1970 bp, Homo sapiens
ccaggctgcacggtaggaccggggcgaggggagccaggcggtcagggcggaggccaagcccgggagatgcggttgcagccgccacggctgttggggcgcctggcgctccgtccgaggcgggtggctgtgaggccaggggagtaggcaggctcccagagagattcttccaagttggcgggtggcgggagagggggccgcgcgccccggcgcagctgctttgtgcgcgcagagagggactcgtgtccctggttctctccaaccctgggacccgttgtgcgggcagtattgggcaagccgcagaacggagcgatttcctccgagaaagttgaggatggagcctttttttccgcaccgtccccgcgatggcatgggccccgagaatgctgccccgaggctcccagtgtgggggagctcggggtcgctgcgcctctagcttgagcgcagaaatccgcgaatcactccgatcttcgcgaactctggcatcttctaggaaaatcattactgccaaaactgaggcgagcttttctggcgggcacggcaccctgcccccagggcgctggccctgggcgatgccccctttccgatctcaggcttggtcaagggcgccaggttccgaattcgcgcttgccgtgcacgccggcatcgagcctcaccaacaccgccgggcaacgtggctggagtagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcggcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaaaaa

SEQ ID NO: 114 - DNA, 2505 bp, Homo sapiens
ctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaagaaaagatgttgtcccggttaagagtagtttccaccacttgtactttggcatgtcgacatttgcacataaaagaaaaaggcaagccacttatgctgaacccaagaacaaacaagggaatggcatttactttacaagaacgacaaatgcttggtcttcaaggacttctacctcccaaaatagagacacaagatattcaagccttacgatttcatagaaacttgaagaaaatgactagccctttggaaaaatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagggattatttatttcgatctcagacagaggtcatgttagatcaattgtggataactggccagaaaatcatgttaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgcactcttaaaagacccattttacatgggcttgtaccagaaacgagatcgcacacaacagtatgatgacctgattgatgagtttatgaaagctattactgacagatatggccggaacacactcattcagttcgaagactttggaaatcataatgcattcaggttcttgagaaagtaccgagaaaaatattgtactttcaatgatgatattcaagggacagctgcagtagctctagcaggtcttcttgcagcacaaaaagttattagtaaaccaatctccgaacacaaaatcttattccttggagcaggagaggctgctcttggaattgcaaatcttatagttatgtctatggtagaaaatggcctgtcagaacaagaggcacaaaagaaaatctggatgtttgacaagtatggtttattagttaagggacggaaagcaaaaatagatagttatcaggaaccatttactcactcagccccagagagcatacctgatacttttgaagatgcagtgaatatactgaagccttcaactataattggagttgcaggtgctggccgtcttttcactcctgatgtaatcagagccatggcctctatcaatgaaaggcctgtaatatttgcattaagtaatcctacagcacaggcagagtgcacggctgaagaagcatatacacttacagagggcaggtgtttgtttgccagtggcagtccatttgggccagtgaaacttacagatgggcgagtctttacaccaggtcaaggaaacaatgtttatatttttccaggttacagaatacctatatgctaataaaatggctttccgatacccagaacctgaagacaaggccaaatatgttaaagaaagaacatggcggagtgaatatgattccctgctgccagatgtgtatgaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacaatcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaaaaaaaaaaaaaaa

SEQ ID NO: 115 - DNA, 1746 bp, Homo sapiens
aaaggcagggggtggggctgcttcatattgaggctcgagtcataaggggctctggagggtctgtgggcacagccccacacccttgtcctggggcctctttcctcttccctctaggctggtctcccttcgtcagtgcccaccacccttaacagtttgcatttctgttgtttcttccagtctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaaaaaaaaaaaaaaaaaaaaaaaaacacaacaacaaaacaaaaaaaaaaaa

SEQ ID NO: 116 - DNA, 2040 bp, Homo sapiens
acagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaaaaaaaa

SEQ ID NO: 117 - DNA, 822 bp, Homo sapiens
tccgccgtcggctccgcggcgccgccatggccgacgtggaagacggagaggaaacctgcgccctggcctctcactccgggagctcaggctccaagtcgggaggcgacaagatgttctccctcaagaagtggaacgcggtcgccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagtttatcttcagaaattctctgcgattaagaagataatttattaaaggtggtccttcctacctctgtggtgtgtgtcgcgcacacagcttagaagtgctataaaaaaaggaaagagctccaaaattgaatcacctttataatttacccatttctatacaacaggcagtggaagcagtttcagagaactttttgcatgcttatggttgatcagttaaaaaagaatgttacagtaacaaataaagtgcagtttaaaacccaaaaaaaaaaaaaaaaaaaaaaaaaaaaaa

SEQ ID NO: 118 - DNA, 834 bp, Homo sapiens
gtgatgtctcacagaaagttctccgctcccagacatgggtccctcggcttcctgcctcggaagcgcacgagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgtccgtgtagccttctctgtggcacgcgctgggcagaaaggctaccatcaccgc

SEQ ID NO: 119 - DNA, 2159 bp, Homo sapiens
gcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctacataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtattttttttttttttttgagacagtcttgctctgtcatcaggctggagtgcagtggcgcaatttcggctcactgcaacctccacctcctgggttcaagcaattctcctgcctcagcctcccgagtagctgggactacaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaataaaaaaaaaaaaaaaaaaaaaaaaaaa

SEQ ID NO: 120 - DNA, 1258 bp, Homo sapiens
gacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaggaaaaaaaaaaaaaaaaaaagctctgagagcatcttattttgtttaaaggcaagaaataaaatttccttttgtggaaaaaaaaaaaaaaaaaaaaaaaaaaaaa

SEQ ID NO: 121 - DNA, 624 bp, Homo sapiens
  misc_feature 485, 497, 530, 549, 564, 586, 614: n = A,T,C or G
gactataagccatgcaacaatgtcttttattatgtatgcggttttaaaattatttcttgaatctctccatacacaggcaaaaataagtgtgttacttaacatactggaaattgcctaacttaatcattgcctaaagaagagaaaattatccccaaaacgtgcttaaccaggaggccaatgcatttgccgacctccaagaacatggagatgaacgtgatagacagactgtccaccatctgaaccttcattcaccaccattcgataacccttattcaggcccagatcagcagcacatttcttgccaacaatcattaagtgtccaagaagactttcatcatcatcttctgccacagaaatctgggatatatgtttcttgggtatcaccagaaaatgtgttggtgcttgagggggaaatgtcatggaaagcaaggcaccggtcatcctccaaaatgattttggctgggaattccctgcggatgatcttnccgaagatcgtntcgccaccaggccgagcgacctgagcccttggnatctcatctggcacctcgngccgaatcttggccncgagggcaaattcccatagggngtcggattaaatcggaacatggcaagcngttcccgggg

SEQ ID NO: 122 - DNA, 942 bp, Homo sapiens
gagcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatgtgcgcgtcccgggacgactggcgctgtgcgcgctccatgcacgagttttccgccaaggacatcgacgggcacatggttaacctggacaagtaccggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaatgccatcaagtggaacttcaccaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggaaaaaaaaaaaaaaaaaaaaaaaaaa

SEQ ID NO: 123 - DNA, 738 bp, Homo sapiens
  misc_feature 556, 651, 726: n = A,T,C or G
ctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggnagaagtagtgaacaagaagcacggtgaggcggcaaagaaaaaaccaaaaactcaaatagtgtgcaagcatttcctggaagctattgaaaacacangtatggctgtttttgggtatgccctggagggggtgatatttgcatgtatcgtcatgcacttcctcctggatttgngttgaaaaagat

SEQ ID NO: 124 - DNA, 719 bp, Homo sapiens
  misc_feature 520, 645, 682: n = A,T,C or G
acataaagaaaattttcatttatttttccctcagatatacttcaaaataacatgtagacacagaatcacaaatatatacaaaacaaagtatcgcctggttatttcaagaagagttttccctcaattttcttagctgctgtgcataaaattcaaagctttcagggggttcaatgaaagggacaggctctccagcatacttcagcaaagatgcgtaacgctttagaaacagatcatccaattttgtattctttgcagtcaaatgttcatacagtgctttagcagatgtgacatctttctctgagacatagcttttcatgagggaattgtatgcttcttccttttcatttaattcaggaatcaattctaacacagatttcacagttgatgcctttccttgtttcctagaattcctaaggaggaacaacaacaaaatcggggtttgttcagcaattgcaccacatctctgtaggagagctctggcatcatccaccttgcctgcatccacaagttgaaggaaaanatcagtgacaggtttataaattgcaaactgattggccaatctctccgccatgatggcttatctttcaaactgctggtccaactgctcctctattactttctggataagatgccaaggccgagtantcgggtcaatgactttatcctctgaagtaagctattntcatggtttctattgcggcatctatgtaatcattctt

SEQ ID NO: 125 - DNA, 601 bp, Homo sapiens
  misc_feature 492: n = A,T,C or G
tttgagaccaagtttcataaagtttttacttggaaaaaaaagttttacaaaatatctttccaaagaaattttcccatagagtacaattaattcatgtagctttcttccttaaagattacagtatgacattcagaggggcgaggtttcttgaatagccaactagccgcaaaacctcaggtgttactgataagggcaaaagtttcttttgattttcttgtggttcctcttccaaaatgctctcactggtgtcactgcaagtggcttcttcgcagctgatactcctcaaaactccccgcctatcatcaaattcagcagcactgctttcactagtgtcgctacacacactattctctctacttcgagacttcaggatggatttgcgagggacatattctccattcacaacatcaacaaaggctctgtaaatgtctgcaggcgtcctgatggtcggcagctcctgggcagagtggccactgccagtgctgttctttncgttacgtttggcttcttctttcttttcactgaattttaaaggggtattctttccagtatttattcggaccctcttaggcttcaacagatgtgaaaaatatattggtgg

SEQ ID NO: 126 - DNA, 1119 bp, Homo sapiens
ctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctcaaaaaaaaaaaaaaaaaa

SEQ ID NO: 127 - DNA, 135983 bp, Homo sapiens
gatcatacttttaaatactattcacagatggactagtttaaaatgcagtcaaaacaagaaaaagtctaaaagcagggaaatagtgtaacgtctgggatgacataagcattgggatgaagtgcagacagcacagaggtaggcgtcaaggatcttctgtcattcttaattctataaaaaaaatcacaacttcttcaggtttcattttctcttctgaaatgtgaatatctgtctgacttgcctcttgagatcattttatagtgattaaagagctaatatttgtgaaaacagtttaaaaaccatagagtactacaaaacataaaggagaatttgaatttaaaaacaggttaagataatggaggctcccagtgtcatctggtcccaggctgatgcttgacaggtaaaactggaatttgctgccccaaactatagtaattctccggaattttttgctttgcttgtgcagagaaaaggaatacaccaaaaaggtagaagctcaaatataggaggtgctgccgtactgctgtggtctgagtgaataggtgcccctttaagttacaaatgtcactcgcctacatcctggactcctccacattctaatgagagtattgggacagacatcacatgaggcttaatctggaagaactagaaaaaaaacaatgcacgcagtgtacaagtcatcaggggccctcgtttagccagcagcatccttttctggtctttgggtttcacaaaataatagaggaaaaagacatactctgaagaaatcccaaaacaggaagagaaggagcaggaggagaggaagcacaacactcacagtgcccaggaaagtggtgatggtgaagaagttgtttaaaagagctcagatatctcccctgcaaaagcaactgcctgaggagtctacagcaggtgaatagttttcaaggtcttttaatttggataaaatgaccaaagaggaggaggatgcttgtgactttagtacaaacgacatgtaacagaacctggtttcttaatgttttgagcaaactgctggagtgttctatgtgtataatgcaccagtgtgttatggcatgacgtaaactgtataaattttgtaaatatgtatcataatatattcatgaaaacaatcaggacttttttttttaaaaaaaaaagaataagttaagaataattgagaaatccctgtatttgggatccaggtcacttttttctttcctggtgtaatgttttcaaggggaaaagtgattcagacatcttatctctctgcttttcctttcaagagtctgccctgccagattctttttcccaccccctcatctctcaggcatcaactggcagtgctggtggattaactccagcacaagaatgtgtgaaagttgctcttcccagtctggtcctctcccgactctttagtcatatgcataatggcttagaacctgtccccaaacaaccttgaactaaactagatatgcagcgctctacttctggagcttgaaggactttcttattatgaacgaacagcttttgaaacagaaggaaatgagagggaccaacatttctttctgtgacttaaattgtacttgcttcattttgggatgccttggagtctgttcacatcctgttcttttcttctaagtgtgagttctcaacataagggaaagcagagagggcagctcttgaaggtagaaagaaggaaagatactctgtctcacttcatttgattccccttagagttctgcaaagactcattagcagagggctaagataaccctagtacaagtgtagctagaaatgaatgcatatttagcacctactatgtgccaggacctaagttgcatgtttctattcattgattctacacaaccataccccatttacaaatgataaaacataagaactaccatggtagttcccaaatgattgccaagaactcactgaagagaaaatgcttcttttcctactgcttgcctgtttagcaatgactagtgcatgagagtagtacttacctgtgcccttcaggtagcatgtggatatgactctggggacagacaagcctagttttaaattcctattgggtcacttttgttcatataatcttgagcaagaaatatctaccatttctgttatgttagatcccccaggctggagtgcagttgtgtgatctcagcccactgcaacctccacctcccacgttcaagccattctcctgcctcagcctccccagtagctgggattacaggcacctaacaccacgcccagctaatttttttttttttgtatttttaatagagatggagttttgccatgttggccaggccagtcttgaactcctgacctcagttgatccacccgcctcggcctcccaaagtgttgggattacaggcatgagccaccatccccagcctaaacaattcttacaacaaaaacacaacaacttaagacaaataagctagatgtgaaggatgttgctgctattattcctgcacattttcctaaaccagtggttcacgcttgaggcaattttgccccacaggggacatttgacaatatctggagttgttgttgattgctacgccggagagtggcaatgctactggcatctaagaaacagaggccaaggttgctgctaaatcatactacaatgcagacagccctcttaaaaacaaagaattttctgggccaaaatattaatagtggcaatgttgagaaacccttctccaagggaataaagtaggcaaagttgaaatcagataaatctgttaagaccaattgatgacattctacttatttaacagaaatacaagtgacatggtttggctctatgtttccacccacatctcaggttgaattataatctgcagtgtttgagaaaggaccacgtgggaggtgattggatcctgggaacagatctcttctttgctgttctcatgatagtgagtgagttctcacaagatctggttgtttaaaagtgtgtggcacttcccccttagctctctctcttctgctgccatgtgaagatgtgcttgcttccccttcacccttacaccatgattgtaagttccctgaggcctccccagacgtgtctcctgtacagcctatggaactataagacaattaaacctcttttctttataaattacccagtcgcaggtagttctttatagcagtgtgagaatgaactaatacaacatgagggtgaattcaccctcatgaatgcacccaaaaattttcataagagcaaatagattggaaaattcaaaacagctacttgtcaattgtagattaagtgattacaggaaaggtaaccatacaatttgtttcccaaacttgtatgatatgaggagtaaaggagggtattttattaatttttcaggataatggtcatatatcaggatttctctgggcaaacaaggttatatggttccctggttataagagaatgcgaaaataaagtatgtcacattgttgttatggaatgatatgtagtcagcaaaaatattttaaaggatatttaacaacattgtaaagtgttaataatgtattttatatatccagccctttataaggctagatatatttatgaatcaaattttataatatatatccttatctgtattgaaaaaagaatggaaagatatagtacatagcatttttaacattagttcactggctgttgaaattacagctgatgattttggtttttctctatattcaaaattgcctataatttttttaaattataaatatatcctgcttctttaagaagaaatgtaattcagtcccagttgatgaggcaaagttattcttcacagaacaatgtcagctactaaatatagaaaaaatgatataaattagaaaaatcacactttttatacctcccaatgaaataattatttcaggcaaagatcgtcaatgcattttaaaatatttaggtgaaagattgttgagatactcacaaggtgctaaggtattaaccaacaagttagttgctaattgtaaagtgaaaaataaaccttcacaatgaagagatttggtgatgaccataccaacaaagtgatcaaatttaacatcattttagtgaaaaacctggcattatatgccttctgttgtgatgtaacatgaaataagaatatcacttatggaatatcctagccaaaaatgtttaatttaaatctaattaagccattagacccattttagtttataagaaatccaaagagtataagaacaaggagaaccacagcatgcagaagaaatcagacaaatccagaatgtgggacaatacaactgtcctgccatgtcttcaaaaagtaaatgctataaaaaagaaataaagggattttgagattaaaagacactagagaaatgtaacatgaatacaatctgtgaactttgtttgaaaaaaagagagagaatgagagagataaatgtcatctttagataattggggaaatttgaatataaattgaatataaattggttatattatcatgtgtgtgggtataatatgaatataaaattatcttagatatgatgatggcattgcagttatatgaaatattatggtaaatattatgtctgcaacatattttcaaggtgttcggaaaaaagttcacatacttacaaatagctatacaaagtaaatatggcaaaacatgaataaccgctgaacgaaggtaatgagtatacaagcgttcatattgtactattctttcaatctttctgtatatttagaaaatgtttaaagttaatggaaaaatatccaaaaaggtacgtttaatgtaatatatttgaagcagtgtgattacatttaaagcagcataattagtagtcccagagttaacctttgtctttgtaggttacatggaaatggtgaacctacagccattcccttattctgcacaccacttcaggccagcttttccagtttcacttctatgggtctcgtcacttcctgtgatatatttcagtttccgtcccctccaccacagacagtaccaccttcttctacctcctccatctttgagggtccttatctccccaggaacaatggaaatagagcacagaatcagtaactaacttccttctagtggcaaaaacagttaatgtcaaattagttactcccaggtactcccctacttttcccaggctacctcacagttaggttggggtcatgtaactggctcagagggaaaaggccggttccaggccaagacagctatgagctatgcagccacttccatctttgtctacccttatcgcagaggcccttagtgtggctgcaaaatgaaggaagatcccccattcatattagactgtgatatgaacaagaaatacatgtctgttgtgctaaagccactgagatttcagggtttgtctgttacaacagctagtcagaatttcttagtttctaaatctttctgagaggctaacaggaaacccctctactactgcatccagtttaccctttctttgaatattgcctttaatatgcaattaagaaaaaactattggtgttcccttaggaaattttatctcccacaattttcagagtaaacagtgcgcattcttccaaatctctacttaacataacaacaagcacatttgaccatttcctcaaaaagaaaagaaaaaaggctgggtgcggtggctcacacctgtaatcccagcatttgggaggctgaggtgggcggatcacctgaggtcaggagttcgagaccagcctgggcaacatggtgaaactctgcctctactaaaaatgcaaaaaactagccgggcatggtggcatgcacctgtaatcccagctactcaggaagctgaggcaggagaatcgcttgaagctgggaggcagaggctgcagtgagccgagattgcaccactgcactccagcctcggtggcagagcaagacactgtcgcaaaaaaaaagaaaaaaaaaagaaaagaaaagaaaaagaaaaggaaagaaaaaaagagaaggaaggaagggagtgaaggagggaggaagacagagagagagagaaaaagtgagagagaaggaaagagagagaaagttagaaagggagaaagggagaaagagagaaagagagacagaaaggaagggagggagggagggagggaggagagattgcttaataggttaggaagttcttttgccaggacttctacatatcctcctgtatgggtcagatgtgtcacacccagacacacagaaagccaaaaaagcattaaaatgggctacaatttggtgacttgggaacaaaaacataaaaacataatattttcttagaaaggatttctaagcctaaaaatgaattattgccttggacaatgacagcattaatcctggaagaaaacatatctggctggctctgtatgagaattcagatttcttgatttctttaccacctattgattggcaacatttccaatgaacaattttacttatttcattttaaattgatttctctttttagcaagactttgctttttgagagcactgaggcaaaaaaaaaaatcatttaattttactttttgaaatcaatgtctacaagacccttccagtcaatggattacccttgctatccattagacacctttctaggctgttcactgaccttttgtatcacatatacgattgcagcacttttagtcttacatgaaatgtttttgtcattttccccctttgctctttctgtcacttttaagttctgaacttcactctgtaattgctcagcttctcttttaaacttgacatgcattatgtgtcttttgtgcccttaattacattttgtactttggggttcaactgtgttggtcttttctaatcctactatattgattgctatacaacaagcctccttccctctgggaacactatttatctttaagctattttttttccagttctgagaaccactaaatttctttctactgctctttccaggaaatctcagactatcctgttgtgatgccaagatctattcactagaaacataattacttctctttcaacatgagctctctataggcatatttgaaaaagaaaccaaagtgacaaaatgtagaaaagatacatgtgtcaagaacagacaagacatttcagaatattcaggaagcaaaaaatatatattttataaaattatgagaaggagaaaaaaaggatggtttcttaaagaaatataatatgggaaacattgagttaaagcacagtataaacacatggattttacgaaattaagagtatacaactttaacgtctagtgcaccaaacacaaaagcactagctgtgaagaatgttatcatttgtcaaatgcaggcaaacatcttcttctatgaaaacatgtgcgacagtctcctcatttgtcccactctacccagtattatttccctccaactttctccagaatgcagccagagtccttaccataaaatgcatctttaatcatttctctgctggaaaagcttttaatgactctccattctagaataaagcccaaatgcctataaaaccctaactatctggaccctatttacttttctttcttcatttctagccacttccctttcttcccaaaagctgtatgttccaaacaaaatgttcttatggttttcctctggacctttgtatacactggtttctcagaatgctctttcctgccccaactcctcttggtctgtctattgcttattcatctttcatgtaaatgcctcttcttacctgactcaagtaaaaattaagcaactcgcttctgtgtattattatagttcattgtatttctcctatcataacacataactcactgttacattatcttgtttacttacctgcaacccactttattcagcaagcaataggatggtaatgacaaatatttatcatttttgccaatatcccagcacccggcactgtacctagcacctgatgaagactgataaatgctttgttggatggatgtcgtacaaatatttagtaacccaaggtctaattttaacctctggttgcaattcttgttgaaaatctctccaaaataagaactggcaacccttagcatgtgcattaaaaatggctcattagcaggatacctttgggatatgggacagttgatgcctctattatctctttcctactaaccataagggcttgtagtgataaaagatgcccatcatgttcaaaattcagcagttggggttctcttagcacccacacagtccatcttcacctgtttagaggtactcatttagccaccaaaaccttccaggttctactctacagaagaatcagggtggcccagtaaatgccatctcccacaatttttagcctgacaataggatggattaagcattttagaaggaaaagtactccttccaaaggcagtcagcctctttctattgtgtaatgaatcagtctacttttctgtcttagtaaatctagtacaataagaaaaattgcatctctttggaatgactaagcagcttataagatctcagagtcctcatcttagaaatagtatcctgggaactttagatttagagatagagaaaagtggctcaaagctgtactaatcccctctagaagtctctgaaataaaaaactacttaattcaatatattctgcttgattttaaaaacttcattccctccttttcaaaatttctcctgcaagggcaggaaattcaaccagtggagggtacagtaaagggaaactgtattgaatcagatttggaatatttacatattgaagtttatgctctaaagtatcaaatttagtgactcaggagaaaacttcctttaaaaattatgtgaatatcattaagtactaccttgattttgcaagaaataacatcttttttttgagacggagtcttgctctgtcgcccaggctggagtgcaaaaggtaataagaaataaagaaagcctttgagcatttggaggaacaaattcaaagaaaaatagttttcattgttttttattattattaacagaaaagggaaaaacatgaaaattatctggcttactgcccaaactaagggcatcactaagaaagtattttcactcctcttaatatcaagagtataaaaattctgctaccaaaaataaaaacaaagtgaagcttcatgtccaggagagtggaggtacagcaaaatgctacccaaactattggtaatttattagtaagtgtaatttaaaatcaaatgctttttgagttatagaatgtggaataatcaacctttcagggttcaaatgggccacagattttcaaaaaggacatcaatagaaataaactgtagaaaagctatttggactgtcctaaatctaaaatagccctagttcccaaatatgtctgttcatgtgcttctttttatgcctgactacaaatttgctgacagatgttgtgtctcttaatagtcaaattttgatatttcttctttgtttacccactaattgctctcagtagtacctcccaactttacttttaccaaaaactaaacttgggtactttacgagtgaccctgacattttctagtagctccttatttcctcagaagccaaaaccagcaactaattcttgaatattttttccatacctgacagagcctgcaatcccatcctatgactttccaaataaatacagttcagccatcaaagtgagtcagaagtaggtcacatacctggaccagtgatggaaaggttgggcatttgaacagaaaattaatgaatattaaagtgaggaagtttaatggatattaaagttagaaagtgtaaggtgctttcctgcccagagattagaaaacctgacaagtctagaactctaataaccacaaatggcctattgcagctttatcaagatgcgctccacaggacaataacatgggaagatgccccccagattgcctttcatgagcaataaatgtagaagcagctacacaacacagcttttctcttggagattcagaaagcgcattagcatattaaaagattttttaaagcctgtccataaatagacctatttatctctgtttaatctgatatttaatctgctttctgccaaacatttttaaaaattatttttaatttgtatacatttatcttgtaaaatatattgccaaacttttttgaccactgaatacctattaagatctcagagaactggtatcccaagaaatatgcttgagaaaaagctgacctgctcagtcattcatatatgctgctgcttcttgatcacctagggctaccctataaggtcaggcattgaccatttgatgtcctaaagctgtgtttcttaaacttctacatgcatatgagtcactggggatcttgtaaaaacatagattctgattcagtaggtctaaggtgggctctgagagttggggtttctaacaagcctccagttgatgccaatgctgctggtccgtgtcacactttgacaaagctctacagggacctggcaatgggaaaatattcatatctccaatctctttatcttaccattcttagtaacaaatcttcctaaaatactgctttcattatgtcactttgctggtcaaaactttcagtgcttccctcttctcttccacattagtcattcaatgatagacatttattaaacctttattgtgtggtaaatagattaagaaagcctctgtccctatatactcaagaaagaggtgggtaagaaacaaggcacagaatgctgggagccaaaacagtagagaatagctaatttcagtaatttgaacgtgctacatgactagaccaataattcccaaagtgtgttgcccaaaccatcaatggaaaccatcagcttcacctggaaacttgttagaatgcaaattctcagggctcatcctagacctacttaatcaaaaacttcagaagtggggtctagaaatctgagttttaacaagctctccaggtggttgaaaaccactggattagacaatcagtaagtttctctccagctctaaaattctatcattttgactgctgatacctctttcaatgatttttgttatccagacttttataaactaaaagcatactctcgggaattaacttccgggatttaaaatccacctcttacacttaattgctgtttacacttgcacgttacttcagttgtctaatgcttcagattatcatctataaaatgagggcaataatagttcctattttcatacggttgttctgaaaattaaataaactataataatataagtagccaaccaggcaagatgcctggcatgtggtgcttcagatcataacacagtcattaccctcttaataaggccttctttggccactctatccaaaattgccacccacccctaccatttccttgtccccttccctgctttatttttctcctttgcagttattattctctaacatactacatatttaaattgttgctttctttactatcattttccactagaatgtaagagctataaaactgccaaagatttttgtccattttgctaagagctgtatccccagtgttcagtatagagtttggcacattataagcactcaaaacatattggttggggctgggtgtggtggctcatgcctgtaatcccagcactttgggaggccaaggtgggcagatagcctgagctcaagagttcgagacaagcctgggcaacatagcaaaaacccatctctaccaaaaatacaaattaatatatataggttggatgaataagtgaataaatgttaactattattgatatttatcttattactaataattagcaatctaaactttccttattgaaacagtttctacttcttgttcattgccacaaattgcacttatgtcccattccatgctctactcaaattatgccccatttctaagatgcccttctgcctaaattcagcccattgtagaccctgctcaagttctgccttttcctttaaagttctctgatgactgaatgactctgatgattctggctctatagctctctgaatgtctacattgtttactatctgtgccatacaatttagcacttaattatcttaatctagtgtcagtagaatgagtaacttttaaggaatttactgaaagagtctgtgtcattcatgcaataaatattccatgaaaaattggaggaacgaggccccaacggaaacaatagaaaaccttatcattaattatccatgttgtccttaaataataaaaatagcactttacattttacaaataacccattaaggctgttggaatcaaaatggagtcccttatgtttaaaaaaatatctgacaaatagagccagggaaggcaacgaaaagaaggctctcacacttgtatacctgattacaaaacttatcacaaaagactgcaaataccaaaaccttgcaggaaggccactgcacccttgtgtccaacctcagactgacgttatccatgttattatatgtctttgtacccaaagataaccatttcaataaaattatgtaatactcctcattttttctgtaaaaactctttgtcttcctttacctatctgaatacacacatagtttactatgcacatttccccattgcaatgccctattcttgaatattttcttttagagagcttctctgtgacttaagttgacacactttttaacatatcatcctaattttgattagatgatctcaaagactatgtatccttggtctcaaattttcaaaacgtctttaggtaaattatgaagagaccatttcctgaactgtaaaacataagaataaattgcaaaagtcataaaaaaagcagataattacccaagaagttgtcaagttcagggatggaaaataagtggctcttttgccctgagtcctcctgccaactggatctgcaaaaggtttcaccatcatccccatgcagtactcgagacaggcattatcaattgatcagagctggcagaaaaggggacacctatttgccatgctatcttactctaaccattctgcttttaaatgtaaaggaaacagatatttaaaattttaaagtgatttaccttttgcaaatcacctgttaaagtcgtcggaatcaaaatggagtcacttatgtaaaaaagaaaaaaaaaataaagccgggctccatttgtccaggtacatacatggtcatacatggtgacagaaccaagacctaagccagcctcctgattctgtccagggctctctgcccctcctactccatttctgaaattcagtacctacattttcattctaaagcaatcaaaacataagaagcaaacctttgacagagagttttcatactaatgctcattaatataatgctgaaatgaaaaatgacagcttcaagtcaagtgacagacagggttggttagcctgttatttttcagttcagtttatttacctaaacctagaatgtgtcatgactggaaatagacaaaacagattattctaattccactgtcctagaaaaagaaaaggaaaatagtcctcattaataggaactgggctcaaatccagtcctgaaataacttccattactgaatcaactttttaaaggtgacttttcctttattaatggcaaagcattttaagcatagctttaattactcagtttaaattataggcagacatacagaattggaaaaataagaaaaagaggtgagagagagataaacatctactttaatataatgaccattcccttactatggaaattatgcccacattaaaatttttctggagcctctctctgaatcacagcttctaaatattaaaatcacctctataatgcagttggaataaaaactgacttgtcaaattgtacctagtcaattgataattctatcttgattaactctcattttttaggcttactataattgaagctgcttttttttttttttttaaagaaaaatcatcatctaacacagaaaatgcttctggcacaatctgcttacctaaggaaaccaggataacaggcagttctgttacttcacagagttaatccattttagcacctatgttacttagttacaaggtaccagcagttggtcctatagtttgtcctttcgccctgagaaggtgagcctgatacatatttgaaggaagaaggaggaaagcagcaagtacacagaatcacttctcagcacgcaccctgccaccaccctgggagaaatgctgaatccgcagctgaagttcagggtctgtgctgcccctcctccatgcaaaagggcaagtcagttctagggttcttccatcgtgtggaaacaatgccaaaggccctcagaaaaatccagccacaaagctggagtgattctcaccttagccccctaagttagcccaaagatcactggtgtaccatgaattggggtcaaagcaagaatgtcaccaagagttctggccatatcccaccatgctagcctgggcatggtacctttagacaaacagggtagccaggacaaattttgacttctagaaagtagactagtatttcctaaagaatggtgcaggaaacactggagaactctactctctagcctagtcattacaaaaaatcagagatggcttcccctgtatcacattactgaatgagtttttcaggcaatagatttaatcatctggaaaagagtacaagtaccccaactcactcagcagaaacatttttagtagttggcatctaagacaccattcacaattactggaaaccctataaaacactaccactttcataataaaaacccaaggccaggagcggtggtccatgcctgtaatctcaacactttgggaggcggaggcgggaggattgtttgagcccaggaatttgtgagcagcctgggcaacatagcaagacttcgtctcttgaaaaaaaaaaaaaaaaaatccttgagaaatggctatatgcttgctaaatccgaaacagtaggtagaaaataagtttaagagtagaaaggacttgatagggaattacagtttggtcactgctcagctctgtaaccttgagtgaaattacttcctatctctcagtctaacttttctctttttaaaaataatcataataaaactaatttcccagcagagtcctgaggattacataaaaaacacggaaaaagtgtcttcataaaaatgcctggcccggccagacgcggtggctcacgcctgtaatcccagccctttgggaggccgaggcgggtggatcacgaggtcaggagatcgagaccatcctggctaacacagtgaaaccccgtctctactaaaaatacaaaaaaaaattggctgggcgtggtggcgggcgcctgtagtcccagctactccggaggctgaggtaggagaatggcacgaacccgggaagcggagcttgcagtgagccgagatcgcgccactgcactccagcctgggcgacagagcaagactccatctcaaaaaaaaaaaaaagaaaagaaaagaaagaaaaaagaaaaaaaaaagcctggcccatgataaaaaataaataaataaataattattattttcttctcccattttctttttactagcaaagaaaatatctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaaaaagaaaatatctatgccaaatgattctgaatatgtatatagcttaaaaacttaagtaacatgccagtgtcttatctatgaaactgttgtttgtattggtaatttgaagcaactactatttatgtatgtaattatatgtgaaatttgaatgaattataactctgggcaatcatctagttgaacaattcaaattggtaccataatctggatctccttttccagaaatacattgcaactttatttctcttctaatcaatctcattatgatggaagagaaagagggaaaatctatccctcatcagttgaataatagcaatgtgttatggcttcttttctactgagtccatttcttttgtgttagataacatgtatctctcaaagtatttttgcttatctgtcttctagagcctgcttatgcatcttatattgcaaatatatcattctgttcagttttagaagcaagtatgtacaattctgaaaaaggaggagagaagaaatgcatgtttgatgcatctaagagaacaggcagaaacagcctatggccaaggacaacagcaggcttgtccatctgcccatcatcaaactgaactgtgtccactagttatcagcagggggtggccagtgggcatcacactaaaatagaatttctgccattgggaatacaaggtgaggagggaagaaattgtttcagaatccatttctgctttggcatgatgtatataaagaattgttgcttgtttcttacacataaatataaaacttctttcattcttttttttcatttattaaacattttctggatgcgttttaggatctaggcactgtgctggccactaggaatataaagaataatttccttctttagcgattctgttttctgagggggacagagaagtaaacaaataattataatacagtaagatgacagctaatatacatacaatgtgctattggaacccaaagaaagaagtaattaactatgcaaaaatatagcaggtttacaaatttgtgaggcatctttgcaagaggctatgctaatcttctctgtaatattccagtgttgataccaacaggaatgagaccactacaggagtgagaccaaccacagaagtagaatagaacatccaagaataaacagatggatcttgatgagttatgtttgtcttagggtaggagaaaaaagtgtttattgtctttatcttcatttattacagtcttttttatgtgtgtgtatgtttatgatataatttttaaccttagtaatagcatctaaatgtctcaacctctgtattctatatcagtatgcttgagggtatgaccactggaaaacacagatatagatatgatataaatgtagatatagatgcagattgtaaaatagatttagatagcttcttgtctctggaaatactacttacaatatactttttaaattttacaataaagcattgtcttttaggtaatttcctaacagaaaagtgaagataaggcatagcatttattggcacttagcaaaattaagatgttaatacaaatacaaccttagtgtgcttttagacatactataaaggcttcttttcgattacagaaatgaagaaggaacgaattgaggcactccaatttcagctaaagtagaaagtgtgggtaaactgtcagcttactgtttaaatgtctgttggctttgttactagcacactaatttggaaacaaaattcacatcggtttccgataaaatttattgttcctctttgaggcaattttttgtgctaatttacccaagtctcatcttgggtgtcccaggcattcctctgtgctgttcctgaaaccatacattggcctggagctatttgagtaataatattggtgttccccctccatgccccagtcacaggagccagtggcacattctgaaaggtactccaagacatttgcttgccccaggagcaccatggttttaagcatcaggcttagccagggtctaagtctgctttgaagaacccactccaaagagtaacagctgtcactttgcctgtctctgtcctggtggacaccaaaacttaaatagtctatcccctgacgaattcaagagaatatagtcacattgttattattatccatcaattgtacaagacataaaaagtcctaaacttacctctaatctctactttagtcagataattgacttttttcacatatcaaaatttcatttgtaccttacctacatgtaatgaaaaccacaatgcctgtggatatagcttaatgtttttattctttccacttgtcaactctgtataagtaatttgaggtcactgttctcaatgtgtttctcttttaataatatctagcacagcttcacaggcaactttattttaaatgaatgttttctattgatagtggtggtgctagaggtgttgccagcttttctgttccactccaacaagtatccaagtgttgtcctatgagtgaataaagttttgccaagatctacgttattttctatgccttttattacaaatttctagccaacataatttttcattccctgcgtatgtaaaaactgcaaaaaaaatggaatttaaaaataaaaagtaaatgtccttacgcagtaatggctcaagccttgagtaatggctcaagcccaaggaatctgactcataaatgctacggagaaagtcattcattaacttaaggtcaaagacatgcaagctacttgacaataaatggaggccaacagaaacattaattagtggaaatgtttaaaaagtagacgtcactgtgaaagcaatggcttatttctgatgatgaaaggtgtgatatctcttctaggttatttattaacaatagccaatattcagaaaaaaagagataaatgagcaacatagaaaaggactaggtaacacccaacttatgagcagcttcaaaactccaagagcatgccagttgtatagttttaagaaagtattttcccttacggtattgttagacatggtagaaacactttgctttcagctcacataagccaatctaaactataatgtagttgaaatataatattgccctggtaattctatattaaattcacctaaccctttgtaacacacttctgaatttctatctgtgaataataatgaaaaaacaccatttattgagcatatatgtactacttctcaggcactgtgccaatttaatccttacctcagtctgtaagataattattattgttatcttttacagatgcgcaaacaaatctaaaattctaaaacaatctgctataggcgagagtatgttaataatgctgtatgtatgcataagagaaaatgtcctctaagtctgtcgttctccagttttcatacttaataaacaagaagcaatccacagtcaaagggcagaggctctggacacagaattccctgtaacatgttcacaagatcagataaatgcctctgtcagtgactgtccatatagtacaatgtatttgcagccttgaggaacatgtgtagattcaaacatattctgggttcctcttttaagaatcttgttagacagacctttagatcttatttttaataactcttaatcttttttatatactcagccaaagatcaaagctgctgcttaactttaagctatacattctgtattttctactttaacttgtacttatgccacatttttttttcatagcaagagatagatttaccttcacgaaggaatacaatttgcccttaaggaaatggtattcattttcaataaacatttggtaagtaactactttttcaaaagtcaaagactaagtccgaagaaggtaaaaagatggataagacctaacctatgcctgtaaggggcttaaaatctaactatggggacagaaactgaatcagggctaagtttgaagtaaagcctcacactccctctccaaagaacaatttctgacacagtattgtttctctaaggagcaagctctaactttgtctcaatacgagaaagggggctaaacaataattgtctaggataaactgttaaaactaaaagattctggttctaccaataactctgagggagagggggcaacgctggagaaagggaacagtttcagaattgacataagtgtgcctgaggatgttcctttacaaaccacatacccccagcttgccatgttcccaagaatcactgctatagggagtccaggtatagaaaggaagacgtcatgcgtctcagaatcttgagacaggcaaagacggagaaccacaaggtctaacatgctgtagttttccaggtgcagcttccagtgacaacatagtatatactcatttttctatttgtccttatttaatattaaataaaaaagaatatttggcacaaaagtccagatcaagaggaacttaattcaagtaggtgattacctgtgtcattcattgagataaaaggctgtctcttcagaagtaggcctgaatcactgcaaacttgagttgcttagaaaagagtctgtgataaaaacaagtatgaagatagttatctaaagcaaattatttttactcattaacaactaacgttttgggaatgctctcataacttactataatttactctccccaaaaactcagagaattagcctaattctcttctacacataaaataccgcagatattttctctctttggagaagcagcctttctcctttttaccaaaatgaaattcttagtgccacagcttcctaaatctatttcagtccttatatttatcttttatctattttcacacttcacgttccccctgtaaaatgcacccctaaccagttgatattctatcttatcttccatcctcatgcaccatttagcatttacatttatgttttatgttttgctgccacactgattaccaaatggtggtggatgacatttttgttttgagttcagcattttgtttctgttttagttttagggcgaggggttttttaaatggtattatatggcatttaaaattatatggcatatcactctataaaaatttaagttaaagaaaagcctttttccaaatgaaggggaaaagctattcaattttaccacatagaaaccactgctaaaattttggtatttttccttgcagcatttttttctatgtatgttttttaacttttcattttgaaataatttcagacttacagaaaagctgcagaaacatacagagagttaccatgtacccttcacccagcttctaccattaatatgttaatgacttccataaccatagtatagttgcctagatcttctatgtatattttgacaaggttgaatttatattttttgttcattgctttttttgcatttaatatgatagcataagcatttatattaagttcttcaaaaatattttaatgtccaagtaatgtcatactacataaatgaatattttaattaattatttccatactgttggatattgagattgtgattttttctattattaaaaactctcatcaacatgttatcattttttaagtatctactaattttatgggtcaaaaaggtagtctctcattttaaattgcttttttgtagttattattgaaggtgaacattttaaatgcttacagtttttatttcatcttttgtaaactgtttattcaggcccttttccttgtactgattggtgtctgaatgtattacttacaaagttatgtaaagcttacatatttaagattaagcttttgactcaaagattacaaagtgttttattgttttgtattcaccttttgattattttgtttttattgcaataatccaaaataattttgctgactgaaaacaacatatctcttttatagttgtaatttgtaattaaataacttttctataaagtaaaacttccttccattcttcaactcagtatttctcaaactaagatctatcaaccactagttatctgaacatgtgactcttgggaatgataggaatttccttccttaaaagagtctatatattattcaagtttgacaattactgcaaaaggtacaaaagtcaaaggaggaattccatgtttaataagatgccatgcatacacaataaaaacactttatcaaaggatcagttagtattgtatgttttctagtgttaattattttatactattttaatgtcttataaatactcataactgacaactaatttcttttgtgttgttacaagctgaacatcaaaaagctgtatttcacttctacaatactaaattgcttaaaagtcccaaggcacccctagctcttatgtcaactacctctgctccctttgcctggagtactctctcactccattcctccacctcaatcaagtggaaagcttgtgtgcctcattgtcattcctctccaccaaaccatcccgcaaaaatatctgagttgttgtattctctgctaactttttctccatgtttactttcaccgctgcattatcctggcattttgttatgtagctgttgcccctcgcaactgtcagagactgttctcgatattaaattatcatcgctgtaattccagtgaggctagaaaagttcctatatatatatataaataaatatatatatatatacacacacacatatatatacgtatatatacacatatatatacacatatatacacacatatatacacacatatatatacacatatatatacatatatatatataattggaacttctttaatgtttataaaatgaattatccatataaggtagcaatcatctgggagagttctaagaagcccaaccttgtttgctaaattgtactgacaaataatactgcaagttcatcttccagctctgcaatcagttgtctcatgggatccacacttcattttggcaatgtcaaatgctttctattctgtgatgagtgactcaagccaaagataacatctttgctcaggcaggtgattaataatcactctttataaagactttttatattgaaataatttcaaacttacagaagagttggaaaatgctatggtttgaaagttttcccctctcaaacttatggtgaaatttaattgccattgtaacaatattaagaagtgggatctttaagaggtgattaggccatgagggctctgctgttatgaatgaattaatgctgttatcaagggcgtcggttgcttataaaaggatgagtttggcccgatttgttgcttactttctccccctctctttgcccttccaccatgtgatgccttctgccattatgatacagcaagaaagtcctcaccaaatgcagcctctcgatcttagacttcccagcctttagaactataagccactatgtttctgtttattataaattacccaatctgtggtattctgttacagcagcacaaaacagactaagacagaagaatgaaacaaagaactgttgtatattctttaaccatactcctcaattgttaccattttgccacttttgatttctctttctgtgtgcatgtgcacacacacacacacacacacacaacaaaatacttttgctgaaccatttaagagttacttgcagattatgtccctttatctctaaatacttcagtgttcatttcccaataaagaatgttctcataaattaacacagtatatttatcaaatccaagaatttaacatttacgcaatactgttatccaatatacagcctatattcattttcctctaattgtcccaataatgtcctttacagaatttttttctctgatccagattcaagatcacacattacatgtagttggcatgtctgttaatctccttcatctgggacacttcacattttgtttttcatgacatcgaaattattcagaagtaccaagggatttttttttataccttaagttctggggtacatgtgcagttttgttacataggtgtatacacgtgccatggtggtttgctgcacccatcaacctgtaatctacattaggtatttctcctaatgctatccgtcccctagccccccaccctccaaaaggccctggtgtgtgacgttcccctccctgtgtccatgtgtcctcattgttcaactcccacttatgagtgggaacatgcagtgtttggttttccgttcttgtgatagtttgctgagaatgatggtttccagtttcatccatgtctctgcaaaggacacgatctcatcctttttaatggctgcatggtattccatggtgtatctgtgccacatttcctttatccagtctatcgttgatagacatttgggttggttacaagtctttgctattgtgaatagtgccacaataaacatacgtgttcatgtgtctttatagtagaatgacttataatcctttgggtatatacccagtaatgggattgctgggtcaaatggtatttctagttctagatcaccaagagattattttaaagaatgtccctttggttctgtatgatgtttccacttggttagattcagattatgctttttcagcaggaatactgcataaacattgttgtacatttctcagtataacatgtcagggatcatacctcaatttatctcatcattggtgatgttaactttgactactcagtaaggcggcattggtcaggcttctccacttttcattctgtaattaataagtaacctccagggagatactttgatgaaatgtaaatatcctgttcctcttcaaacctttagcttattgattattcttctgaataaatcattttataatgattgcaaaatgttgatcttctacctttactatttcttctacatttattagttaattaaccattcttttttcttttctttttttttttttctttgagtcagggtcttgttctgtcacccaggctgctggattgcagcagcacaagcatggctcactgaaacctcaacctcctcggctcaagtgattcgtcccaactcaacctcccaagtagctgggatgatgggtgtgtgccaccacaccaagctaattttttttgcccagatggggtctccctatgttacccaagatggtcttgaactcctgggctcaagtgatcctcccacctcagcttcccaaagtgctggggttacaactcctagccaaggtgcccagcccattctttttttgaaagttcttctccttagtttgtatttttattcttcataagactgttcaaattcaaaatttttttttttttttttttttttttttgagacggagtctcgctctgtcgcccaggtcggactgcggactgcagtggcgcaatctcggctcactgcaagctccgcttcccaggttcacgccattctcctgcctcagcctcccgagtagctgggactacaggcgcccgccaccgcgcccggctaattttttgtatttttttttagtagagacggggtttcaccctgttagccaggatggtctcgatctcccgacctcatgatccacccgcctcggcctcccaaagtgctgggattacaggcgtgagccaccgcgcccggcccaaattcaaaatttttaaaagtggtatctttaaacctatttttaaattttaatcgcatttttctttaatttttacatttccaatgtaacatgttaaggacacctacagccgacattctatgttactcaaccattttctactttgtaaaactttgaaacttctaagtcttgccacaaacttctaactaaaatcgaagactagctctgtcttgttccaatgctccttaatcagtcctcgaaaatgtctaactcctacctaggaatctggtgattatattaagggtcttcagaaggttcatggaaagtgtgtattatgaaaaaaagaaccatgcatggattttaaaaactttgcaccaaaataaactcatactaacttgttataaaaatgtctgaagaggatctagtttgagatgctaagacatcactttgaaaataccccttatcacagcaacatgaattctgctaaaattgaagcaagaacaaacattaaatttatggtaaagtttggatgaaagaataatgaaatcattcatgttttatgaaaagtttataggaatggcccaaagaaatcagcagtttacaaatggataactcattttaagagttaactcattttaaaaagggataagaccacactgaagatgaaacctgtgcaggagaccatccacatcaatttccaaggaaaaaaattcaactttattatgtcctaattgaagaaaaccaaggattaacagcacaaacaatagccaacaccatagccatctgcattggttcagcttacacaattctgtctgaaaaattatagatgagcaaactttccactcaatgggtgccaaaactattgcacccagatcagccacagaaaagagcagaactctcaatggaaattttaaataagtggaactgagatcctgaagcatttcttcaaagaattgtaacaggagatgaaacttagctgtgattctaaagacaaagcacaattacagtaatggctaccaagaggtgtaagtggtccagtcaaagcaaaagtgtcctggtcaagagagaacatcatggcaacagtttttggggatgctcaagacattttgctttttgagtctttgttggaccaaagaacaataacatctacttatcatgagaatgtttttgagaaagcaagccaaagctttagcaaaaacaaacaaacaaacaaaacacccaggtaagcttcaccatagtctttctccactataaaaatgcacctgctcattcctcttaagaaacaagggcaattttgcaagagtttcaatgggaagtcattagacatccaccttacagtcctgatttggcgccttctaacttctttttgtttcttagtcttaaaaaatctgtaaaagaaacccatttttcttcagttaatagtctaaagtctgcattgactgaattaaattcccagaaccctcagttttttagggatgggctaaatggctggtatcatcacaagtgtcttgaatttgatggagcttatgtttaaaaattaaccttatactttttattttaatactttatttccattttccacataaaaatttattttcataaaatccagattctgcacaatatttttccatgaactttttgaagtctcctcacatctctagttttagacagaccaagtctcatttttattatgtttcattacacagtggagattaaggaggacttagtctaatcttttaatttagagaccagtttccttctcttcaactagttcaattctgtgttcagacaagaatcaaaataaaatcctcagaaaatggatcgatctaatagtttcagtgaaaaaatactttagatgctaactttatgaaatttaatgatcttttaactttatgaaatttaatgatctttaaaaatgtgtttaccattaagcaaccactatactaaataataatttaagcaattttgctactaaatattactaatttttttttatttctgaagctctctttctagactgcagattaagagctattggtcccaaatatgcggttttcccaagtcaagtaaccatgtcaagaaatgccattctgtctaaaaggggctaaaaaggactcaaagaatacacataacacatctcgcatctgtgaagactgtttactaatgagatcatcaagaaacagccaacatcaattgtttagagtgaaaatttgaaacttggaaactgtggcatagagcctcatagattttcatagctggaaaggaccttggtggtcatattcagcccaaagctcccactttgtagatgaagaaattgatacaaagagacatgtcataatttgaccacagccaattcatgtcaaagtaaataaggataaaatgttaattaagagacaaacaggaggttggtaatttgaagagtctaagttcattagtgtttctataacacaatttagggtttgtcaagtccagtctggtttcccatatcttccatctttcctatcccaaaagctatggctataatctcagccaggtttctggaaacaatcctcgttgaagacagatgagatttaaggaaatctagtcaacatctgcagaattgatatcaaattaaacatgttctttttttacctaagctctgattttatttccagaggttttgctttgactctttgaccaaattcccttcttgaatacagtttgggtaactagacactgagattggcattgttctctgttcttgagttccagtcttggatagctgcctagtaaaatactaaggctaggactgtatgttgttcttaccaagctctgcttcttcctacagaaagaaaagttaaccacaaatctcagaccaattggcctgctccatcatttaatgatgcagctgcctacatcttcaaatattcatgaaactaaaaattctccaccgccccactcttccttcttcttagtacacctctatcacgatgtattggattactctatctcattttcaatacctgtgacctttctcattttattcatttattcaacaaacatttatggagtgtctcttgtatgtcaaatattgtgctaagcataggtgcagatggtaggaatgaaaaatagttatactttaattcctgaccttaagggatttacagtcttgtgacggcaacagattgtaaatggtacacagataaaaccgtgtacttacaaggtgagaaaagcatcaggaaggaaacacagaattacccagtttagtcagggaaaagttttctggagaagtaacattatatctggagatttgaaggataaaaatgaactagcttgcgaagcagtggaaaaagtatttcagacaaggaaccagcagatgtgaacatcctgtaaaggctcgggaaattggggaaagtaaacagagatcagtatggctggaatatattgagggaagaggaaagctgattaaatgagaaaagagaagcagattgtacaaacccttgtgggccatgggaaagcattttaattaaaatataattgtaatgagaggtcatgtttttaagtgaagaaaaaaacatagttttcatttttaaaagattattctgctgagttgaaaacaggcattcaaacaaagacatgtatacaaatgttcatagcaacatttttcataagaaccaaaaagtggaaacaacccaaatgtctatcaactgatgaacagataaacaaaatgctaaataaccatgtaatgaaatattatttggccataaaaaggaatgaacatcatgggttaaccttgaaaacatgctaagtgaaagaagccagacacaaaaagccagaaatacatgattccatttaaatgaaatgtccagaataggtgaattcatagagacagaaatagattagtggcttccaggggctggaggatgggcatgggatgtgactgcttaatggatgagggtttcttttgggggtgaggaagatgtcctgcaattagacaccagtgatgcttgcaaaacattgtgaatgtattgaaagccacttcattgtacacttctaaaatggcaaacatgataaattttacattatgaaaattttaccttaataaaaaaaaaagatcattatttgaacaatagactactttgcaagagagaggggctagctgctgagggagtaatctccatacatggacaaaagcagtaacagcagagaccaagaaatggggaagatccactgtaaatttcacaggatttgatgatgtcagtaactgaatcagggagaaggaagcagagaggaaggaagacatccagaattactcagaagcttctgaatgaaagaagaacatgtttcaagaggaaatgaagggcttagctttggactcattaaccttgagatgcccatgacccagtctaggatatcctatgctaagacacttccacactttagaatattactttaacttttctaaacttcacttttctcatctacaaaatagaaatattaatagtgtctatctaagataattgttgttagaaagaagttaggtaattgatgtaaagtttttagcacagttcttaacacacagtagaccctcaatcactattagagattattattgttgttataatctttgttttaattactatacttattccgtatgctgattctctgttcccactttcagcttctgcagatgcttagcccacccaaaagggctggttttgaatgaagtttcaagccctcccaatttgctccattttactgcagctaatgagtccataactagtcataatctcagatatattgacagggagggacctgtctggttgaaaataatattcatattccttagccaggcaagtatattcctatggtggagaaggcacactgagctccaataaccgtatgacaattttacttttaaaagcatccaactcactttcttctaattttatgctttcttgggatcctcctatccttaattttatttccccaagctttctctcccacagggattaaaatgtgctgacaagctgacaggagtattccagtctacttggcagttaacttcctcatagagacgtctaaattgatgttctggtttataatcagactcttgtaagtttggtcagaagggatcaatttgcctgggtctgttaacctctaggtgtccacataataacccagtttctgaacctgaaagctgcatatcagaacctgggcaatgaaaagccaacaagaaatgacacatacactgtatcaccaggctagaaacagccactcagacgtcacaatacaattttgtacagaattgtgaatattaaggagttaatgtatattaaagtgcctggcacatgttagactctcggtcaacatgagtttattttttattttttaaatcatatgcaactcacaagggaaaagaatccaagtctgaaaaatttcagatgaactgaaatgatcctacactttttgtgctccatctcagtcaatccctaattttcctttctctgaaaaatttcttttttagtgttttctcatttgggcagctgccttttgcaattggctgtctccatagttcatcactcaataatgcttaaagaaagtattagtgcaaatgaaagtgctatctgagaataatcgtatatattctgaggaataattagctcacaaaccctgtgatcttgggcaagccacttaacctttctacatgtctgtgtctcattagtcagcaaacgtgcctcaccagcccatcctataatgtctcttagtgtcctttccatccctagtatctgtaaactatattcactactaaattctcagcacttagcacccataggtgctattgacatatatgttgaatgattgaatgtatgtattttaggcctatatttggttcacaaatctcataaataagccccatttttacaataaagaaaaggaaaatcagtcactaacttgctttacacaaaagtttaaaagttctaagccttaaaaaatataacggcaaaaaaatatataggctgaaatttgaaaacagactctcatataggcattctatatgccaacctcaacatcatataaacatatatgaatgaatgaatgtatctatcgattgatcaaaacttgttgaattttttaaagcataaattgtatggctggtttttttttttttttcatttgggccctttttcccacctctgaatgcccagagagcattgttcacaataactaatttaacaaatctatccttttggagtgtctgttgctttaaagaaatgatgacactcttcaacactgattagaatcacagtacctaagagaagctcttttattttttggtggcatactttctagaaattatctttggctttttagctcaactaattcacatttgtggctacaaaacaattataaatgataacttttccatgctttcacctttgttaataaacggtttaaagaatgagggaggtttttttaaattccattttaatctatcgttcctgacatttaacagaaatcaggacaccagttcaaaaattacgtaccaagtcaaaaatgaaaaacttgagcttgcagaaaaagttgtgttgtcttttctaacaaacttcacattttccaaaaaagaagtagactatatttctgatttcttattttgttcttcatttactcaccatgactacggcatgaatacaattatgtatattttctatactacagtttctctcagttcaattagttcagtttcacaagtattattgactacctattgggagccagccactatgctaggttctaaggagtacaagagtaataagacatattttctaactctcatgaagttcacatattactaaattttttcattgttttttcaatatctcagctgccacaaccattttaatcaaataattttacttttgccagttttatattttgaggtttaatatataactgctttaatatttttgaaaaattactggtctgagggaagctagaaaaatttaagtaattacaatacatcatcattcaggtaataataaaagcattgtcttaccctgggttccccagaataccaagcctaagacacaaaaaatgtaacttaaggtccagagctagggaatgggggagaagggaggaaagaaaggtatgtcaataaaagattccatgttgagttgactggtcacccatacagatggctggatattcagtcttacaggacaccttaataacctcttagagaaagaaagtatgaagtatttattcattactgttgccttctattgatcaagggtggtcccccaattattcaactccccatcatttctaggttgcacatgcatggaatactgagcaaaatctcagggatgttttattccctactgcttcactaccagtaaggaatccttgtggagcaggaggaggaggaggaggaggaggaggaggagctaggggtaaattgcaccagcctgaagcagggcactgtcaggttgctcccccatgaaactgggcggcactttcatagaaatggtcaccacagccacagctgggataagagttgaggccaacgaaatttgaagccgtgtgtaagaagcatttgataaaagtgtatgtaaggcacaaaagtagaactgaatagagagtgattaattctgtctgcagataaagggatcagaaacttcacaaacaattcctcagaaaaattattaaaagtaattgaagtatcaggctgggtgcagtggctcatgcctgtaatcccagtgctttgagaggccaaggcaggcgaatcatttgaggtcaggagtttgagaccagtctggctaacatggtaaaacttcatctctacaaaaattagccaggcatggtgatgtgtgcctgtagtcccagctactcaggagtctgaaccatgagaattgcttgaacccaggaaacagaggttgcggtgagccaagatcacatcactcattgcactccagcctgagcaacagagtgtgactctgtcaaaaaaaaaaaaaaaaaatgtaattgaagtgtcagatgccaaaaggggattagtagtccagacagaaggaacaatacatatgacacagatgtttgaaacaacaagatacatttgaagaaatgaaagaaaattagtacctgtattcctggagttgaagaaacagtagatgtggttaaagatgtaaacagagcccaaaacataatggatttgataagccatgttaggagtttaaatttagtaccagaaaaaaatggacagtcatttgagtggttttaaacaaaaatataaatttagggtagggtgtaaatagaattatactaataaatattattatggaagtaggaaatacaaaaaaataagatactgcctttaaatagattcagttatgttaaggatacatattattagctctagagtaaacaccaaaacacaataataaaaggtatatctaagaagctaatagagaaaataaaatggaacacacacatacaaattcaaccagctcataagaaggcagaaaaaagaaagagagaaaaaaatagaaagacagaatgaaaacaaataaagacagtacacttaacgccaacatttcaacaattacattaaatgtaaatggactagacactccaattaaaagtcaaataaatgcaacatggttgaacctcacagatattgtgccacatgaaagaaattggacacaaacaagtacatactaaataatgttaatttatataaaagtttaaatcagacaaaaccactttatattgataaaaatcagatcagtggttgcctgaaaaactcgttagtgcaagatattgacttcaaagatgtaagaatgagctttttagggagatgaaaatgttctatatcttaattggtttggtggctctacaaatgtatatgtttctcaaagtcattgacctgtacactttgaatatgtaggttttactgtatataatttatacctaaacaaaattgactaaaaaaaagagcaaacaaacatctctcaagttcctgacttgaatgaataagtggtgatgatggtgagagtagaggagaaacagaatgttttggcctcacattataggtttgtttacatggagtgcccgttcaaagccaagccattatgctaggggctggaagagcaaggataaataagacacaattccaatttgtgtctcttatttataataagacacaataccaatttgaagggtagtcacaaagtctaatgcagaatatatgaaaacaactttgtttactacactatgggaaatgttccactagacttatggacaaagtgctgtggaagacagatacttcatgtaataaaatattaaaaattctccatcgttagatgaaaaacaaatatttgtatatccacacagtagaatgttatccagcaattaaaagaagcaaaatattaaacttgcaacaacatagatgaatctcaaagtaatagtgttgagtgaaagaagccagacttaccttcccccaaaaaagtacacattatatatttccatttgtagaaaactctagaaaataaaaactaatctatagtgatagaaagcatatgagtgatggtgtagaaggaggaggggatggagagtgatggaaaggaaggattacaaaggagaatgaagaagtcatcagaggtgatgatatagttattatttttattgtgatcatgatgtgaaactttttctgacccctcttcctccaagcaaaattagtcacattgtattttgttctactgtgccctatgtttgtttcatgggtaatacatacgtcaaaacttactaaactaatctaaatatgtgcagtttactgtagccaattatacctcaacaaaactatcttaaaaacactgaaaacaatcttggaagatgaaagagatatattatgttatagctgcactgagtagcatatgatctacattaaaatctaaatttctaacattaaatataataaagaaaatattcaagttggaataatgatattggcaagcccccactgagtgtttactctgagacaggcactttgttaagtcactcacttgcatcttttcatttcatccctgcaacaaccctatgaagtaggtactattaacattttcaaataataaaagaggaaactgaggacatagagttagaagtgtgttcacctgtgagtaacagaaaaaccaacttcagggcataaacaaacaatggctgttattcttcaaaaagtaaaaaaggggattggagataggcaattcaggtctgttttacctactaagtaatttggacaaggacgggtaggctgtttcttttgctgtccccacccccacgcacagtgtactaccttcctcatagttatatgatcgctgctatatcttctggaatcacaggactccaggtaaaataaataaagaaagacgggtgatgagtacactaatagccaagacttcaccactacacaatatatatgaaaaagtgaagagaaagaagacataagggtcatactggctgaatcccctagcttcctcaggggttttacccagcaggcttttgcctatttgtcattggccagaactgtgttacatggtcacccctaactggaagatggctaggaagaaggtgattgtagatagaagccagagcagcaaattagtaatttctgccattgctactaagagatggagtgagaatttggtctagccttattccccaggcctgtgctattaaccataatgttatacgaataaagttctccataaattctccccaaagccatcttaatatgccaagcaaaaagaaaaaatttcatccagagaaacatggatttgacacagtgtaagtgcatagggagcatgtagatgactttttagagtagcattattttcttatctaatgcaggcaacattgaaaatgtgggagagaaaggaaggagtgaatacacagaagaaaggtgggcaatggtgacctataacttaatttcacatattttccatctaatagctctgtctcttctgtggccttgtgatagagcaccagttcctgaatgtctcatctagaaagttctctggtgctttgtcagggtaattttccacattctacaagtgttatctgggtataaacaggaggcaaggtagtttttaaaacagaaaacaaaaattatatggttcatatttagaagacataaatattttcaaaccactggctattcaagtcatttccactatgagattaagcctatacacatttacactgtagtatacttagtgtctgtccagtattttggtcaattagaatttatgtaatttatttgctcaatgatccaatagatagaaaaagcattttgtcaagtataaaatattatgtgagtgttaatggctatttatgactatattagaatatagtttttggtcagtgagttgaatattggttaagaatccactttttcaatctaaattattaaagattgattatatattagcacattccaaaaacatacggagaaatccacagccatttattgagcatatactatgagtcacacattgtactgggttcagaaataaagcatagtaactatactataaaagatcacaatctaatgatgacaatttgataactgctacagtaaatttatgtaattggcacaacaaatgtccttctgatttctcttccctctgcatttttaacttttattttatctttggatgtaactgcaaggtagttgatcaagatgataaagtaatagcaagaacactgtagagtttacacctgagagatttagaaacatactctctaaattttttattatttgataaaatgtaaaacaaattttcaagttacttgctaggacaaaacattgccaaagatcaagtgtgttggttatggagacgtgtcaataattttctgctggagattcaaactgcagcctagaaactagcacagccatcacgctgtactaaaattgacagacgtgagtattcaagcacagttcactgctttttgtcatctacatgcatagcaagtacacaccgttgatttgccattccactcagagaagaggaaaaactccacactaccttaatatggctgtaggttggttagctgctttttaagaagaaaaagtttgaagatcatattcaagaaaatccccaaacttttatacagaactacaggaaatgaacgatgcatcattttctttatcaacaacaactttgcgatattttgatgtaggccctgagacttcaatattgagtcattattataaaaacaacactttccgacctgagaaaaacatatttatgtagaattaaactcattcaaagagaaggaaagtgcagagtgatcttggtcacacattcttttcctcagaatcaaaacaggtaaaataacttattataattattaaataaaagtcataagcttactgatgagactcaaacaagattccaaaaggtctcagacagtagccaacactaaatgcttcttgaccatctgccacatttcaggcactgtggtagaagtgcagctattgacttgctcacaagaagcctgttatctactaagaaaagtcttattaacatgaaaccatgaaacaataagagtatatattcttaaagtgttaagtggaaatgtacaaactattagaaactacagtttgtatatctatatatacacatatggaaatgatatatatgtaattgttaaagtactttatatatatatataaacagttcctaataggtactcagtgtctggctcagtcaagcgtaataggaaatcatgatgagcagtaaaggaaaaagaagcagaactggaatagggtgttaaatgatttacagaatacaaacaagaggaaagcagaacagcctaaatgctaggaactgcacaagcaaaagcacagatctggaaatgcaccatgactgagggaattggctgggacataaaaaggaaagctctggctatcatggtcagttagcaccaaatattggatctgataatatcggatagttcacttggaagcactgagtagtatattgagaactttgcatttcacctagtgagcaacaggcaaaggcagtatctgaactgggatgacatttcattcaagatttttatatgcactgttcacagtacagagtatatgcttcttgcatacacattcaaatgtttatcacatgacatcaaaagcataagcaacaaaagaaaaactatataacttggacttcactaaaaatttttaaattttgtgctccaaatgatacaatccgaaaagtgaaaagacaacccatagaatgtgagaaaatacttgcaagtcatatatctaaaaagagacttgtatccagaatatataaagaagtttataacttgacaataaaaaagacaaatagccaagtaaaacatgggcaaaggattggaagagacatttatccaaagaatatatacacatggccaatagcacatgcatagatgtttatcattagtcattggagaaatgcaagtcaaaaaccacactgagatatcactttacagccactggaatggctataatcaaaaagatttaggcagtaacaactgttggtaaggatgtgaagaaattggaaccctcatacattgctgatggggatgtaatgtgattcagacattttggaaagcagtttcacagtttctcaaaaaggtagaactaccatatgatacaacaattccactcctaagtatatacccaagagaaatgaaaatatatatccatagaaaaacttgtacaaatatgtttgtagctacgttaacaatagatgtactgtggaaataacccaatgtccatcaagaaatgaatgaaaaacaaaatgtggtatattttcatacaatggaataatatttagccactaaaagtctgaataaagtatccaaaataggcaaacctatagagacagaaagtagataagtggttgtctaggattggcaggaggttggaggaatggagagtgactgctaatgagttttgggtttcttttaggggagacaaaatcttctaaaattatattctggtgatagttgcacaactctgtgaatatcataaaagaaaaatgaaattggacactgtaaatagttgactggtatagcatgggaattatataaagcagtttttacaaaagtacactttaaaaattgcctggtttctaattgtcccagtaaagttttgtctgtggcagatttggtcctttgcctccctgtgccccaagactcagccagtgcctccagagatggaagaagctcagtttctactcactgaaacaggcttgtccctgaaaaagatgtttattaatcacctattacgaatcacctactatatctgcaaatcagttgacattttactcagatttctaatttagttaccttttaaaggtatgttttcagtatataccaataaataccaataaatacattaactatgttgataacaaattatgtacctcatcctatttagctacatctgatgtaaaagtcctaataataaggttaaaaactacctctgattaaaactacttctcgccaagactcccattcatgtgtccacagggtaattcaacactttgccagctatttagttgtggcttcttaaaggaaacaagatgtcagtctctattttcatggatcacttttatctgaaatcttttctctgcatgatacaaatttactagaatcataatctgtcctttgtaatatgtcaaaaagtggagaaatcaattatgtgtaattatacatggagtctcccagtatactttcagagcttattattagtaaatttcatgacaaaagaaggacaagaatagaaatatttcattacaaagaaacgaggataaggtagttgttttttcaaattactcttaccctgactttttttcatagtatttaatacccactggcatactttacatgcatttgtcattttacttttattattgtctgtctcttcccagaggagtacaagtactatgaggaaaggaactttggtatttttcactcctatgtcactaacacctataacattcaatactgtaggtcctcaatatttcaatatcataggtattcaataaacactgaatgcatttaacatttaggaagcattggaagagtcctacaattgctggctgaataaaattaaaaggaaaataaaatgcttttacattttaactattttatctcacaaaatctctccaacatcctgataaccctatctctactgtttgcagaataagagttggcattttcaacttggtcagcaaacatgtttgaggttatcattcactgttaaactatggttattttaaattcattgtgtattattattgtaatttaccatagagtgacagttataatctgatttgcattggaataagcaaaatgagaaaattttatttgaagatgcagttgtactttttatcaagccatcattaatgtaatattttttgttataagaacacaattttgggagggagggaggaggtaaaggagaagaaaagataactattgggttctgggcttaatactttggtgataaaataatatgtacaaaaaaaatcctgtgacacatgtatacttatgtaacaaactttcacatgtatctccaaacctgaaataaaagttaaaaaataaatttaaaaaattaaaagaaacacaattttaggatattttgataaaattttgatgaactccttcttggaggtagtcatataagaaatactagtatttcccagattttttattatttgaatttttttctaccccagatccatcagcactcctctatggaaaatgtttttaattcttagacttctttcattttgtttttagaaataaacccaaaaactatatcaccaggttttctacaattttcttattatttttgtaagtgagaattttaaagaaattgctaagataatataatttttaggccaggtgcagtggtttacacctgtaatcataccactttgggaggctgaggtaggcagatcgtttgagcccaggagttcaaggccagcctgggcaacatggagaacccctatctctataagagttacaaaaattagccgagtatggtgacctgcacctgtactcctagctactcggggggaggattgcttaagcccggagatggagtctgcagtgagacatgatggctccaccgcacttcagcccaggtaacagagtgagacgactctgtcacaaaaaaatatatataattttcgtctcttaagtcttgagtaatttttccttaatccttaccttatgccaattcaggatctgtatcctctcacagtctctctttcaaatgggtgatcacttatctttcttagtggtctattattttttgctcctatactctgttctagctgtcatgataccatagtaatcctcaatatgtgaaacaactcaagaaacagttcaaggaaaaacactgacatttttacaaaaacacttgtatattacacttcaaaagttttggtctgcttgaggttagtttgtgtttctttcagctactgaaatgtttcttaccttttctctttgatacgcaatcattacattctgtggattttaaatatagattacatatatcttaatatcatcataatgtagttttatacaagaactctttataaaagtatggatataaaagaatccctcctttggtaggaaaataaaagaatttgggatgtaaattgagtttcacagaaaatctcaagaatagttttgttttagtgggaaatgtaaaactaaattaagcagttacagagattaacagctcaggacccatttccttactagcatattaacactgaagaaaagtatcagaagatgatgaaaagataagggtagatatttttttttcaaatgagtaaatgtgtcacacctaaacaagaaagggtcttattcagaaaccattctgtaaaacatgtactttgtctgctctacatactctgcatgccaaaatcttggctgaaattttctactgtatcatcccagttgagatattatatttaatgccatttagaaaaattatttttacatattatttttaaataatagtaaaaaaattcagaatgactaaatgaataccttaaaataaattatacagatagctaaacaaataatttagaacatggttttctatactgttctagaggaacttacaagtctcctataaaagacaagccaagaccgtggtcttggtatcaaatgtaaatgaaattgttatatttataagaccgcattatcctaaaccacataataagtgcaaataacatagttgttctattgcattatatattgaggcatttgactccatcagttttcaaacaggtgtctgaaaatcacacaaaaagcttatgatttccagctctgtcttaaagcaaatcgtaagaactgtcttcaaaaagttatattggaaaagattcatattagcaatagagaatatagggtaaaaactgaattatactgttgaaatttaaaatctgtagcctctagcatgtaggaaaaaagaaaaaagaaaactggtgtattacccctctctacatatttagatggtgacaattcttgccatcaatgacatcaaaacacattttcaccaaatacatcagaacactgtacaaatacacactggctccttgtcacaagttgcaatatgctgatcaatatcaaatgggctagactgacctgtgaaaacaaaaactactgtaatctactgtgctaaacccaaagaagcagtttacaggaaaattagaattgtttcttcattgggagaattaatttcaaattaagcattcttaatttatgtcgaagtgatccactggggtaaagaaagagcaaatttgattttcaagcattaacatcactatcaaaagcttatcaatttgggtatcatgattttgagaatgaatcaccttcctctcataagtcccccaaaaggattttttttgcaatcgtttttatttttctactcagagaaaagctttgtaattaattttacataatcaccaaatagaatgaataatctggctctttacctgagaagttaggacccatgatctttaactccatggcttctgcaaccctgatttatttatttactttttttttaatttttatttatttatttatttatttatttatttttcgagatggagtctcactctgtcgcccaggctggagtgcagtggcaccatatcggctcactgcaagctcagcctcctgggctcacgccattctcctgtctaagcctcccaagtagctgggactacaggtgaccgccaccaccaggcccagctaattttttgtatttttagcagagatggggtttccccgtgttagccaggatggtctcgatctcctgacctcatgatccacccacctcggcctcccaaaatgctgggattacaggcgtgagccactgcgcccggcctatttttatttttatttttaagtcctggggtacatgtgcaggatgtgcaggtttgttacacagataaacatgtgccatggtagaattttaatatctgcaaatgacctagaaccattaatgttgagaatcagaaaataaatgattagaaataatctataagttgttgaccattacaaacatttatctgaagtctcttccccaggttaaacattaatgaggttgcctgccccaaaaccatcactatgccagcctacttttcccgaccataactggtgaaggagtcttcaatctattttcatcggaatattctcacattaaattatgctgaaaacaaaagcattcgccttattggaaggatgcaaaacactgattagttcatcctcaaaatgtttaacaagatctcagcaggagacaaagagaagtctagagagaacaatcaagctcttggtaaaacgaaaaattcagctagcctcacaaaactgccactaatgcacaaagttataacagcagcagttaattatggccaatgctgtatcctcacgtatggtaacaaaatttataactaaaatgtatctatatcagagtcttttgtagaagtgggataattctgtaaaggggtccttggcagaactattcttctaaatggccatagccatttccatttttgccacacatatttctttctccttcactccaggcagtaatgtagaacaggtgagcagtctttggtatcagagccaggttcaagtcctagtttttcacttactcattttgcaaatcattttacctctgatcctcaattcccttctctctaaaatgagggtaataattcctgcctccaggagccattatgagaattaaatagtacaatttatgcaaagtgtctgacactgaaaagctaccaaataaatacaaaatgcttttttacctggtatggatagacctttataggtaatgaagtagcatctgaaatacaaatttttaaaatcctagttggcatccaaaacttattaatattgaaggtgttatttttcacactgatgtattattcaaatgttaaaaaagaaaaaggaaaacactgctgtctttaaatagcatacatttcacttcaggctatctgtttataacaatgaaccaggaacattatgcagtaataaggcagttctgaaatcaatgttggaggctgtgagaaccaggaggaaatggaatgccacagcaccagaggttattgagactcagtgcccaatgattaaagcacaactcatataaaattaaaaagaagacaaattattctagtactagctatttatgataaaaatacacgtgtggcaccacctcaagccagtttataacaactaaaattctatgagatttagaaatcattttgatagaatgaaattatcaatactaataaaaatatctatctttcaaaagaataagaatgagtctgtgaaataaaaggccagttccagctgcagttaaagcagaatatgtgttatttttgttacagcaattttaagcattccttcaaaaataccacacaggcccaaagcttcagtaccagtatgaaataaatcatgctgctaaaaggtaaatatttttattatctctaacaactttgtgttaaaaccattgtgaaaatgcagctagattctttaaaaatcactctcaaacatgtatatgcatttgaatgatgtgtaaattatgttactaagttggttttatacaatgcagagcacagcagaaaagaaaaagatttcactcaaaaagttgaactgacaatgcatttatctggctacagccaatgaaagatttcagcacaaacgtaaataaatggtctttacatgctctaaaagtaataaaaataacaccttatgtttatttaatattgaaaacatttgaagcccctcacttaatcttaacaattctgtagcatacgtattatcagtatctgttttactgttaagacaactaaggcaaaaagaggttaatcaacctgtccaagatcagaactgtaagtggaaaatctggatttcattgtctgactatggatcccccacttttatctgttacattatgttactccatctctgcttcgtattttcctaatccagtagtggatagcaacgttgactagaggcaagggtgggtgctcaacctatatgatctctttcagcctccatagcctaatgatcatgtgatcttagaagtggattatttcagacagagccatactgcttctgcaggtgtttgggtatccctggtttcctcagggataactttttgcactttttccaaaactaaatctgaaacagaaaagagagctactttcctatgtacagctcccccacatagatgacaacctcagaattcacccagaagatagacgtcctgtcctggcattagaaccttttgcataatttgctaagcagaactgtctgacagtagccaaacagtaatatgcaaattatattactatagattatgagcaatgacatcattgttaaaagaacagtgagaaagaagaaagatgagattagagtatatgaaagcttcagagtaattgctaattccaaagccataaaaagcaaaattcatataggatggcctggttcaatattgttggataacaaaagaaaggaaatggacctcagggtaaattactaataggcaaaaatgtagataactagaagtgtgtgataccacttctaccagtcactaacagaggagacagtgagagttggcctttcacggatgtatgaaataaagcaaatgcttaagatttagggtctgaaaaagcaagtaatatgctagaatcattctaaatacgatttaataaggctaggaaggggaacaaaggccagttacgagattatttaagcttttcaattcctgagattgttgttttctgaattaacttttttccacactgatattcaaggaaggagaaaaatagaacacagactacttattattggaagagcaatttctctgaaatagtagctcgtaacttcttaatgtgtagctattgctaccccatggctgcaataatgagcacagacttctcggcatatagttaaatacattattagtgactttccccactaataatgctaacttatgtattggtgcctaagaaattggcaatgtaggaaagcagtagattttgttttgtactttttttccatgcaagaagtcttcacatggaaatcagcaaaacaactgttgtgactatagcagtaaattagtttaaatagaaactgtaacgtataatttgtgggcactaaaagtctttcagttacactcaaggatttattatcaataaagaatgattactttctattttttaaatgtttcccattaaaaatccattaggaaactggtaccaaaaaaaaatcaggataaacccaacacataacctccaacagatttatacaattcttcaccaactctttggaaggacatagatggttagaaatagtgagaggataaatagaagatgaagcagagctccggccaataagctacctagctaacctcaattctgactggcccagatacaggaaacaggcctttttttctttcttattccctctattatcctccccactttgagagatttctcagagaatgaacttgtcctttgaatttttccttgcttttctattttccatacctctatctgttttttctgcctttggcaattcagattcttcttccatatttctcaaagtggccctctgattcttaatcctacgatccaccacaatgatgcagactgaaaaattaccacatccctgcaatagcgtcttccttacctacatcattctattcctcacaagaatagaacatcctaaagcacaacgttttctcataaagatgctttcaatttcccttcacagaggaatctaatggctcccatttgcttccacatcaaatccaaattcctgattatatgaatcatttatcaccaatctccatcaatatttatatgagcatctccttacaattttaattaatcctgtgtacatgtctgggtttttgtatgtacttacacttgcttcacataatgttgccttccctcacttaggcaggtaaggcttctcctgagtgaaccattcctcttcacatgccacctgaaaagggactgtgcttattctgtttcttccctaggaacgtccagccccatcactttatcttcaaattgacttcccttttacccaactcaaatgtcacctcctcctgaattcatccctaaccacccatcttcaaataacctttcatgactttaagcccaatgacacattcatctctaccttttttttttttttttttttgagacagggtctctgtttgttgcccaggctggagtgcagcagcataatcatggctcactgcagcttctacctcccaggctcaggtgatcctcccacctcagcttcccaagtagcttgggactacaggtgcatgccaacatgtccagctaatttttgtattttttgtagagacaagatttcacctcgttgcccaggctggtctcgaactcatgggctcaagttatctgccctcataggcctcacaaagtgctgggattataggtgtgagccacgaaggctgccctcaacttttcttaacaacacttaaaacattctattgaatgaattatctgttcagtagaacacaagttccttgcaggtagaattcacgtataactcattattctactctccatgaataatacctggctaacggtaaatgctcaaaataatatcagttaataggattcagattcaatataatgaaagaagtacttagttgtctgctcttccatctaatatttcattgaaattgtaataaagaacaaatttaacccatggtatctccatttgagttgctcagaagcagaccttgagataaggattctataccacaagcaatttatatgagaggtaatgccaggaaacactaatacaggagaggaaaagtgagatatgaaatgcaggagattcaataaagggctcactatcaacagatcatttggcacctggtgcttaattcagctaagcaactcggaagccagagtagaacatgcaactcaaagttatcccaacagaaggaaaaagaagctgaggtgtttgttcaccaattcctactagtcatttgttgaaggctgatgggaggggacattctctggctccaccagactgctcatggacaggtagagcaagctctacatccagacaggaccttcaggctaagagctacaggtgctggcattgaaaaatgggatgggtgctgaaaaacggggagcaatgacaggatgtaagtaactaacagaatctactacaaacaataacagaaagaaggaaggggcccacaagtggatgtgaatttgaaagacaaaatactgatggaagatttatgactgagaagtgaacgaaacacagaaatacacagaagaaatcaaaatacacaaagagaaaggctaaacctcaggaatggtggtaggtgaaagaggagggttcaatctattttatggaatccccatctagataggattgagactcagaagttgacagtgaaacatgaggctgaagagggagggactgatgcaagtctgttttgcagagactggtatactatatcccaacacctatttttgcagtttttgtggttttaaagcattgtttataaaatgagaatttgtgccagaaactatatgtagtttgcaatgcctaaatttttactatctggctttcacagaaaaaaatttgctgacccctggtttatggaatagaaagcacacatactagccctttcccacccctggaagtaagactgcctaaaaccaggcacttaacactgaacgaaaaaaatgtgggctatcttctctgatcatactagaaaaaaataagacagtacgttaatgtgctaattaaagccctcctcatcctagtaattagggattctcaggcttaatgatcagtgccctagtcatgaagcaaaaggcagaggatgccggtcaagaaacatctcccgtacccagagcccccagtcagtttcattcttccagatggacagcccacccaaatcactaaatgtttgactaaagccagcaatatgaaagagaaagatataaactagtagaaaaatggctccaccacaagcgctaataatccagaggatttaagagtgcttttgaaaccctcaaaataatattctcagagacattcccaaaaatgttgactctgcaaacaggaaaaatatattatgaaaaaacataggtgaataagaaaatgatcttagattaaaacatataatttaagagaagtcttacaagacaaaaccagggaagtctcccaagacatagaacagtaaggacaaagaaacagaaaatatagactaaagaaacacagaggatatatccagaatgatcaatattgactaataaatattgagaaagtacatagaggggagatgattagcaaaaaataaatacagacatcccctgactttcaataggtcaacttaatttttttactttgccatgctgtgaaagtgatatacattcagtagaaatcatccctcaagtacccatataaccattctggttttcacttttagcacagtattcaaaaaaaaacatgagatattcaatacttttttataaaataagctttgtattatatggtgttgcccaactgtaggctaatgtaagtgttctgagcacctttaagataggctaagccaaactatgatgtttggtaggttaggtgtattaaatgcctttttgacttaggtgtattaaatgcctttttgacttacgacattttcaacttaaagtgggtttattaggacataactccactaagttaaggagcatctgtataagagaaaatagtaaataagtaaataaagttgttcagttgaaaacaaagataaagaaaagatcttaaaaacttccagagattaaaaaaagcaaagtaatcaacaaatgaattagaattagtctgatatcagatttcttatcagcaaaactaagtgctagaagacagtgaatttatgctttcaaagttctgaaaaaaatgatcttcaaccaagaaatatatgtccagccaaatgacttgatcaattaagtgtgaaagtagaataaagatctttgtggtttgcaagatctcattcattttatctcctgtgtacccttccttaggaagttaacttaaggatgtaagccataaagaaaacataagatccaagtaacagggtgatgtccatggaacagtgaaagtaagtctcacaatgacagctttggaatgaccctagagagtaaccagggcagactagacccagtggatatagcattccaggaggcaggtcttcagaggaaaaaaggaactgaatggattcagaactatgaaaagggtaaggatatgataaactctattagtgaagtgttcaagcagataattcattgggatttgaagctagaatattctcccctgagtggcagagaagtcctatataaaacctattgagaaagaagtataacttccatagaccaatagagaaggaaatatattactaacgcactgtgcctagctctgcagacatattatatttatcttgtcattttagagggaatattgtttattggcttagaacactgagaagtaccaaggtaaaaagaagtggaagaaagactgggagttataatgtgtttgtcttacaaagtggagagttcagaggtactgtccattgtcaatgaaataagaaatacagatttgattatatttttgaagtaccaaagttaatctgtaggaaaacagactattgatatgatcatatgtggaaaaagaggaatggggaagtaaagagtaatataaataaattcaggcttaagcatatcaagaagaaaatatggccaggcgcagtggctcacccatgtaataccagcactttgggaggctaaggcaggcagatcgcctgagatcaggagtttgagaccagcctggctaacttggcaaaaccccgtctctactaataatacaaaaattagctgggcatagtggcatgcacctgtagttccaactactagggaggctgaggcaggggaattgcttaaacccgggaggcggaggttgcagtgagcttagattgcaccaccgcgctccagcctgagctgagcgacagagcaaggctccatctcaaaaaaaaaaaaaaaaaaaaaaaaaaaggaaatagtatataaaggtactaaagcaagaaataatgatacatattaattagaaatatagatataacaatcccagctactcaggaggctggggcaggagaatcgcttgaacccgggaggcagaggttgcagtgagcagacattgcaccactgaactccagactgtgtgacagagggagactccatctcaaaaaaaaagaaagaagtatagatataactgccagaagaatcaaaacaaaaacagttaaacgttggccacctctgggggtagggaagggtgtggctaaggattgcagttttttattctaaattcttctgtattgtttgatatttttaaccacataaatttgttatttaaataaaattgcatgtttatcaatgcacagataaatgaaaatattccttagagtgtctccctcacaagtaatacaaaatgaatatgtttaaccgttgctgggtatcgtcctgactactaaaagtgacaatgattatacacagggagcgtaacccaaccccatataagctctattgccacaaactatgccgatttattgtatgaaacaagtagaagctactccagtaagtatcaggtaaattgtcacaataataatttatttaatatggtatacaactcaaataagaaagccagaaaaaaaaaagatatttttcctcctcctatgggagtttttgttgttttaagaaacatgtacaatgttttggccacactgaggttcagaaatagcacttgcatcttctacccgaatatatttatggcaaagataattatgcaccccatgcactgatgcactcaatgcatcagcaaatatggcaaatctgaagactgtcagcgaaagtctcaacttcttgtagtctcagctgaataaccttcatgaggtagcatttggaaaaatatttttttaaaaagtgaagaaagcaaaatgcatcaaagtcaacaccttgaattgcacctggaagcaaattgtggaactagaggacaaaaatataatgttccccctgtggcttatcctattaagaaataagccttcactcattttctgagttgcattttcaaaagctgctacaagtagactgcattgcagtaatatagttttaagaaagcaatgtggacagagagtccacattgatattatttagtaaatgatctaaaccatgctatttggctttggtgcacctgacttaagcaagaatgacctaatagcaaatcattaactgtcactaaatttgggatgttatcttctgtgacacctaaaattcatgcagttttaaacagatacatcttgataaaatattgacaataataaatatctctgatacttaactataagccagcagtgctgataaagcaaactgcctaatgatataaaagcagaagcaggtctggctcttaggcaaaactgtggagcaagcagctctcagcgacccacctcatttggagctccactcctaccagcaccctatagaccaagccctgccctctacagtatcacccaggtattatttctactttaccatatacatctctcctatatgtgattctgtcctctctttggtccagtcattagaagtattaagaccatattgtgggaatctaagtaatatgagaaaattatttcaacaataaaaggtacataagggagaagactgagtatccatttatggacttttgtatgcaacatgcttaagaactaacaggagtaaaacacaaaagggctggccaggtcagcttggtctgtaagggaataacagcagtacacattctactgggaaaataaacaaggacaatgaagaatgagagaagccttaggatgactctggaaatcaaggtccagtgaagaggggtactatcactcctattttctagaggaaacatataggatatcaaaatgcttactaaagttgagtcaagcagaaaacccaaaaatcattttctttccctaaaatgacttaatttctagatgctccacatttttaatagataatcaagtttcttaactctgtcacacatactttcgatgcagcctaatattaaattccctcaactgattatattgtttcaccagatgcttcccccacatgtgtcattatttgtaagtatgaactaaaatgatttcagactttaacactttagtttaatcatggggtaatacagggtacaatgtagaaaggaaaaaatttagcattttataatgtacttattctgatgggaccaaccaccaagtgacaaatgaatcatattattgactatgcactacatttgtattgatttggtgaatgtattgctgaatagttaatggtatgtcagccattcacttacaaatacatatttctaaggctgtcataccaagatataaaatatttcctaggagctggtaggaaatttagcgcagatcatgcataattctttaaaaactgtgtttttttaactccacaattgtttggacaagttatttagagtagtccacacttacactatcctacttaatacagagggtatatatttctattgtaataacttgttttgctgagttatatagtgcacaatgcaacccaaaaaatctgagctgaccttgtgtggctagattaattgacaaaagaatacctaaacagctgctgtgtggtgagttaaccataagcacattggacaaaatggaaatgtaggatacacgaagcctgaacaatgtcattaactatggactcctaggaaagtagaatgttgggtcaaccaacattcagaaagtaaccaggaatggcaagaactttttgaaagctaaaatgttggagagcttgtgactaagaggcataaatacaaacagcaccagaaatgtagtagccaaaatgagaacggttgtcacaagctattaagagctatgtagtacagaaaactgccaccctagctagacagatgtgaaaaacagctctctagagtaaaggtgggggcggggagtgggagagagagagagaaatagagatgaatgggatgtctattacagtaaaataaaaatatttttataaaagaaatagagatgagagatagatagagatagatggagaaatgaagatggagatgaagttggagatggagatagagatagagacagagagaaaccaaaatacttaaggttttataaatgttcctttttttttttctttgctttttgagaggaagtcttgctcttttgcccaggctggagtgcaatggcgcgatctccactcactgcaagctccacctcccgggttcgcaccattctcctgcctcagcctccgagtagctgggactacaggcgcccgccaccacgcccggctaatttttttgtatttttttttagtagagacggggtttcaccgtgttagccaggatggtctcgatctcctgacctcgtgatccgtccactgtggcctcccaaactgctgggattacaggcgttgagccaccgcacctggcctaaatgttcctttaaaaagagccattttaatctaagctatcgcaagtcctagatctgatgggtggtagagttttccatattataagtctatatgattcaacacaactatactcatttctgaaatccttagacgcagatctcatggtgcttagaagcaggggctgtgatgtcagactgcccaggcttgaatgctgcctctgttacttgctgatgaataaagagaagttaacctttctaaactgttactttgtttgcacaatcaggacaatactgggaattacctcacagaggtgtagtgaagatttacctcttcttggatgtctaatgggcatctcaaatccaaaatgtccaaaactgaattcttgatcttcctttcctgaacctgtttcttccactgtcttcccaatgcttttcccatgattcagagcaaagccctgcatctcattgactcttctctttcagacaccatatcctgttggctctatcttcaaaatatatccagaattcaaaacttctctccacactccacccctaccctgatccaagtaccataatccttgcttgggctatttcaacagcatcctacttgacctcctcttctaactcttgcccccacagtctattctcaacatagtagttagaggaatcctgttaaaatgtcttttctcaaaccattcattaactttgcatatttctcagaataaaagcccaagtctacaaaatcaggccctttattaactttctgacctcatctctggttgctctcctcctggccatgagcatctctgcttctgaaacaaacatgcgaagcatgctcccgcctcagagccttcgcacttattccctctttctgggcctttcttcttccagacatccagatgtctttaccagcgatttcagatctttgctcaaatgtcacagtctcggtgagcccttccctaaataccttcttaaaatgaaagaccaccacattcatacatcatactccccttcttccgtttatgcctttatttcccctcataaaactcaccaccatataacacactatatgttttatttattaattttaattattttgtgtcttctccccctaaaatataaattctctgagagcagagctacttctctgtttgattcctcattgtatatccccatatcctattgtgtacctattctgggacattactgagttcaataagttaataagtacaaaacacctaaaaatgtgtgacacatactaagtgtacaataaatgttagttgttgtttactcaggatattcatttatgtaatttctcctagtttttaagtcttcccaatatatactgtgattataaattacattagcttcaaaacagtttgtttcttaatgtttcacttttgtctttaatatgaaattaatctaacattaaaaactcatgactatcaagctccaaagacattctctaaagatgatctgctaaaaactagtttttaatagcttttaaataaatattttatactccttaaacaatccataaatacagtttctatatttttcccaagtaaattttgagtaagaagaattataaaaattagtgatatataatttatatatggttctgtattcattttttatgattccttaaaagtttcaagctaattgagtttaaataaatagttaaaataatttcactcaagctctgtgattaataactgaaatagcacaaaaaaacatctaacacaccaatatttttctcttgtcattctctttaccttcttaaattccaaagatagacaaatagatgattgatagagatagacagatgattgatagatagatagatagacataaaatagaatactattcagtcttataaaaagaaggaaatcctaataaaactgaagtgcagtgtgctaagtgaagtaagcccagcatagaaaaacaaatattgtgacctcatttatatgtggaatctaaaacagtcaaatttgcagaaacagagcatagaatggtggttgacaggggctgtgggggcaggtgcagggatggggagatgttggtcaaagggtgcaaagtttcagttagacaggataaacaagttccagagctttattgtacaacatagtaaaacatagttaataataatgtattgatactagaaaattgctgatatagtagatcttaaatactttcaccacaaacaatatgtgaggtgacagatatgttatcaggcttgatttaatcatttttcaatggatatatatataaaatatgctgtacactgaaaatacatacaatttttatttgtcacttacaaaatcatctgtattgctaaattcagcatttaaaatatgaaaatattagcatacataatctaccatatgtactaaaatggaacatatattataaatattcaaatcaataatagtaatatggattaaaagctggtatctttgagttctaaatgctcattattaacctaataattaaaatccacagtttaaattgctgaaagtagaggtttcagtcaggaaatgaactctgaactatgaccattaattaaacaggaaaaggagttagttataatctgggaaaatgtgccatttggatgactactgaaggcattgcagaattaaaggaaatgcctttgactaatcagctgaacttgaccagaacacataaatttaagtcagttatctgggcatggaggcaaacatctatagtcccagctacttgggagactgatgcaggaggatcgcttgaactgaggaattcaaggctgcagtgagctgtgatcacacgactgcactccaacctgtgtgacagagcaagactgtctccataaataaataagtaaataaataaacaaaatgtaagtcaggagcttagaataagttataggtccctaagcaaaatatttcaagaggactctcattcacttccctacactaatatattccttttcagtatgaattctaaatggatagcctttttgcttgaacccaatgcatttaaaagacccctttcctactaattacacctcttgcaggagtcatatgaaatatattaagatctaggaatgtttttgaattgataatgaaaaaaggtttctcaatagataaggtttagagaagacagaatatatagaagaacaaatctgaaatgattctatagattttcctttaacaaagagagaggatttggagaagacaaaattcaactatctacacacacacacacacaaactagtcagcctatctgaacctgccaaccaggagattttttaaaaaagtaattcaggaagataacacaaatggtcagcatttaagatctcagatcaaatttttggatgtttttaataattcagcatgtaaggagcaagcatagtattttccatgcatatttttactagttggaaattgttaactatccagtgagcatgtctctgtggaaggactcacactgcataaaatctattgataaaatattaacagcagagagtctttcatttaagcacttctcaaaataaaaaataaaaaaagactacctacagcatagaataaaaatattatatttttagcatcaaaagatagaaatctaattcccagatataatattagttacaaataaacaaaaaataaaaataaaaaagcaaaactttaagttgtaggatttacgaacttagccaagcagtaaaacatgcagcattctgaaaaatgaattaccacggggtgggtgtcccatatgactagctctaaaatgtgtggtttgagagtcaggtgcaaatatttgtgctgtcttatgttgtctcaaccacaaggtccatagctgcttgttcatggtaggaagataaactaagtaccacatacaaacaagtttgttagcagaaagggccataacactccaaagttggttcttctgaagaattcataggaacaaaacagaataatgagttagggcccagcgcagtggctcacacctgtaatcccagcactttaggggctgaggagggtggatcacttgagaccaggagttcgagaccagcctggccaacatggcacaaccctgtctctgctaaaaatacaaaaattagctggacatggtggccacacctgtagtcccagctactcagaaggctgaggcaggagaatcagtagaacctgggaggcagaggtcgcagtgagctgagatcaagccactgcactccagcctgagcaacagagcaagactctgtctcaaaaaaaaaaacaaagaaaaagaaaaacaaagaaaggaaaggaaagagggcccatatgtttagcataatgcacagggaatatttttttaaaaaatcaaaacctacaagatggaattagtgcctgtggagaagaaagatactttctttctcagatacctactatccataaagcctagctataaacacaagtcagaaagtcagaaatatcttaaggcaataaaatttttaaaaacaaattatgttactccattttgtccatttaaaaggcagacaagccagaccctgaaggctgatgaaaatagccaaattcaacatataatgacatcaatgatttaatcctttcattaccaagagtatcaaagaccattcacattagtagacaaaatcttaaaaaactggaggtggacctagaatttatattatactatatgatcaagctgtttccaaaaaccaaagctcattgtctaaaaattgaacatggagcctgttaaaattgttccttgtgagtcttggttgaaagaaatggtggaggtaactaaatgaactggcttatactcaaaaggcttaagccattatggtccactaggtaaaatatataaaaatgccaaatagttaatgtcactattaggaccaacaattgttggttaaagctgcattgtcagcaatgaagaatgtaattttagaaatataatgaaaactcttctatgataattcataaaaataatgtatatggaataagatgatgtgggaaaggggtacagtattccaaaataacacttgatcccaggtagtactgtttgatatttcttcccacaaatcctcagtgttggaggtggggcctaatgggaagtgtctgggtcatggctgtagatccttcatgaatgacttggtgctgtcatcacagaaatcagtgaatcctcactcttaattcccttgagaactgtttttaaaagagcctagcacctgcctctcccctctctcttgcttcctatttcaccatgtgatttctgaacacagcagctcctctttgctttccactgtgactggaggcagtctgagtcctcgccaaaaacagaggctgatgccatgcttcttgtacagcctgctgtgagccaggtaaacctctttctttaaaaattacccagcctcgggtgttcttttacagtaatgcaaacagaccaagatatccagttatatacaaaaggatactgagctttcacttccaggcgcttcaggagccacgggttacagtgcagacatggccaagtccaagaaccacaccacacacaactggtcccgaatatggcacagaaattgcctcaagaaaccccaatcacaaagatacgaatctcttaaggggtggaccccaagttcctgaggaacatgcgctttgccaagaagcacaacaagaagggcctaaagaagatgcaggccaacaatgccaaggccatgagtgcacgtgcaaaggctatcaaggccctggtaaagcccaaggaagttaagcccaagatcccaaagggtgtcagccacaagctccatcgacttgcccacattgcccactccaagcttgggaagcatgatcatgcccacattgccaaagggctcaggctgtgtgggccaaaggccaagaccaaggatcaaaccaaggcccagcctgcagctccagcttcaattccagctcaggctcccaaaggcgcccaggccactacaaagggttcaaagtagagatctccatctgccaatatgaggacagaaggactggtgtgacccgccctgcactgccgtctgcatagggctggtgtcctcctgtgctatttgcacaaataaatctgagggtaacactcctcccctacccccacaaaaaagtatagatttttaaagtctgaaggtatcaaggaaactttctaatttagcctcttatttaaatgaagcctttcactacagtgattttctaagtttataattcagaaaacagaatcctctcccatcatttccttttctctacaatttatctgctaaggaatctgggcccttcattattaattattgcatgagctggactcagtagcaatcaggaaacagcttcatttttctcccatcactgcattcagacattctgtcaggtctcccctcctctagccttgacagtgtctctttcagatttcttttcatgataacaattttgtcatccagtattaaaaagttcagtcttgtctaactcaaagcattaatctaatacttgatttggaacgtcccctcctgtcagctcaggaatgactcagtgtgaggggaagagaagctgtgagaagacataggggaggactctgttctggttttttatactcctttcttctctccctatcccaccctcaaccttgccctttccatttctgaatcctgggagatggcagggatcaaaaaaggagctaatttataactctcatttgactatcagatgccctctgtcatagcagccttccaaatattggatctcattaagtacatttgcagattcttgggagactctcaacaagttcctatgccctacatgtttcctacaatagacaatgagctctttatctgaccgctcagaatcacctgcatccctcagctttgccccagtagacagccctcttagggtcctcttgactcacaggaagtacaatgaacgtgcagcttgacaaactgctgactccttccttgttgccccacagtcaagggcagctctactttgttttctatcctttgtcttttccagaaaagaagcagagacctattattatcacactttgcttcaaattatggagagtcacatgtcagtttctctcaagaaaaaactcactttctgctcagctagatgcaaagggaaaccccactaatttttgcaatttggcaaacatccagccagggacagagatgacactctaccattttgtagatgaccataacctctatatgcagtactcttggggcttcccaacatgtgatttggtggtgagggaagcatctgcctcccttccctctaaaaaaagtctgaataggccaaaggcagatcacagaccagttggtggtccggccaattttcagtaattcctatggggctgggtcagcaccaatctctgaagtatggaggagattgtcactcaatgtcccaagctttgaggtctcaaattctaagacaagaggacatctcccattccacatgttcttatagattcaaagtggctttttaataaagtgtcttaaatgaaaatttatctttctgaattgccacccaactaactggggaggagagatccaaagtaaagggcttaagggcctcactccaaatggctctgtccctttacagtgaaactgtccttttgagcttctgtagtctagtctatgtggaaatggtgtaaggcaaaggtaattaaaaggttcatgaaagtaagagcagtgcagcactatcctaactgcattcttcctggtgtgaataaattaatctgtttcagtcactgcactggcaaactagtctaggtaccgtatcacattagaatataaaaacccttacacagtaaaagtggtaaatgtattctgaattaacaatgaattaggacactgtcagtatttctactagctaattagaaaagctagagtcctcatatttggaagacggattcactgacactttctttaggatttaggaacataaaatcaagccataaatactgtgtttgcttttgggggttttgtgggggtttttttgggatttttgtttgtttagtatttttgagactgagtttcgctctgtcacccaggctggagtgcagtggtgagatctcagttcactgcaagttcaagcgattctcatgcctcagcattccagttcaagcgattctcatgcctcagcctcccaagtagcatgtgccacaatgcctggctaatttttgtgttttcagtagagaaggggtttcaccacgttgtccaggctggtcttggattcctgggctcaagcaatccacctacctcagcctcccaaagtgctgggattacaggtgtgagccaccatgcccagtggggtttttacaatttctaagtaaatttaatgatcaggaagataattaatcctgcaaataacacataacttatctttcttattctaattttatacataaatatgtgattaagtagtggttcaaaaaagctaaactccatagccagaaagtcagaaagcctggttccacactcaaccctgggacttcctggttgtataattttggacaaatcacttcatctcactcagccttggttttctaatttgtaaaacagcaatgatttaagaaaatttgaaaggttgttatgttttgtaaagggactgcaaatcactttgtaaatattagttttctctctctttaaaaacacacttttttctggtagatcacataaactgaatttatctgaataattaggagcatagtctttaaagtcagacagactcattaatcatccaatgccagtaagtatttgctgaataaataaatggaatactttttcagttttatactatatcaaaaaccatagtcaaattatgcatcctctcgaagcctcaatattcatgtatgtaaaatatacaaaaagaatacccacttcagtgattctcaatcacagtacatattaaaaaccaaacagtttctgattcagtaggtctgaggcaagacctggacaattgcatttaaacttcatgagtatttggaaactggcccacagctgagaaccactatgctccctctgagggctgttgtgaggattaaatgagacaatgtctgaaggcatttcatgtattagcacatgtttaatacatataaatatatagattatacccttcttttttaacaccattttatacatatttattcagtaaattatataatacatttaagaattaataagtgaattattaaagcattggttctcaaacttcagcatgattctaatgggggactcataaaatacaaattgacagaccccaccctcagagcttcttctgactcagtagctctgagaggaagttcaagaattgcctttccaacaagttcccaagtgatgctgctccagggatgacactttgagaaccactacctaacaaaaactttaatcatatttgtgatggctcattttacaggtcaacttgactggtccacagagtgcccagacacttggttaaacattattctggatgtatctatgagggtgtttctggatgagattaacattcaaatctgtagccaaagttaagcagattgtcctgcctaatatgggtgggcatcatccaatcctttagaggcctgaatagaacaaaaaggagaagtaagggagaatctgctttctctgcttgtttttgagctgggatgtcagtcttctgcatttagactgtaactataccaccagcctctcttctgggtctccaatttgcagacagtagataggggatttctcagtctccaaaacagaagagccaatgccttataaatctctttctgtatgtatatatgtgtgtgtgtgtgtgtttgtgtgtatctgcctgtgtgtgtcctactgattctgtttctctggcgaaccctaatacaatatttaagaaattatatatatatatataaaatttaaaatgacaggcagaaaatacaatttcaaaatgctatattttagatgtctggagtttgatttttttttttgtttggtgacttgaaatgtagtctcatatgattactcctttctcaacaaggccttaactgacacctgtcttctaggatgaatgggaagactacacctttgcaggtccactataccatatattgacttaagatatatgattgcacttaacagccttgaattgaaatggactaatagggcattacttgctatctttaatagaaagcaaagtccttgaaggcagaaatcagatcatagttattatctatgtaccccaagggcctagcacggtgcctgcagacagtcaataaaatgcttagtgaatgcatgaaatagagtaaattactccactcaatttggaatagagtaagttttgtgattttttttttaagtcttatgataactccatgggaaactctagacgtagatagagttatctctcagctcttttatcaaagcagtggttctcaaaatgcagagctggggcaggctggtgccccctagaagacatttggctatgtcagagacatttttgtatgtcacaactgaagagggtcctaaaaacatctagtgaatgaaagtcaaggatgctgctaaacatcctacaatgcccaggacagccaccgacaacaaaatgttcggcctaaaatgtcaaaggtgtctaggttgggaaattcagcattagaggaatgcagctgagctaattaagcaagggtcctaacccttctcccatcaccctcctaaacaaaatttggccttaaataaaagcatatcaatagcagcaacttacacatgtataacaatttgttttacagataacattttgcaacctgaggctcaaggtcacaagggctcaagttagtggttgattagcagtaaaatgtattcttaccctgagccaaacactcttaaacactttcttcttaactcctggccagttcattcatcatttaatgtgaacctcgtcagtagctacttaatcactgctttctcatgttacctccatttctgagcctagacaagatcacctgtgtcaagagatacctttcctccagttgttgttttggtaataaatttttttgattttctttaattcagttatgtggcttagctctttttcacattaggcctctttcaaagtatatattaagtctaatattggtttaaaacattttgcaataaagcctgattgaaagataatgaaatggcaactttcacagtcaagagcaggacaaacaaccagttgtgaccttccctttttccttttcagttgggccctaaattgcattccaaagaccctgctcctggaacagccttctgcaatcaacacaacctcttggaggttttactgcgtctggcactcgcaggttcccctgctctcactctctctctctctgtttccttgctgtgaaaaacgtgttgaccatcaggcatatggcagaataattggatttcaggcaagccaatgtgagaaaccagaaggcaaatctggtcatttgtgggtatacacaggacaaagaaaaaggagtgtagagaaacagaggctgtcctggaggtaagctgaggctgaaagtagtttactcgataaagccctgttgctgtaagacaaagaaaactttgactatgttgcagcactctcgtatccaaaaaagtggagttaggagaaggaaagaaagaagggatgaaggaaggaaggagggagggagggaaggaaggagtgaaggagggaaggaggggggaggaagggaggtggggaggaaggtgacagggagaaagaaagggatggagtaaagaaggggaaatggaatgagcatttattgaatacccactatatataactttgctatttgttatgtcatttaatcctcaccatagtctgtaaggtaggtaatatagtctccatttttttcagataaggagagtgaagttgaaaggttaagtcatgtgcccaaaatcacagagctgagattggaacacatatctgcccgatccgaaagttcggaaaaaaaaagaaaatggttaggttctgggaaaatgtggggttttttctccccatccccagagatagatgttttttaaaattttttaaaacatattaagaaaaatcatttggggaacattgtacccggcatgatagaaaactgaattgagatatgggattgttcttcctgaaataaagatatctggttcctatacttacttcatactggtttttttaaaaagcagataatattttttacatttatttcttccacaaataattggaaacactaagtgaaaggcactgtgctagtcaccattgaaggtataactgtgaacaaggcatgaaatttacagtctagtagagaagaaaagtaaacatgcaattatgatagagtttgataaatattataacaagtgaaacctcagggagttatgggaacaagttaatattgacaaagagaaatgccagagtttcaggttgaggcttaaggcatgagtaagcaaagtgaaaacccctttcttccacaaaagaagttagaagtcaacgttaagtttggaggaactgcattcacgcgcaccctctctctttctctctctctctctctcaaacaatactctaattctagacaataaaagaaagacctctgccacctaatctgccatgtcattcattaaaacagagctaattccataacatgtggtaaaaagcagcattggactaaaagccagatctgaattttcatctaggcttgccagagtgctggctatgtgactgtgggaaagtaagtttaacttccctgatcctaagtttccttatctgctaagggagttaagctaaaccatttttaagtctctcccatttttaatactctctgtagttctaactctaatgactactcaacgacatagtgtagcttgcaatcagaaatttgtttgataaactgtcttagaactttagacttttgaatatttatggagagagagagcaagatggtataatggaaagctctacccatcgtcctgccagcaagaatatccaattaacaactatctacacagggaaaatacccttataagaaccaagaaccaaagtcaggcgagcatacatagtatctggttttaccttcatatcacagaaagtggcactaaagagatagaaaaaacggtcctgaatcaccaatgccaccctgcccccacctctggcagcagctgtgtggtagtgagagcatctctgtgtgctcggggagagagaacacagcaattgggaggcattgaactcagtgatgttctgtgagagcagaaaggaaaacccagatcaaactcagctgatgccccctgcagagagagcatttaaactagccctagccagaggggaattgtccatctcagcagtctgaacttgagtgcctggaaacctcaccacctagcgccaaagtggtcttcgtctctaagtaaatgtgaaaggcagtctaggccataaggagtgcaactccacaacctgtaggcaagtcctagggatgaaataggcccagagacagtggattaggggggcacacgacgtactgagacaccagctggggtaaccaagggagtgctggcatcacccttcccctaacccctgactgctcagctctgggctcaaaaagagaccccttccttctgcttgaggacagaagagagaagactcaggaggattttgtcttgcatcttggataccagcttagccacagcaggataggtcagcatcatgaagctctgttctaggccctagctgacagatgacaattctagacataccctgggccagaaggtaatctgctgccttaatggaaaaaatccagtcttgccagcattcatcacctgctagctacctaaataaccagtagcaatacccaggtactacatcaagggccttggtaagcctctgagacttgctggcttcaagtaccaacactgccacagaggcatacagcaccagtgagctcttggggtccccaattccaggacttgactcttggacagcatttctgaacctgccctggggcagagaggagcccagtgccctgaggggagtctagtctcaggctaaacagcattcacacaagctgacttaagagtccgtgggccttaagggaacatggctgatagtctggcagtagtcctcatggccaggggtggtggtggctatggggtgaggttcctctgcctttggaaaagggaaagaaagagtgggaaggactacatcttgcagtttgagtgccaggtcaacaacaataaatagaaaatcagatagattcctaaggtttttgattctagtgcctgactcccagatagcacttctgaacccacctggagcttaggggaccccgctaccctgaagggaaggagacaggctttgccacctgctggttttagagccccagggccttgagtgaagataggcagtagccagggagtagttacagcaggactttggcgagaccctgcactgggctggcatcaggactcactcagagcagtcatactggtggtggccacaggagctttaggtggctcagaacagagagagactgtatgtttgggagaaagtaggggaaataaacaagagtctctgcctggtaatccagagaattctcctgaatcttatccaagactaacaatgttgtacctctatgagtctgcaagaaccacagcattactggccttcgggtgccccctaaggtgggagaaagtgagagaaatcaccttcactaaaaggaagacaagaaggaagaaaacaccataaaacaataggaaaacaaataacaaatggcacgcgtaagttcttacttaacaataacattaaatgtaaatagactaaactctccaatcaaaaaacatagagtggttaaacccacttgatcacggtggagtatctttttgatatgctgttggatttgattacctagtattttgttaataatttttgcatctatgttcatcagggatattgttctgtagttttcttttttgttatgtctttttttggttttggtattatggtgataacaaagaaaagtcaaaaatagaaaactacaggccaatatctctggtgaatattgatgcaaaatactcagcaaaatactagcaaaccaaactcaacaatacactagaaagatcgtttataatgaccaagtgggatttacccctgggatgcaagaatggttcaacatatgcaaatcaagcaacatgatacatcatatcaacagaatgaaggataaaaatcatatgataatttcaattgatgctgaaaaagcattttataacagtcaacatcctttcatgataaaaaaaaaacctccaaaaactggtgatagaaggaacacaactcaacagaataaaagccacatatgacagatccacagctagtgtctactgaatagggaaaaaccaaaagcctttcctctaagatatgggacatgacaaggatgcccactgtcaacactgttattcaacatagtactggaagtcctagctagaacaatcagacaagagaaaaatataaagggcatccaaattggaaaggaagaagtcaaattatccttgtttgcagatgatatgatcttatatttggataaacctaaagactctattagaaaactattagagctgataaattcagtaaagttgcaggatacaaaattaacataaaaaatcagtaacatttctatatgctaacagtgaacaatgcaaaaaaaaatttaaaaagtaatcccattataatagccacacataaaattaaatacttaggatttaaccaaagaaatgtaagatctctaaaattaaaactataaaatactgatgaaggaaattaaagaggacaccaaaaaattgaaaaatatgaatattgttaaaatgtccatactatgcaaagcaatctacagattcaatgcaatccctatcaaagtaacaatgacattcttcacataaatagaaaaaacaatcctaaaatttatatgaaaccacagaaggcccagaatagccaaagctatcccaagcaaaaataacaaaactagaggaatcacattacctgatttcaaattatattacagagctacagtaagtaaaacagcatgatactggcataaaagcagacacatagagtaacggaacagaatagagaacccagaaagaaatctacacacccacagtgaactcattttcaacaaaggtgcaaagaatatatactgggggaaagagattctcctcaacaaatggtgctgggaaaaatggatatctatatacagaagaatgaaattagacccctgtctctcaccatacacacaaatcaaatcaaaatggattaaagaaatctaagacctcaaactatgaaactactataagaaaacattaggaaaactctccaggacattggtctaggcaaaaatttcttgagcaatatcccacaagcacaagcaaccaaagtaaacatgaacaaatgggatcatattaagtttaaaagtttctgcacagcaaaggatacaatcaacaaagtaaagagacatcccacagaatgggagaaaatatttgcaagctacccctctgacaagggattaataaccagaatacacaaggaactcaacactaaaggaaaatgtctattaatccaatcaaaacatggtcaaaagatttgaattgacatttctcaaaagacacaaaaatggcaaacaggcatatgaaaagttactcaaaaccattgcttatcagagaaatacaaatcaaaactaaaatgagatatcatctcaccccagttaaaatgacttacatccaaaagacaggcaataacaaatgttggcatggatgtggagaaaagggaacccttgtacacttttggtgggaatgtaaattagtacaaccacaaagaagaacagtttggaggttcctcaaaaaactaaaagttgagctactatatgatccagcaatcccactgctagatatatacccaaaagaaaggaaatcagtatatcaaagagatatatgcactcttatgtttgttgcagcattgtttacaatagctaagatttggaagcaacctaagtatccatcaacacatgaatagataaagaaaatgtgggacatatacacaatggagtactattcagccataaaaaaggatgagatcctgtcatttgcaacaatgcagatggaactcgggattattatgttaagcgaaataagcaggcacagaaagacgagtgtcacatgttctcacttattcatgggatctaaaaatcaaaacaattgaactcatggagatagagagtaggagttaccaaaggctgagaagggtagtcaggggatggagggaagaggggatagttaatgggtacaaaaaatagagggaagtggggatagttaataggtacaaaaaatagaattaataagacatactatttgatagcacaacagggtgactatacattttaaaataagacaaaatgtaataggattgtttgcaactcagtggataaatgcttgagaagatgaataccctattcttcatgatgtgcttatttcacattgcatgcctataataagacatctcacataccccataaatatatacacctactgtgtacccacaggaattaaaaataaataaaacacttaagatctttacattgagactatctccagttgcgtcatttaaaaattatactgagcccaagtcacatgaattttacaaccaatattaaacaaggtaagaaaaactgacatcataaatggagatatatcagcttttgaaaaatcccaaaatgaagttctgaagggaaaaaaaagaacatgtttaaatatagcacgacagtattctaagccggatccaaatgtcattagtgtctccaaatgaaatgttaaaagattgaattaccccattttgtattatattatctgactgcttatacagtagaaaaatagtaagactaaaaaaattagaaaagctgaattttggtcttaatattattttattcataggtcagcattttttaaactatcagtatgtcaactgtaaaatggcattcaaaattataatgaaatcgtcaagtgatatgtaaattgataataagcaacagaaatgctatgctttcttatctttataaataagaaaattaatattttcaaattttctctgccttttgaaaattaattagctaacatttatgaagtttttataccttggaagaaaactaatgatgtaacagaaaaaggcagagggaagatggtaccttttttttttatcattttagtaaaaaagaaagattattaaactaacaatgttaaccagtaacaacctgaaaataaagtcaatatttattttttcataaacaattagtgagggtagataaagtcaatatttcagtgtatattttgcccctgatttcagtaaaacatataaggctgaaaacaaattataaattcattttaaaacccttaaaattatatttggtattacaactctgaagtttttagtgtgaccattttcaataaattactttttgttaaccaagactaacccaaaataagaaaataattatatcaaaagaagaaagaaagggaggtagggaggtagaaagggaagaaaatatacctcttctagtgcttcagaaataattctagagtaacaagttttaaagattccaaatgtggaaaagtcacctattaagtattaactaaagactaactccaggttgacagtgatgtattctctggaaaagactttgcctaagggcagcttttcacactttattcacacacacaacccattccattgtctatatttttaaatcagaaattttcctgcccaaagcataccagatttcaatatttcaaaaacatctcaaaggccctgacccataaattatttattccctgtggatcatggaaccaactttttcactacaattaaaaaaaaacttttgatgagttagatagttccctatttgaaacctgaaagaaatgaaaaccataatagttaattgattatccagaaatagattcatgatattgattattcaggcatgatctgaaaattcttactactacagaaagaagcaatatccactctgaactatgtctgtaaatttcagctcactggctggcaccaggactcttccattcacttgcataatttttaaaaaaactgcatcttaaaactcattcatatgttcatttaacaaataattattaaacactttctaagtgctaggcaccaatagaaagatttactagtctctattttcaagaagtttatggcttaattttatattcatgtataaacttaccagcattaaaggaagaataggacagaaagaaaaatgaatgatatttgaaatataagccttaaaagttcctgttaaaaagagataatttagcatcacattcatttgtaccttttcccttagaactcaagctaatattacatatctgacctattgactagctttctgagaatttctaacatcattcaaaaagaacactattaagatttacagctaatatcaaatcttctaataaccaattggtacaagtccctgaatatattaatagcaaattcactttttctttttctttcatgggcccacacttaacctttaggctcagatgatactgagtttcttcaaactaaagtgatagttcaacatagtagacacatgcacacacacacacacacacacacacaatgtaatgttcacgagagaaaattgaatccctgaacagaccaataatgagctctgaaattgaggcagtaataaatagcctaccaaccaaaaaaaagttgaagttgcaccagacagattcacagctgaattctaccagatgtacaaagaagagctggtaccattcccactgaaactattccacaaaattgagggagggagagtgactcctctctaactcattttatgaggccaacatcatcctgataccaaaaccctgcagaaataaaccagaaaaagaaaacttcaggccaatatccttcatgaacatccatgcaaaaatcctcagcaaaatacggtcaaaccagatccaacgcacatcaaaaagcttatccaccatgatcaagtaggttttatccctgggatgcaagattgcttcaacatatgcaaatcaatagtgattcatcacataaacagaactaaaaacaaaaaccacatgattatctcaatagatgcagaaagggcttttgataaaattcaacatccactcatgttaaaaactctcaataaactaggtagtgaaggaccctacctcaaaacaataagagccatatacaacaaacccacagtcagcattatactgaatggacaaaagctggaagcattctctttgaaaaccagcacaggacaaggatgccctctctcaccactcctatttaacatagtattagaagtcctggccagggaaatcaggcaagagaaagaaacaaaggcattcaagaccagcctgggcaacatggcaaacccctatctctatgaaaaacatacaaaaattagctggacatggtggcgcttgcctgtagtcccagctacttgggaggctgaagtgggaggatggcttgagcctgggaggtggaggttgcactgagccaagatcatgccactgcactccagcctgggcaatagagccagactttgtctcaaaaaaaaaaaaaaaagccacaaaaagaacaaaataccaaggaataaacctaacggggggtgaaagagctctacaagtagaactacaaaacactgctcaaagaaatcacagataatgcaaaaaaatggaaaaatatcccatgcccatggacagaaagaatcaatattgttaaaatggccatgctgcccaaagcaacttataaattcaatgctaatcctattaaactaacattgatattcttcactgaaatagaaaaaaatttcaaaattcatatagaaccaaaaaagagcctgaatagccaaggcaatcatacacaaaaagagtaaagctggaggcatcatgctacccaacttcaaactatactatagggctgcagtaactaaaacaccatggtactgttacaaaaacagacacatagaccaatggaacagaatagagaacctagaaataagactccacacctacaactgtctgatcttcagcaaacctgacaaaaacaagcaatggagaaagtattccctaaatggtgctgggataactggctagccatatgcagaagattgaaactggacctctttcttacaccacatacaaaaattaactcaagatggattaaagacttaaatataaaacctaaaagtataaagtccagaaagacaatgagggcattaccattcagaatatagacacgggcaaagatttcatgatgaagttgttaaaagcaattgcaacaaaagaaaaaaattgacaaatgggatctgattaaactaaagagcttctgcacagcaaaagaaactaccaacagagtaaaaagaaaacctagagaatgggagaaaatttttgcaactatgcatccaacaaaggtctaatatccagcatctataaggaacttaaacaaatgtacaagaaaaaaaaacccataaaaaagtaggcaaatggtatgaacagacacttttcaaaagaagacatacatgcacccaacaatcatatgagaaaaagctcagtatcactgatcattagagaaatgcaaataaaaactacaatctcacaccagtcagaatggctattattaagaagccaaaaaaaaacagatgctggcaagttgtggagaaaaaggaacatttacacaccattggtaggagtgtaaattagttcaaccattgtggaagacattgtggcaatgcctcaaagagctaaaaagagaaataacatttgacccagcaatcccattactgggtataaacccaaaggaatataaattgttctattataaagacacatgtacacgtatgttcactgcagcactattcacaatagcaaagacatggaatcaacctaaattcccatcaatgataaactgaataaagaaaatgtggtacatatacaccatggaatactatgcagctatgaaaatgaaaaagatcatgtcctttgcagggacatgaatggagctggaggccatcatccttagcaaactaacacagggacagaaaaccaaatactgagtgttctcacttacaagtgggagctaaatgatgagagcacatggacacatagagggaaacaacacatactggggcctattgaagagtggaaggtgggaggagggagaggatcaggaaaagtaactagtgggtactaggcttaacacctgggtgatgaaataacctgtacaacaaacccccatgacacaagttcacctatgtaacaaacctgcacatgtaccccaagcttaaaataaaaattaaaaaagactattcataaacaaatatatatataatgttgtttagactattacatttccacagaaaactcagttaattatgccagttatgctaaattaatgcaattgaatattaccaaaccatttaaaataaaattatgaaaatatataaaaatatagagaaatgtttgattcattcaataaatgttcatttagtatctgtgatatgtccaaaattacacttgacattttggattaaaggataaattgcgcacaatcaaaatgctcgcattgctcacagcctagtaatgggtatctaggaagggacaaaaagattgggagcaacgctaagaaagagatgacagtttctagacaactagcttggaaatagagcactgttttttcaagcatcaatgtacaggctggctggcctaaaactaactgatagcgcatcaacagaacaattggagacagaagtggaccagagcgacactctaacctgggatgttaagccactgactgatttgcggtcaggtttttggttccttttgcttcagtgcagaagtagggctgaagacccacatgaagattgagaaaggagatggatgtgtagagtctacatttaaattgatataagagcactaacagaggtatatgaaagatgttatgggagcaatgagaaagaagtgcttaatttgaaggtggtagtcagagaagatgggaaattttacagagaagttgacatttgtgcttaatcttggaaaaaaatagaaattttcagaattatacatgtgcacacacacacatacaaaccatccaaaacaataacatcatgaaggcagagaagcataaaagaatgtgtatggcccccagtatttagtgtggtcggatcattaagaattagggtgaatgtgggaagtggtgggaaatgaacctggaagggtaatcataggtcagattctagacttggatggtttgctacagaattttgattttgtcttgtgtagccaatgaaaagccattattggattttagggatgtgaaatgaccagatttgtctttcaggagtgtcataagtgcaggagtttcttaattgcagtagagtaaaaaataaattggaggaaagctaggtcgaaagcaaggagaccccttagtgcagaggtggtctaatccatattagaaatgataacactgactcagatctgtggcagcagagatagagaaaagtagatacttaggatcaagagtagtgactgactttatcagtttgagcagagcctggaaagaggatgtgagagggaatatggagtcaaggactcttagcttgtgcaagcagacagataaagatgtcattatataaaagtacaaccatgaaaattatatatgaaccaagactagatggtaaactacaaaaataaaggaaaaaaagttgagttagaacagtaggaccacttgttttccaaaactttttcaatgtcatactctatgtctgaaattgtttggggttacatctagttttaaatattaactctgtaaatcattagttttataattttgagcaggttgtttaacctctgtgaattgtctcatccaaatatttatttatttatttattaatcttgtttcaaaaaatattttaagtagtttataaaaataaatacaattcagcaaaacaaagtacagtcatgtgccacataatgacattttagtcaatgacagaccacatacagaatagtggtcccataagattatgatattgtatttttactgtaccatttttatgttaagatatacaaatatttaccattgtgttatgattgtctagagtatttaatacagtggtgttctgtgcagatatatagcctaggagtggagcaataggctataccatatagcctatctatgtgtataactagatatggctacaccatctaggtttctataagtacattctacaatgtttgcatgacaaaattacctaatgacacatttattagaatgtagccccatacttaagcaatgcatgactgtgtataaagagagacagtgagaagaaagagtaagaatatgagaaacaaaatgaatcaagtgcatgacttatgatgacataaccttgagcaagaagtgagctcaacattagttctgagacttcctgtctacccatagtggaaaacacaatgagttccatgagtgacattgttcattttggctagcgacatttcagagaaatttatccatgagatcctcataatacagattctaaaaacagtgatcagcacaagaaataacatcccttgagttcatgtcatttgcagggacatggatgacactggaaaccatcattctcagcaaactaacacaagaacaaaaaaacaaacaccgcatgttctcactcataagtgggagttgatcaatgagaacacatggacacagggaggggaacatcaaacactggggcttgtcgggggctggggggctggggggctagaggagggacagcattaggagaaatacctaatgtaaatgacgggttgatgggtgcagtaaaccactatggcatgtgtacacctatgcaacaaacctgcacattctgcacatgtaccccacaacttaaagtataataaaaaagagagagaaataacatccttgaacttaatacaatgtcaagtttctcaatgccagccaatattataacaggtaagcacaaatcagcaaaagcacttctgcagggaccaaaataacacaagctgggtaaagagctatctcaaggtctgactgattccaggaaaaaaatttagcatatctaaagcaatgaaaatcttgcatctttatttagaaaatctctcacaaatttcccttccataaagatcactcaacgacatcatctaaccaccttcccaccccgagttgttttcctaatgattcctgagacattggtctgacaatgacagttctcaaaattctcagcctcaaaacaaacaaaaactcaattttcagaaatacaagatgcagcataaaaactcattaaatagggccaactgaaggaagtctgaacttgtgaaaattctgaatattcaaaagttattccagtcctttaatacaagcaattggctaaagaaactactcattagacttcctcaaagatttgctttagtaaatgattatttctaattagtatacttttctaccatttactgctgttaaaaatttgaaaatgggttgttttcccaaataggttaaataggttaaatgcctctcttgacctcggtcaacttatttataatctattatttgcctacgcttcattatacctaaggtatttattcaggcagtgagagtttacagaagttaaaacatagggagccttggtcttagaattagtcaagtgaaggctatgtccttcttttgtcttagtaatgtttccataaatcattaaatacaagttggtgtgtaggaagtgtgataattattcaatgcagttttcataaagttcaaaaaataatatgtattaacgtaagactttctgagtggttaaggattgtggaggggtgtattccaaagctgtgctttataatttcaagcctatcatacctcatacagttaagatatccctggacacatctatttatgattaaacattttttaaagagcaataatggtcctcctttagtcaccaatactctttcagtaaagcaaaggtgttaaatcagcagaatcaatgtcattgccatgagtaaagaatgtgatgacattcttgtgcaaccaaacaaaagtgtgataagaggctgagataaataagaaaaatgtgtttttcacttcgaaaaaaagtatttcaaagtgaaaggtgctgttaatactagtttgtgaagcataaatgcccagtaagtagcttttaccttttttgttaaattttatgactttggatatttttaaacttgtacgtacaaatgtatataatcataggctaagcttaaaataagttttgactttcctgtaaggcaaatctagagtagtaatacatttttaataaaatgtaaatttatttatgtatatttaatttgggtttgagagtttttcaacatttattttagattcagggggtacatatacacattgttacctggttatattgtgtaatgataaggtttggagtacagttgatcctgtcacctaggtactgagcatagtaccccacagttcatttgtcaaccctttcccccaacctccctctccactctagcagtcccagtatcaattgttgccatctttatgtctattagtacctgttgtttagctcccacttataagcgagaacatgtggtatctgattttctgatactgcattaatccatttaggataatggcttctaactgcatccatgttgctgcaaaggaaatgattttgttctttttttggctatatagtattccatagtgtatttgtacctttttttttttcatccaattcactgttgatgggcacctaggttgattccatgtctttgctattgtgaatagtgctgcaattaacatgcgggtgcatgtgtctttctggtagaataatttgttttttgaggatatatgcccagtagtgggattgctgggtcaagtggtagttctgttttaagctctctgagagacctccaaactgctttccacagtgactgaactaatttacattcccaacagtgtatatatgcttataagcattcccatttctctgcagcctcacccaaatatttttaaattttaataatagttattctgacttatatgagatggtatctcgtgatttttgatttgcctttctctggtaattagtgatgtggagcattttttcatgtttttttttttttttttgctgcttgtatgtcttcttttttttaattgtatgtcttcttttgagaactgtccattcatgtctttcttttgcctatttttaatggggttattggtgttttacttgttcaattgtttaagttccttatagattctagatattagacctctgtcagatgcacagtttgtgaatattttctcccactctgtaggttgtctgtttactctgttgatagtttcttttgttgtgcaaaagctactcagtttaattaggtctcacttgcaatttttgcttttgttgtcattgcttttgaggacttagtcataaatttttcccaaagtcaatgtccagaatggtgtttcctatgttttcttctaagattcttatagtttgaagtcttacatttaattctctgatccatcttgagttaatttttccatatcaaacaaggtaggggtccagtttcattcttctgcatatggatagccagttatcccagcaccatttattgagtagagagtcctttccccattgctgattttggtttactttgttgaaggtcagctggctataggaatgcagctttatttctgggttctttcttctgttccattggtctatgtgtctgtttttgtaccagtaccatgctgttttgcttactgtagccttacaatatagtttgaagccaggtaatgtgatgcttctggctttgttcttttttcttgggattactttgcctatttgggctctttattactttattacttccatatgaattttagaatagttttttctgattctgtgaaaaatgccattggtagcttcatagaaatagcattgaatctgtagattgctttggggagtttgaccattttattattcttccaatccatgatcatggaatgtttttccatttgtttctgtcatctatgatttatttcagcagcgttttgtagttttctttgtagagaccttttacttccttggttagaggtgaaaccaaggggtgtgtgtgtatgtgtgtgtgtactgtaaattaggctatgttcttcatttggctctcagcttgaacattattggtgtaaagatatggtactgatttttgtacattgattttgtatcctgacactttactgaagtcatttttcagttccaaaagtctttggcagtctttagggattcctaggagagatagtttgacttcttcttttcctatttggatgccttttctttctttctcttgcctgattgctctggcttgcacttccggtactgtgttcaacaggagtgggaagagtgggcatccttgtcttgttccagttctcaagggggatgcttcctaaaatgtcaatttgaaagcctgatttttgtctttgactttgaacactgaaagacaatccagagaactagcaaatttacatttaaaaacctgccttttaagtttttaaaaactatgaatttaaaattgcttcttttaaaattgggttttaaatttttgattctacaagaaaattttcattcaacaagcacttaggacctgttctgagtttcttcagagcctttcttaaaagataaggcacatattgaaggtagagttattaagaatgagaaggtggagaaaaaataaaaataaataaataaacaatgcagctctcatccaaaatcctaatggcccaaaaaagctacaaaaaaagatgcctgagaggccacccctcctttcatattaaaaagctatagtgatttgtagagtcagagcttaacaaatcaccctattcttcatcctttccttcactaagttgtcagacagatgcagaatagaaatcagcaatgtgaaattgtggtttctcaactgaatgaggaatttttcaccatgactttaatgttcctctgtcatgggccctaatgggaaactaccaaaagttataaaattcgattatactatgggaatccacagaagggggtaaagagaaagcaaaggcaaaaaagaaatgtctttattttgaaccctaatcatttatttaaaagctgtgtctcatctaaacacagaacaatgggatagggaaagctcctgcttccggatccctttttcagaagcagcttcctagcttctctctggaagaaaggaaagatgatagggctagcccatagcttctcagccttggcaacattgacaatttgcactaggtaatcttttgttgtgaggaggtacattatagaatgttagtagcatccctggtctctacccactggatgccaccagcgccactccagtcatgacaatcaaaatatctccagacactgtaaaattgcccctggttgagaagcattaggctagttcccgcacaatttttttttttaatttttctttagttctttaagatcctttcaagtgagggaatggactgccacagtcagcaacaagatgactggcaaactcttgtcttctggaaactttttcctactatggcatattttattattttgtcagaaaatccatttctatacctctcttaatactccatttaatatttcttaaagataatacatttaaagacgtaaaagaagataaaagagaaacatccttagaactaggcaacataagaccattctacattaattcatcttacctccataggaaactgtcataaaaagcacccaaaatttaaaatagtaaaagagaggttaaaacccacctcaatacacagatagtaacaaacaacaaggaataaaacccactattattcttccatcttaaaaaagcaaatcttttttcaactccacaactcccatccccagccatatcatttctttgctccctttaaagcaaaacccttcaaaacagttaactgtgctgtctttaattttcctcctcttcattctctcttaacccacttcactcaaagcatcattgccaccacttcacctgggctgtctttgactttcatattaattaattaaggtcttcaatgactttcatattaataaatacaatggccatttctcaaccctgatcttacctgacctatgggcagcgtttgacactgttgattatcattttcctccttgatacactttcttccttggttccaagaccccacacccacttcttagtcaccagttgctctttctcaatctcctttactgactcctccccttctcacttatctcttaataatggagcagccctgggctcagatcatttctctcaatctatactcaattcccagtgagtcttccagtctgtgatcttaaataccaccaatgttctgatgaattccaaattcatatgatcagcccaagcctctctccaagactccagacttacatatccagcttcctacttgtcatcttcacttgtatatcaaataaatatttcaaacccaaatgtgtccaaaactaaacttctgatccttccccataaacttgccccttctacaatcttcaaatagtagttgatgccaagtccaccttctcttagttgtttaggtcaaaaactgtgcattaatccatcactcctttctttctctcacatgaaacatcctgttagtttttaaaattatataagttctaccttaaaaatatattcagtatccttccatttctcatgttcaccactgcttctaccctgatagatgccactatcatctctcaactgaattattttttataagcaactttttattttaaaatattaattgacaaataaagactgtatgtattcaaagtgtacaacatgatgatttggtatatgtacacgttgtataataaataattattacaaccaaatttaataacacatctgacatagtttgggctgtgtccccacccaaatctcatcttgaattgtaactcccataattcccacatgtcatgggagggacccagtgggaggtaattgaatcatgggggtgggtctttgccatgctgttttcatgatagtaagtctcatgagatctgatggttttataaaggggagttcccctgtacatgctatcttgcatgctgccatgtaagatgtgactttgttcctcattcaccttctgccatgatggtgaggcctcaccagccatgtggaactgtgagtcaattaaacctctttcctttataagttacccaatcttgggtatgtcttcattagcagcatgaaaacaaactaatacaatatccatcactatctatgctgtatattatgtccccagaacttgtcttataactgtaagtttgtactgtttgactagtatctcctcacttctcccactcccccagcctttggcaaccaccattctactcactgcttctatgagttcaataattttggattccacatataagtgagatcatacagtatttttctttttgtgcctggttgatttcacttagtataaagtcctccaggtttatccatgttgttgtaagtcaatagcaaaaacaaaacaaaacaaaacaaaaaacaaaaaaaaacaaataacccaacttaaaaataggcaaaggaactgaaaatatatttttccagagaaaaagatatggaatcaacctacgtgtctatccacagatgaatggataaacaaaatgtgaggggtatgtgtgtgtgtgtgtgtgtgttgtgtgtgtacacaatggagtattattcagccaccagaagaagaaaatttttaaagagttattgcaaaagattccttactagtcttctagtttctcattacccctacatattggctcgatattctcaacacagtcgccgtagcaattattttaaaatgtaagtcagatcatatttttcctctgttcaaaatctgaactggtgccacatttccccagagtaaaaaccaaagtcttaaaactttctaaaaagtttaatataatttagtcttccctcatctttctgacttcattttctatttctatcccccttactaattccacttggtcttctttctgttagtcaaacataccaggtatattttcactgtagggtctttgctctggcttttccttccttctggaagtctcctccccttccactgcttcatgtccttcaatattacctcgtcaattggtcctaccctaaccaccctattaatacttgcagctggcccaccatcatcccatgattagcaatccaaatcccccttactatgctcatttttttttctttctgtcatggcacttttcaatttttaatatcaacaatgtattcatgcttattattcattgtttgtcttccctatgtatagtgtaaacctcatgaagaattcattttgttccctgatttatcccaagcatgcttagaatagtgcccagtacatagtaagcgattgattaacacttattgaatgaatagagaactacatgaacgaataaaatagattaatatcctactctcaagtagaagagacggcaaccttcctttcttaaatcctctttctcagtctcctatttatacctcaaaggactaactgggctgggaggaggaagggattctttggtaaggaggaatagataaatacagctggaaaggtttttatttgaatattttagggtttcatttctttgggttttttcttttttaattggcaagtaaaaatttatatatttatggtgtgaaacctgatgttttgatatatatacacattgtggaatggctaaatcaagctatttaacatattcattaccttacattcttatttttgatggtgagaataaaagattgtagattttaagaaactttctatcttcttagtttggaggactgtgaaatcttgtgctgttgggagattttagggcttttgtattctctttatcactctgatttttggttcggtagtgcttcaatttggaaagtatcttctaaactaaatgaactagaggagccaggaatcagtactcaaaaaagcagaggagaaagcaagctgctacaagaaactcaagggaaacaagaaaagagaacttcagggtttcagcccaattcactaaataggaaagagggctaagattcaagatcagtgttggaactagtaacaaatattacatttcatgatagaggtgcaaaaataatgaaccacaggtatattcatgatctaatgttatgtaacctattacccccaaattttagtggtttaagacaagagtaagcatttattatatcttatggtttctgtgattcaggaatccagaagcagcttgattggatagctctgggtcggggctatcatgaaattcagtcagatgttggctgaagctacagtcatctgaaggcttgacttggttgcagggtctgttcccaagatagatcactcacataactagcaagttgttgctattagcaggaggcctcagttcttcccacacagagctaagattcaagacttctatgcaagtcaagaaatacacacacacacacacacacacacacacacacacacacatagtgaagtctgaatataaattaggaactgagctcttcttctctctccataggtatatacatatacatacatatacctatatacacatagatatcctggagaattatttagagagagcaatatttctacatcagctccctaggccaagtaaggtgacccaatggacttcacttttctaaaaagtgcagttatacttatgtatcttctcttactattcatcaaaataccgacaatattttgggctgaaatgttaataatatctgtatgaacctctgcttcaaaaaataatccaagggatccttgagtatttttaaaacatggcatctggtttccccaaaatgagcaacataagaaagcaaagaatacaaaagaacaaggcagaagccatagtgtatgtctttatgatgtagttttctgctgtacagtactgatcacatggtcagctgtgattcattttggaaggggagtatgaacaggtgtgaataccagtaggtaaggattcctagagatgttatcaacatctcagcccgaaatattgtcgatattttggtgaatattaagagaagatacataagtgtaactggactttttagaaaagtgaagtccattgggtcaccttacttggcctagggagctgatgtaaaaatactactctctttaaataatcccccaggatatctatatatatacacacacacacacggagaggaagtgctcagttcctaatttatattcagacttcactatatatatgtgtgtgtgtgtgtgtatttcttgagttgtatagaatacgtacttatgaataacaaacttgaccaattttcctacagacatagacttcttgcatttagcagtatcactcacctcttactccatcatttcttcaataactccatcaacactgaaccttctaactctaacatgctacgattcactactgtgaaaaaaaagctgatgtcataaacacattgtgttccagtatcactaagggccataccccattcttaggtaatccctgaggtcctactagccttgctagcctcaaaggagtcacttggagtataaagagggggaggagactgaacaaagtcctggagctatagtatattttttcattgttaatccttggcaaagaagtaggtagtttggaggtggaagtaggccatgattacctttaaaataatctactattatttgtgtctttcctgaatatcatagcaccttcttgtcacaaatgcttaggggaaagaaaatcatccaatataccccatatcccacttaccaacatctctacagtaaaatgagacccaagagcatgatttccttaactagctatcaagcaactacctccaacaaacagcagttatcattaatatgttcatgctattttcatttgtgaggtctgtaatccatcagaacaacctgacagtgattaagtaaaatcaaagagactttgtaaacatctgtgtgcttttattgttacaaatgcttcattataaaaagatcagtcaaaagcataaaagtaccctggtttaaactttttctgtgtttgaatgagaatgtttctcttggaacatgctcatatcaggcttccacttggcaaaatcacgaattggctgatgttgttttagaggctttctcatgtccccttccaaacatcactcttctccttctgtggacccctttctgttatctaggagcccctcatgctgccttccacattctgcctactgcacagtcatgttctggacccctcagaatccccctctaccattacaatatgtttttcctaagacttacttgcattgaaaggcttgccagggaagtgactaatcttatcatcttgtactaaatgttaaattaatcctcattctctctagaattgttttctaagcagggattcctagagatgctatcaatatctcagcctgaaattgcataggtattctggtgaatagcaagagaaaataacgtgagtataactggaccttttagaaaagtgaagtctattaggtcaccttagttggcctagggagttgatgtaggaatgctcctctccctgaaataatcttccaggagaggaatgtatccccaaatagcaagtgaatatccaatggcttctcattgcacttaaactctatattcctttttatgaccaaaaaggcctggcttctccctaactgtctcttccttacacattacacctcttccttttgtatgtgaatgtgccaagctaccacctcatttctaccttaaggcctgaagtgttatgttccagttcttggcatgcaaattactcttcatcacttgtttcccgacacaaatgccacctttccagacaatctaaagtaacctcaaaatcatttgctcgcacatcactttgttttatttctcctggtattaatcactatgtgaaattttctggttcatattatttgtcacctgcttcttccaggcctcctcttacttcattgtctatcatgttcattaccgtatccctagtgttttgcacagaatctggtacatattcagtgctcaataaatatgtgctaaatgaataaatgaataaattaacctaaacataagttttacacttaagtaattgagcaagaagtctttgttgtactaatattggaaaaggcaggggtgggggtggtgacgtgattataaccaatgtaaccagcttgcatttataagacttgtattgattatgaactatagcattttttcgttaaaaacattatcaatattggattgtaaaagattccattggcctttctgaaagactgtccttttgatgagatgtcacaaatgaatgctaatgtcccttgagaaatcctgccaacagatcttattcttctatcaatgttaagaaactgcatttctctttggccaatttctaggcttatggatagtctctcttgctaggacttcagaagccaatgagcaacttgcctgtcacaagatccgacgaatgatctctccctgcatgcggtgtagctaagcagagaagcagctcttgtaagagaataaccaacacagcatggaatattgctaaatctacagtgttttatccagcaaagttcaccccagtagcctgcccctgccaataaagcctagaaatttttcctaccaggcagtcccagtttagttggttgtagcttagaagcagacatctgagagcagttcagcaagcctgcagtcagatgcttttgtagagctctcctcttaaaaggcaaaattgaggcaagtcaatagattacaactttctgggtttgcttctgtcatctatcaaatatcacaattcatcctgcttcgctaaagtgaaactccaaggatttgtttttaaaggtgtccttctttctgtgaaatactaaatgaacttgttttaaaaaacaagaacaactcaacacaagttgataggagctaagtaacataacttttcctttaagaaaaacatgtagcatgagaaaaccttatttttaaagtactacataaaatttattgagaccacatgtcgtaagaaagcttgattattaatccttccagagaaactgttaacacttaactgctattcttcaattatttcactatcaaattaaacttattcaagaaaatacaaatgattccatactgacctacaaaacaaaaactttttggtgttttgaggggacggaagaataaaggggaggtgtctttttcatcaaatctcttatatgagctcatttcatcaatctaattgtatctttttgtgcttctgccaagattattaatttcaagggtaagattttctctggctaccatgtactgtaaaactgtaaaattttttccactcttcatggaccatttacaatctgcaaggtttggggtgggaatgaaatgtatttctgccaatggatagccacatcagcagtgctgaaaaccaatccttctgtttcactcatcgtgccatatggctccataaaaaaggagcgaaccaaaagtgtagctcatacgccttgtcaatctgggcttagactaattatttgatattatgataaagagaggaatctgtttgtaggtgaatatattctctcttctttctttactcgtgtatctctatacccatgcgctaatttatggagggggggaatcagaggtttaaagcccctctaattttacaggagctataatattttaagaaaaggcattgcaataaaattgtcatacataggttataatttttaacaacaaaaagtcccaggtgttttcatagtaatgtcttcttaagaattaaggatcatgattttaaacgctttccagtaagtgctttgagtactccggagcaattaaaaagcaagctgacgcgccaagataaagttgtgtccccctagtgacctctagagcggagctaagctcccacaagccagacttgggaggaaaagcaaaaagcacgccaaagcctgagcgctgctgtagtccaagccaatgtattcagtaatacccttcacccctcagttctcatctgagttcctgtccttttttatataaccccaaaggctcagtaagtcgctgcctcccaggtcattgggcccattgtgttgaaatccaacttcgaacgacgccccttccttgccaccatcctcaggtccagttcccccgcgcacagccttcctcaccgcgcatggtgtcgagcccacttccacctctctgcagtgctgcagacaacctctagggctctgcgagtcccccagcgagagctagggagccgacaagctgcgacctctgcgagtccgcgctgcgggagcgggtggcttgcacctgctccccgcgcgccggctctgcgacccctaggcaagacgcagcccaggaggctccctcccgagtcgcgccccggaccacgccgcaatgcctcgtcaccccagcaacaagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggagaggcagccagctccaatctcctcctgaggatggaggttggggaaatggatgcagaacttgtcaccctagggacgaaggggcggagggaggggggattggaagaaaagaatagaagagaccatgaaaaactctctctctctcttacacacacacacacatacatacacacacacacacacacacacacacacacacacacacacacgagagggagagagagagagattccggaaaagacaagatgctaggagcccagtcgcttctctccccactgcccagaggctaggaggtgcaacagatagatacccaagctcgccgagtagcaaaggggtggggtgagagaggagtctccaggtttccccaggttgcaaaaggggcacaaactcctgtcagtgtccccggaggccaggggaggtgcagcggcgccgcggtttcccccaccccctccccggacacggcaaactcttccccggcaggagccttccacttggccgcgcctggatgtaaacaggccggcccgaggggcagagggcgggtgagagaggggaggcggcgaggggaggagggagcgggactcacccttgatgctggggggctttctcttcttggccatcttctgtccccttccctcccccggaccccccacgcgcttcctccggctgccgcgcagctcccaggcgagccctcgccgcggctctcagctcagcgagctctttgttgctgtgatggcatctgcgagcagcagcggcggccgggctgcgcgctcagctcggctcggctcggctggggcgggcgccgccgcccctctgctctcggccgcgccgctggcccccctcttgcgctgctgtggacgcggtggctgctgcggcggcggcggctgctgtgctgctcctgctgctggagggggcagcgctgggtcccctgagcgcccgcccagcgctgacctcccccttctccacaccctccctcccccacgcccccacccccggtgtcccgtctgagccgccagcccccatccaaccggctaccgcgccgtcatccagcagcctctactggaaagacaacggtggcggcggcggggagctgctggggggcgcggagagaccgcggccatctggggccgggaaggagaaagccaggcagagtctgatggagtctgcctccggcctgccttcctctgggccttcgaagccccctctcaaaaggccaggacgcgctgggcccaagaaagacacccgtcttcacaggccaaccagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagaggggagagggaaacaggagtctgatggaggggagagaaatggaattccagaggcagcccacgggcagacacctgcaagaatggctgtgttctggccctgaagttcttaatagtgagggcccaggatagttcccttggggctgtgggaaaagagggaagttcacgctctcagatgttggaggaattggaagccggaggtgtgatttcttggcctccagcagaaacttggttacagtggccacgttctttctctctctgattgggggtttgctttggaaagttctcatgttcctggaggagctgtcctcccctcgcgtgctgataagggatgaaaagaagttctgctggcgtcccagaactgcaagggcaggcgaaagtttaagaatataaaggagtatcggaccttaaaaagaaacgcttaaagggtagggtagggagaggttaccagggtgtgccactgtgggaagaggctacaatatcgaattttttttatatgctgcagctgagattgccgccgaaacgcacttcctaattcgcagtgaccttcttaacacttctcctttcctcctcctaggttagtacagttcccagcccaatctgattgtctaaacattcagtgagttaattcaatatctccacccagaagttgccccagtactagtgtggtgcggcaaaaagaacagtgaagtcaaaaaccccaattgtgaattctggccctgtaacttcgtagctctgagaatttggacaagtcactcaatctctctgctcttctgttttctgatatgtgcgatatcatctcaaaaatttcttccagctcctgagatattagtgacaaaatcatcacaagttattttttcagcccttctaaatatagcttcatataatgtaatatattgaagtaaataatctagaaacatgtgaaatgaccaattcctctcacaatgaagatgtgcatcagaaataaaaaacaaagaacatgtttcttttaataagcaaaatagacccattctcagacttatgatcagaaataagactgactcaaagttttcctcttccaaacagctgcctcttatttaattaaaaactactcttctaggtcttcaaatgtttactgtgtataatattagactttgtaaatatttcagtccattttatgtgctcatattttatcaccaactactaattattgcctatattagaataatgtttttctgtttattcattactttcacatactttatttcatttaatcatgaccacacccatgagttgaaaagcaggtcctgtcttctaggttttacagacggtgaaatgggattcgtggaggtatgataacttgcccacagcttcggtgtaactcttttaactcaatacccagctctctccacaacactagctgcctatgtgaaatagaatatttctgcttcagaccaggaatggtttcctttttctaatttattccttccacaatgtcagtactattctcaacagaggagactcaaatttagttgactagttaggactatttttggtacatggatgtgattaatatgcttttacactgttagcacttcaaagtgtccttacatgcattatctcaattaaggtcatgacaatcacataagatcatcaaaagaggtttattcagccctgctgaacagatgaggaaactgagaccaaaagacattaaggccacaactacccaggccctggatttccaggccaagtgtttcccctatagcccacactgtgtgtttttgttcaagggttgcaattagaatgactgcagggaacagtaagacagaatacatgacaccatcagtataaatatacagtcatgcattgcttaacaacagaaatacattctgagaaatgtgtctttaggtgatttcatccttgtgcaaacaccataaagtatacttaaacaaacatacatggtatagcctactatacacttaggctatgtggtataatccattgctcctcagctacaaacctgtgtaagatgttactatactgaatattataggcaattgtaaaacaatgctaagtatttgtgtatccaaacatatccaaacatagaaaaggtgccataaaaggctgggcatggtggctcagcctgtaatcctagcactttgggaggctgagatgggtggaccacctgtggtcaggagttcacgaccagcctggccaacatggtgaaaccccatctccacaaaaaatacaaaaattagctgggtgtggtggcaggtacctgtaatcccagttacttgggaggctgagacaggagaatcgcttgaacctgggatgtggaggttgcagtgagccgagactgcaccattgcactccagtctgggcaacaagagcgaaactctgtctcaaaaaaaaaggggggggggaaggaaagaaggaaggaaggaagaaggggagggaggaagggagagcgggaaggaggcagggagtgagacagggagtgagacagggaggatggaaggaaggaaggaagggagaaggaaggaagaaagggacggagagcaggagggagggagggaggaagggaggaaggaacaaaggaaggaagaaagaaaaggtgctgtaaaaatgcagtattatgaatttatgggaccactgtcatatattcagtccatcattgactgaaatatcattatgcagtgcgttgctgtatagatgtacttgaccaagggaaggggactgtagagaactgagagggtgtgtaccactagtcagctgcaggatgccttgtgggaatgaaaacgtcggggctgtaagaattctgatttttcaggagtcagaaatccaaattttctggtgaaatattctttttgatgttgattaatacattaaaaaaacaaaaacacaaacacaaaaaagggtaggcctaacagaacacatctgccaataatatgtagactatgagctatgtgtccatgtgtctgtttttaaatttcatcaattgcttttaacctccaaacagcaagggctgaaccaaatccttgagtatggttctaattctgatggcatctaatgtccctagaattagagattaccaaggccttgggtgcaattaattatgatttataaaaatgatttgtgtgataggtgtttctaaatttctggctattctttttattattattatactttaagttctgggatacatgtgcagaatgtgcaggtttgttacataggtattcacgtgccatggtggtttgctgcatccatcaacccatcatctacattaggtatttatcgtaatcctatccctcccctagtcccccactcactgacagaccccagtgtgtgatgttcctctccccgtgtccgtgtgttcttattgttcaactcccacttatgattgacaacatgtggtgtttggttttctgctcctgtgttagtttgctgagaatgatggtttccagcttcatccatgtccctccaaaggatatgaactcacccttttttatggctgcacagtattccatggtgtatatgtgccacattttctttatccagtctatcactgttgggcctttgggttggttccaagtctttgctatcgtgaacagtgctgcaataaacatacatgtgcatgtgtctttatagtagaatgatttgtaatcctttgggtatatacccagtaataggattgctgggtcaaattggtatttctgattctagatccttgaggaatcaccacactgtcttccacaatggttgaactaatttacactcccaccaacagtgtaaaagtgttcctatttctccgcatcctctccagcatctgttatttcctttttaatgatcaccattctaactggcgtgagctggtatctcgttgtggttttgatttgcatttgtctaataaccagtgatgatgagcattttttcatatgtttcctggccacacaaatgtcttctttcaagaagtgcctgttcatatcctttgcccactttttgatagggttgtttgtttttttcttgtagatttatttaaattctttgtagattctggatattagccctttgtcagatggatagatagcaaaaattttctcccattctgcaggttgcctttgcactctgatgatagtttcttttgctgtgcagaagccctttagtttacttagatcccatttgtcaattttggcttttgttgccaccattgtttttgatgttttagtcatgaaatctttgcccatgcctatgtcctgaatggtactgcctacatttttttctagggttttcatggttttaggtcttacatttaagtctttaatccatcttgagttaatttttgtataaggtagaaggaaggggtccagtttcagttttctgtatatggatagaatttctggctattcttgaagccatcaatgagaatgatcacagtaaatgaaatactttttaagtcacatgtggttcttctgggcacagagacacacatttttcctgatagtgatgacaaggttctgacaatgaagatgatgacaaggacaaaactggcctcatctctatttcccttaaaggatagttctgaatgaacccttttgaaaaatagacacagaactgaaatggtaacattagttacatgtcgtataatcattattcttagatttttctagccatgccaagactacacataaagtaagaaatagtcagaatgaggaaaggaatacatgttcctacgtggaagtattaagtaagctcaacaggaataatgaacttatacaaattatactaaagacaaaaatgaaaatgtaattcatagtacacaaagcatgattgccatgaatgtatgttagtgcaattgcagtgaaaaggttgaaaaatatgacccacagaagagtatttttgactgaaatattttacattgaatacctgtgcataaattaactaccgtagtttagagaaaaataaaaagaaataacaaatgtcccaccaattttaataatattgtaacatcgaaggatgtcaaatgatccaaacttgctccactgttgaaaaaccacattgtattttaaatttttacacacaaaaaaatcataatattcacctcagctgaggtttttagggactgtacaattctgtgactggaaaggttaaaatagaaataatagttgaaagagaatgagattagccagctagtccattttttaaaaaatttgtttctggcacttacagactcaattaacatatgaaggggcggagaaactgaggttggcttcctaccccatgccacacaccattatgtacacatgagacttaaataacacttcttccctttcttgtgactgacacagatacttactataataaaatttcacctgaattaaacagaaggtcttagggtgagaccctgtagaatttttaatctctttactccattctgattatcacattgatgatccttaactcagaaaacatgcaatttcatttatgtgtgtttgaattgggcagaaagatatgaaattcagaaacatcattgaagggcttaaatgcaaattctgagtttcttagataaaaccttcacaaagagagtcctcctcaccccacccccaacactttactgctttcaaagtacccataacactactattactactagcaattaaaaatattgtgctcaatctgtgcagaggaaaattttgttaattttgccaagttcaatttgccaactgtcatcgaacctctagaattgcattcctctagaaggagttaattaatagggcacttctttgtactcacagtgaagtgtctgcttattgcagttcaactccacagaaacccccccaaaaaaaataaagaaaaaaagaaagcatttgggatggccaagaaatcttaaagctagttatctaatcatataacccagaaatttcaccaagagaaatggcacagacctggcttgagtgagacagagtatgaatggaaggacactgtcagacattacatagagatagttgtgtataatccaccgttaaactctcaaggttttctgaaaaatacataaacaactagaattggtttctttaatactccagttggcctgctcaaggacagaattttctatattactcctgccagcttccaattaatcaatttacctccaaagtgttcttaagttgtcccattataatttgtttataactttggtccttggctcagtttaccaactcattccctcatatatgagtgaatcatttgcataaaaaacaaatggcataccaattaactaaatgcttctgacatatttttgacaatgaaccaaattgtatttttccttgtcttctcttttctacttctcttaatgcagtaactatcaaacatttattcaacaaatatgcattgagtaaaactatatgccagtcgttcttttaagtgattggttatataatggagaaataaaacagcatagttcatacattcatagtatttacagttttacaagggagatagaattaaccaaataaatagataattacaaattgttacaagttctatgagaagaaaaacaaaaaacatagtgctataggagagggcaacatatagcataatttagattgagagtgtcaaggaagattcctctaagaatgtgatgtttaaaaagagaaatgaatgacagaaatgaactaggcaaaaagtagggaaaagactgctccaggcagggaaaacagcatgctgaaaggcccaggtaggaaattcaagatcagagcagtaatttctaaattccaaactgaccaagcatcccaccaattttttaaaaatttctcacacttcttcaactacatttatctggttacttttatattgtgtatactattgtactgatatattatatattataaaacatacacaaaaatttgaaagtctcaaaggataaggtttttttttaaaatggaccatcttggacactttcaacttcagaacctcctgaatgagatgaactgaaggaccaatgtggctgaagcttaggacatgataatattaagcagagaaatggtataatataatttacacttaaaagtaccagcctggttcttgtataggtaattggaataagccctataaactaatgatatagctatagaactggttgagagttaaatttgcacaccacacctcagttgtgctctggagcccgtcattgagttggggactgatactgaaactttccatttaaaagtaattcaagaacctacaagcaatgtactccatagccatgagcacagatgacacccacatcttggtttctaaataccatcattcactaaaagaaacagggatccttggaaaaatgactccaggtctgcagcagggaaagtaccaggtaaacctggaacatattgatgtgtcagaaaacacaaaagaactcagactaattagatcatgttaaaaggacaaaggagccagcttgaagtggttgtctactgatcaaacatatgaagagctgagccccaaaaagattaactatgataatgtattctaatacattgaataaaataaaatgtgtaagtccatagtgatagtcaaaagagaaaatattaactaaatattaactatttttagaagaatatgagctaataaatgtagaagaaatgatagaattacaaagtcatcattttgcaatgcccaatgtaataactatgaaatcaacagatgccagaatcattggataaaaggttgttgggaacatgatatgcatatggtctcaaaatattgcctcatatgttagtcattaatttttttttcagagtgctaaggctttattacaaatggagtttacactagaggggctcttctccaatctttcttctgtaccctcttctctcccaaagatatctctctaggggaggtcagtaggccattagagaagaggaaatctggagaatgaaaaagagcactgctcttgccaaagtcctctgaaacaaccactgagtccttctggctccagttgagaatctggaccttgaaaatgagagctaaacttcttccactagaagaggatgatcactgatgctgcgggtcctctgagacttagcaatatcttctctctgaacctcaattttgagttgcccactcacagccatcactatgatgttcctttgaacacagacctctactgaaaccagctctgctgtgacttatggcaagtatatgaatgcttttttctaaattaccctttatatctcctcagggtcactaaagaaccctagatctcttccataacgtgcaccagtcactgttcggccaccatttttattctactgtgtcacctcacattgacacagggcttctctcagagacttccaacctctcagctactgatgttccaaagttcccgcaaaaactatgaacccactgagtcgcactgtgagtaaagggcactgcatcatctctcacttacttgtctcccacacacaccccttaactcctcccctaggactttctacttttcatatggtgggacttcccttgtatcatctcctccatgccttctacattatgacttgttgtaatattctatttccaaagagctaaattttccttttggtttataaagggctacttttggaacttagaaaccagaaactatttcctcctttcaaaaatcctggatttcatgacaattgtctcacaaagggctcaagaaaattggccttgcaattcaaaaactgaagaaagatcccttttctctaggtggattatgcctttccagaagtaacaaatgccactaattcaaggcgtaattagccactgggcaaagcatttattaggaattaaatattcattggtttcgcaggccaaaaatactatcttcactagggttaccaaagcatattcaatcggaaaatctgaattctggttgcaacttgtcaaatgatacactttgtgacttttgacaactcccataataaaaaataataggatcagcaatttttgagcccctatttgggccagtgaagctggactatcagtgatactgcgtctcttatttatttattttctggtactcctgtctatttatttctggtagtctagtcccccagttaccatcctaaatcttcaccatacccctgtagtttctgactccagccttccaatgtaagaaaccataagcttctgtagtttaaattgctgttgtgtttactgatatttgcagtcactttcctaactggtgcaccaggtgggtctgggtgcagtttgtagatatggtggcaagaagttaagaaagcttctgtgcgcttctagtttctctttgaagtagggcatatagttatctgctgagtttgaggaagtatgttgtggggaagaacatctgagaaaaccggaaatgattttacatgcctactgtggagaacaggggaaaggaataattaagaaaacattgaaagaatcttagtcactattagggtcaagatgctgttaaaggcaatggatttatttagagcagaatcaagcctgaaatcattttattttgctccgtcaatgtaaaggaccagagaaggtcagtgatcagattcatctagatgtgtgttttgtaacaaggatttgagagaaggagaacagggcacagagtttaagagattcataagaaacaagaagtagtgtgttatggaatccagccagaattaacaaagatgtgaggaagggaggaggctgaccatctctctctctcctgctaatatacctgcaatggtgttccattgctcatagaaaaacagttcaaacactcaagatgcctacacaggaatgatctgactcatgactctttccagcctactcttgtgttgctcttgccgttgttctctatactcaagccatgcacacagagggctgcaagaaaataagccaaatatataatttttgatgaattctatttgctttcttttccatgtacatcctctcagcctgccttttctagccaaatctttattgcttccctgggcttatttttcattagctcagtcccttctctctgttctagcaacgccacttttaactttaattcttttaatttcttctccttgaaacttaattgatctccctgactccattctttcacctctctaatccatcttcacattgatgccttggttatcttcacattactctgagcaaagcatattatgcttctgttcttaaagcttttatagtacagcatgagcttcctatgtcatgtaaagttctccgctacctggcaccagttcaccttcccagcctcctctcttctactctctgccctcaacattctatgttctaggcacactggattctttataattccttaaatatgccacatatgttcatatgggtttgttttcaatcacattgttttttcacttcccatctccatcttttaaagtcctagtcatcccttgagtcataaatggtactcattttctgagaagtaatggttccctttgtgtattaccgtaacatgtcggttatacctttatcattaagatttatttcatttacattatatcttgattatctgtgtggatgtctgtctctgtcaaactagaaggtctgtttgggttgagattttgtcttagtcattataataggaacttagttcctagttcagtggtaagtaatccttaacaagagcagtaggggatagggttgcaatagtattttgggatcagattagggagcccctgaatgtcaagttacaatgaagaaagggactaagagtggtggctctcctgtaattctagcactttaggaggccaaggtgggaggatcatttgaggccaggagttcaagacccagcctaggcaacatagcgagaccttgtctgtacaaaaaaatttttttttaaatatccaggcacggtggcacacacctgtagtcccagctacttagaaggctgtggcaggaggattgcttgaaaccaggagtacgaagctagagtgaattatgatcatgtcacccactccagcctgaccaacagagcaagaccacatctctattaaaaataaaaattaaagaagaagggaaattcgtatataatagatatttaataaatactttttaattgaagagctgttaataacccaaatctcttttttttcttcatttgacagattctaagttttcccatttgcacaggaaaggaaactcttcctttattctttggaatattattaattgattcattcattcagcttttcttgagcatctagtatgagttgaaagagaatttatagtccatctaattcagttttctcagtttaaacctaaggaaactgaggcccagcaagttgaaatgatttaacataggtcttacagctagtacgtggcgaaataaatgactagaagctagtctgtgccttgccttctaacccacagcttcctaattttacaaaattcttacaagtttgagtaggtgataggcagagtgatggcaccctagaaacctatgcagaaaaagattctaattaccaaattcaaaactttaggatatgaaagaagtttccctctgcctcaggctctcattgctttatatctgattttataaaaccttcccaatttgtttcactgctttcatagttccctctctgcaaattgatttcacatatctgtatcagaccacatgctagttcccaaacctaaaatgaatgtttcatttcatcagtcacctatttaaaaatcctgtctacttttcattgattacagaatagaatattgattacagggtaaaagacaggtctagattcaaatcatgcctctaccttgcctctttcttccataagctgtgtttcaagcaaatcacttaaacattatgacctttaatttctacaactgacaaatggcaataagagagtttaaggtttcgatattggatttcagccaaatatttaaaaatatccttcccatataacttaattatatgaatagcaaatgggaaaaactaaagcagcaaaaaaagtaaatagcattcaaacaagagaaaggttcatgtcataacattcaaaaaattgtagccatcaaagaaagacacaaagaagttttcaagaatttacagaataaagcttagaacagtatggcaaacctcttaatgtcatcctccaaacaagcactttgtagggaaggtgagcaaacaaaactctgaaaagtataaccacctactcctacactataacatgggaaaggtagctttagatgaaatatgagtaacccttagaggagacaaagaattttgcaaggggggaaaagtcccatctcaactagttgcatgttctaccagaaaagggaactattggaaatctcccttttggcatcttccagctgggtgaaaaaggagaggatgatggcagaacaatcataaacacccatagttaattatctccaacaataaatagtgatatagcagaaaggaagaaaaaaatagaaaataattaggacaagagtctctaagggagggaaagtggagaagaagcatgtgtagtgcctgaagggaagtaacctacatgtacttcctatgttgtttatttttttcccagaagataagagagaggagcttgggaggaagagaaattgctactggggagaaatgggcaaatatggaaagggaaacataaaacaagctaatgacattgaaatagagaactcaacaaacaaaaccaaattccagattactttctttaaagcaaacaaagaatctgggctccatgttgattagaagaaataatccaaagcccaagaatacttctcagtgtaatgaatataaactccaatagattaagattttagcacagaaaacatttactaaaatttcagaagagagtagagtgtggatcctcctccaactgtacacagccacagttgagctctttcttcctccttgaatctaaggtaatagaaaagcaagtggaattcactcacactatagcacagcgaagagaaggcctaaacaaaactgctgtattttaaaagataaaaagaagggacacaataactttgcaaacacattatcagcaaaaataaatacatatgagaaagaaggatacaaatacagatgaaaaaccatgctggaagtaagcagaacttcacaaagaaataatttccagccagtgcttcatgatataaaagttaatgagaacataaaatcaatttttaaagaaatgaggtgtaaaacagtattgaagatgaaagggaagaacgcaaagctgagaaaacaaactgagaaccacacaacaccattaaaagcaagttagaaagcacaagatatatctccattgaatataatttcaaactcaaaactcaaatttaaatttcttctatccccagcctatgtaagtaggagttaaattagcttttctttttctagctccatccccccaatttgctagtcattgtttctgatatctgtggggaggagggtaagagttggggaaatgcagcacagcttttgtgacagctacagttgtaatctacccgcagggccctctgggtggcagaaatacaatagctgactctgtagggtgcctttgtgggtttctcatcaatcccaggcaattggcttgtctgcctcttttctgtctgcctgctggatttctggggtccacctctcagttcctgtccttcaggcaagtactcttggttacaatcatttccatagggtccttatcaagtctcagaaacattcaccattagcctgccacatgaagaagtacagctcagtcacaaagcagccacctgcgtgttcagccgccagactgggcagttccagctacagcatctcagctttagaatattcactggtaagatgctcaagttcctggagacatgcaaaagctttccaagtggtcctctagaaaagcctctccttaaccttaggagagaggattctgcatctaccacattctgccttttttcactattattattattattattactattactgggctatctgactggtccaaattcaaggacaggtgaaaagacaacttggcttctacagaaggttgtttttacctgtttactcccaaagagtaaataaaccgtcattgataaaaataaaataagaagagatcagtggatgcaactccccatgctttaagtgtatttcacagaagctcacctgaggttcagaggaattggcaactgcccaattttccaggtcagagaaagacatggactcgctgtctttcaggtccccaactatgtcaatactcagaaacaacttagaacaccaacagaaggcattaagtcgcctatccggggagccatattcttcagggtctgaaattcttgctgtgccagcactgaggcaatttccacttctccgagcatgctctgcagtgtctatttagggtatttgtaccatcaaaaaatacatccacttctccatcagaggctggtacttaaggtgggtgaaatgtaaaacactgtcaatttctcaccaaataaatctctttctcttcaacctcaacttcttatgtagactagagaggagtgaatcactgcagctggcagaactagtttagaaccttgacctttgaaagttcaacatgaatggtctggttcctctctttagaatgggaaacatattgttttgttgttaacttttccaacagtgcatcttgttgtctaccatatcctttcttgtattattactgctagggtatctgtgacttccctaagacagagacaatatcactcctttttttggagacagggtctcactctgtcacttagactggagtgcagcagcctaatctcatctcactgcaacctccacctcctgggctcaagccatcctctcacttctgtctcccaagtagctgggactataggcatgcacaaccacacctggctaatttttttttttttttttttttttttgagacagagttttgctctgtcacccaggctggagtgcaatgtcgcaatctcagctcactgtaaactctgcctcccgattctcctgcctcagcctcccgagtagctgggattacaggcacactccactgcgcccagctaatttttgtatttttagtagagacggcgtttcaccatgttggccaggccagtcttgaactcctgacctcaggtgatccacctgccttggccccccaaagcgctgggattacagacatgagccactgcgcccagccaatttttgtattttttgtagagtttttgccatgttgcccaggctggcctcaagctcctgagctcaaacaatctgccagccttggcctcccaaagtgctggattacatggatgagccaccctgcctggacagtatcactcatccttattttctctgcagtgcctggagtcactgacgacaaatcataagcacttgggaaatttaattttaaggagaagccaacttttcccttcctgtgcacatattacccacccttcagtcctggataaggctaccttttccatgaagaattcccttctatttcagccccattattttctccgtgtctctgaactctgaaactttgttcatatgatgcttatgtcatcatgtaaatttttctttaccttgcctcttcagtacagacttgagctctttatggatcatcttatacttacttctttagagacattcttataaaatattcaataaatattgaaacaaatgctgtgctaactcagataaaaaaatcatctcagctatatgtatttcagaaggagctacttctttttttttttgcttgtgttgtgtaacattaaactaaaaataattcaaacaaggatcatcctgaaatgttagagcaagagagaactttagagatgatcagttccacacagtttactccattgtaatgaagtggcatcttacaaatgctgcctcccttcaccctctgctgaccattctagaaactgcaccttttaaaatctcattgcagaatgactatcattcctgtttttccatgctcctgaaattgtttttcaagagtcaggtttaaatgtgttctatataatggcacttgttcacgctccagaaaaactaagactctattacccacagggaatatttgagcacttgagttctagagccaaattgcttatgttcataagttagtccttctgcttctggctcagacaagttacctaacatctctgctgatcagtttctgatctaaaaaataaaaacaacaataataatggtgatctttaaaagttgctgtgaggctaaatcaattagtgtctgcaaaacacttaaaacagttcccgaaaacagcaagccctcattattatttggtggtgctggtagtagttgtgattaataacttttataccaatgacaaatatttcttgtttgttcattttagcaggctaaactggaaaagctatacacacactctgatctattcatctttaaatccctagtattcagcatggtgtctgggacatagtaattactcaacaaatgtttgttgaataaagtttataaataatatgattacttaaaatgcaagctctttgttcttttggcttaggattggcttggcgatgcgggctcttttttggttccatatgaactttaaagtagttttttccaattctgtgaagaaaggcattcgtagcttgatggggatggcattgcatctataaattaccttgggcagtatggccattttcacgacattgattcttcctacccatgagcatggaatgttcttccatttctttgtatcctcttttatttcattgagcagtggtttgtagttctccttgaagaggtccttcatgtcccttgtaaagtggattcctaggtattttattctctttgaagcaattgcgaatgggagtttactcatgatttggctctctgtatgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtctttgcccattcagtatgatattggctgtgggtttgtcacagatagctcttattattttgagatatgtcccatcaatacctaatttattgagagttcttagcatgaagcattgttgaattttgtcaaaggccttttctgcatctattgagataatcatgtggtttttgtctttggttctgtttatatgctggattacatttattgatttgcgtatattgaaccagccttgcatcccagggatgaagcccagttgatcatggtggataagctttttgatgtgctgctggattcgctttgccagtattttatggagtatttttgcatcaatgttcatcaaggatattggtctaaaattctcttttttggttgtgtctctgcccggctttggtatcaggatgatgctggcctcctcaaatgagttagggaggattccctctttttctattgattggaatagtttcagaaggaatggtaccagttcctccttgtacctctggtagaattcggctgtgaatccaactggtcctggactctttttggttggtaagctattaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagacatatgtagaaagctgaaactggatcccttccttacaccttatacaaaaatgaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagacaaaattgataaatgggatctaattaaagagcttctgcacagcaaaagaaactaccatcagagtgaacaggcaacctacaaagtgggagaaaattttcgcaacttactcatctgacaaagggctaatatctagaatctacaatgaactcaaacacatttacaagaaaaaaacaaacaaccccatcaaaaagtgggcgaaggatatgaacagacatttctcaaaagaagacatttatgcagccaacagacacatgaaaaaatgctcaccatcactggccatcagagaaatgcaaatcaaaaccacaatgagataccatctcacactagttagaatggcaatcattaaaaagtcaggaaacaacaggtgctggagaggatgtggagaaataggaacacttttacactgttggtgggactgtaaactagttcaaccattgtggaagtcagtgtggcgattcctcggggatctagaactagaaataccatttgacccagccatcccattactgggtatatacccaaaggactataaatcatgatgctataaagacacatgcacacgtatgtttattgtggcactattcacaatagcaaagacttgaaatcaacccaaatgtccaacaatgatagactggattaagaaaatgtggcacatatacaccatggaatactatgcagccataaaaaatgatgagttcatgtcctttgtagggacatggatgaaattggaaatcattctcagtaaactattgcaaggacaaataaccaaacaccgcatgttctcactcataggtgggaattgaacaatgagaacacatggacacaggaaggggaacatcacactctggggactgttgtggggtggggggagggggggaggaatagcattaggagatacacctaatgctaaatgacgagttaatgggtgcatcacaccagcatggcacatgtatacatatgtaactaacctgcacattgtgcacatgtaccctaaaacttaaagtataataataataaaaaaaaaatgcaagctctgatttacactcagtccaaatcttgactctgccatttaataggtatgaaacttaactttggggagggattatttatgtatttatttttaacttgtttaaatttatggggtacaagtgtaaatttgttacattcatagatcgtgtaattgtaacgtcaaggcttcagggtatccatcacctgaataacatacattttccccattaagtaattcctcatcatgcacccctgccacacccacccattcacccctcggagtctcctttgcctatcatttcactctctacatccatgtttacacattttttagcttccacgtatgagtgagaacatgcgatgttaggctttttgtgtctggcttgtgaaacttaacttttctgaactgttatcatatatataaaatgatggtgattacagctcacacttcctaagactgttataagaattaagatattatatacaagaaaagcacttacaataagatctggcacagagtaaacaataagtaaatgttagataatattatttataaagatttcccaaagtaatatttataaagtataagcagacttgtaagagcatctgacatacctgagtttgaattctgactctaccatttgctagatatagggatttaaacatgatacttagcctgtaaacccaaaatcctgatttagaattcagataatactacttcctttctgttttaagaagtaaatgaaatggagtgtataaaacaacactgtgcctgaggaactgcaatcatttaataaatgactagttttgttttgctgatgtagttcttgtttttattattagctttgccaataaggaattttaatccagataagaaacaaagaaataaataactacagtataatgcaagtaaatgtcatggaaataataaagttaacaaatgctttgacagtttatgagtaggaatgatcagtgtgagctgcagtaataaagaatactttctgaaacagataacatttctataaaagaaaatagagaataggtagatatcccaggcaaaaagaagtatgacctcaggaaaggtaaaccaaagcacaaaagcaggaagaacaaggcttatttgagcagtagagaaaatgggcacaattagtagatttattataaagatattcatcaaattattaatccagacctgcactgaccaatatggtaatcattagctgtatgtgactaaagagttctcgaaatatggctagcataactaagggactgaatttttaatttaacataattttaactaatttagatttagaaactgaaacagttcataggagccagcaactccattcctcagtatatattcaaaataattaaaaacaaaaactcacaccaatacttgcacaaaaatgttcattgcagcactattcacagtagccaaaaggtggaaacaacccaaacatccatcaatatatgagtggataagcaaaatgtggtctatacatgctatgggatataattcagccataaaaagaaatgatcctgatacatgccacaacactgatgaacctcaaaaaacattatactaagtgaaataagccagacccaaaaggacaaaaattgcacttacattaagtatctagaatagtcaaagtcatagagagaagaagtagcgtagaggttaccaggggctagtggaagtgaggaatggagagttattgcttaatgggtacagagtttctgtctgggtgatgaagagtgtttggaaataatggtatggttgtacaacactgtgaatttagttaatgacactgaattgcaactgaaaaatgtttaaaatgacaatatttttggtgatatatattttattacattaagaaattaagcagagtaaaatatttttctgataaacatatcttcattgtatttaaagtttatcaattccgggtcaaactgggggagtggagaagacaaattaaaaaatattttattgggaaaatttataagaattgaaacatgggaatacccactatacacagacatgcctttaaaaggactatccatgagatccccttaaattagcctcttccaaaaagatattaaaatagtgcttgaaattttaattcaaaagtatagtgaatttctttccctctattacctagtacctcactgatataaatccgcctatgcagttgacatagttttgccaaattattgtatattctcttgaccttccttcttaaaatatttattataattgtgtaataatagctaacatttacatggcaattgttgtattaactcttttaatcctcatgacatctctatgcagtaaatatgatacaaaataaaaagacttaaataatatgacatcatttattgtcttattataatattagaagctaatagtacgattaaagcaagtttcatgtttcaagtatagtgactctgatggccatcactgctccaaaatcacacaagtgaaacatagaagcatttgtatgatttaacatagtaagtagaatctagttttaatagctattttataacctgaaatgtatttattcttataataacaaacacagtgttaatatgtattaaagttgtaggatcttaatatcaaaacaaaatgaaataaaacctgcaaggaatcaggaaaagttcaacactgtcccatgaggatttatagtgaggaaagtggtgcagtctaggtttaactaaggtaggaaagccaacgaaagagcccaggctgtgttacacagagacagcaattgaatatactccacagctgaaatcataaagtttctcaagcaacccattaataattaaatttgctttctctgataaatcttgtcagcctgctccaaggaaaacggtccttctttctttgtagttttcagccaatcaacttgcccatggacaaaaaacaaaattcattatttttatgactatacatagctttccactatgtatatttaccacattttctttatccattccttcattttcgacacttagattcattccaatatcttggctgttgtgaatagtgctgcaataaacatcagaatgtagatatcttctgccaattgcaacaatatgaatgaacctggaggacactgtgttaagtgaaataagccaggcacaggagcacaattatcacataatctcacacgtatgtggaatctaaacaagttgattcatgtaactggagagtagatgagtgatttccacgggctgaggtggatggggggaagagagttggaaagatgttggtcaaaggatatgcaatttcagttagatgagaggaataacttcaagagatctatcatacaacatggttatagttaataacaatatactgtattcttgaaaaatgctaagatagtggatgttaagtgttctcaccacaaaatgataactatgtgaggtaatgcatacgttaatcagctagattaggtgaatccacaatgtatgtatacatcaaaacatactgtgataaacacatgtaattttatctgtcaatttaaaacaaaacaaaacaaaattattgttctaccagtctatagttcatgttttaataaagccttctttacttttgttccatgataatcaacctatgcttgatacagggaaaatactacctctctcaaatctaagtaaactcagctcagtttctagccaaactaaatacctctaaattattctttgactgttattccgataagcctctgagcccttagaagcatgcagcctaagaaagtttttcatccagacccaccgtgttctgtcttgcctttgctcacttccccagtgcatgccattatacagggatcaaactcatgggcttttacatgctaaacctggctcttagccatgtgtgtttttgttcacagttgcagttgaattaatgttgggaaattgttttctatggtctctgacaagttacaggtaactgggaatctgcttggccctttatctttgtttagttgtttgtctgactgtcatagaaattctgatatctcctgatatctcttaaccagatgatgagataagggggtagtcagatttggctggcctcagccttggggttgaggaattgcccttgtcacatctgcttgatttgttaacttttccaaccattgaaagaaacttcatgttgtttgtcttatgatctataattgctttggtcagttatttttaggtcgttgtactgaaagggggaaaaggccttttactttccttagaaaataaagatatgtaagttacttgttactgtgtggcaaaccaccccaaaacacagtgccttgaaacagcaacagtttcgccaaatttttgttgagtttcttctgctgatcttgccaagcctaactcatgtgtttgtagtcatccctgtattcagctggggctggatgatatcatacaacttctcttacatgtctacagtctcagcttggatggttggaccagctaagccagctgggtctctctctatgaggtctttcatcctggcttcttcacatggtggcagaagtgctccaagagagcaagccccagtgcacacatgcttatcaagcctttgcttgctgtatatctgctgatatcttgttggctggagcaagtcaatggtcaagcccagagtaaatgtgacagggactacacaagcatatggagacagagaagtgtgattcattgggaaaccatcacagaaggaagcttgtctttataatagtctgtttataatggtagttctttctgtacctgtgagtgattctacctctcattctctctctctctctgggggaaattttgaatattaattgatcataacaatctatcatttgtgcatgctatagaaatatccagttcaaacagaccttcataggaagaagatgcatgcaaatattaaaaccagtttttcatggatcatgaagtagagttgtgccttctgaaagagctttgcttggtttgtattacaattgtatgcaggctcgaatgtccttaaaatgggaataattgcttctggcttgtctggggcttcatggccttctgaggaaactaaaggattcagagtacatgaattttttattctttcctcttggaaaatattaataaataaaaaagtcccacggaaatagtcacaaatgagccaagtgaagatgtgaggaagaacttcatgtgaactatgacaaaatattataaaatcttacagtagaacccataagttgatcatgtctgaacaagtcttccccaaaaaggacataataaaatacaaagaaaggcaactttagactctcccagagttctttccttgcccagagatatgacaagatacttctgctgagtatgaaacattttctaaacaaatggcatatttgtgtctattacttttttatttttaaatattttattatatttgaataaaatttgtctccatcataatcttacatgtttaaagcatttaagaacacttttgttaagaaagagtccataggcttcagactgccaaagatgttggtggtgcaaaacatgaggaatctcttaacattagtatcgtctccgggcataaactcttcatgtgtatatgagcttgatttttgtacattgctttgtggagaataagcactacttctactgccaatctttctaaagagtctttgacttccactgccagcagaagttgggtaataaatgtaaacattgtgatcttctgcactgactggcttttctacaaatggcttttgaaaaacttcctcatttacttctacatgatcttccccttcaatcagattacattctttgggattatttgggtcacggttcaaaattgcataacaaggaagtaaaataacttcagcttgaagaatactatatacctctctccaatcttgtatgagatactgcatattcaagtcattgattacaaatggattcctgagttttgcataggcaaccactttgtccagtggaaatcctttagagtgcaaagaaaaaagacaatcacataaaggccagttttccactggttccctcaaaataacctcctcttcaaataccactactgtgatatatttaaataaggagacccattcaagaatttccttcattggtttggatttggatttctttgccatggaacatattccaaccacaatctgcctttctggtggagaatcatcttcctcctcatcatcttcatctgcatggtggaagaaatgttgataatttccaggatttatttctgtgtcttctggtccaatgaagaatctgggggcttcactaattttttattttatttgatgtagatataattgaagtgatatatattaaaactgcctgtaaataaatagcatcagaagaaagcattctccttatgttagctgacacacaggtctgtgacagcttgtttctgcttatacaatcacttgatattatgatgacttttggcaaatgctcttttgttcttagataccattgcttcattgttgatatcaaagttgttgttgcaattcaaaatacaaagacagtgaggctactgctttcttgagttgatacagcaatctttttacctgccacgaatatggtcatcacgtgagcagctgtgagatggtcaagcccattcaggtctaggtttccccctttcattctggaggcagggctgaagtgttcgtcaagatttgtgtctatgtctgaaaaaaaatgtaatttaattataaagtctcatggttaaacgaattcctattctgattgacttatagagacgaataagaaattcaataatcttcaggaagaagagagaaaaatttatatcctaatgttttaagtgtgctgaccatttataaaagcttgagaggcttgctgaagccataactcaataaaacaagaaggagaagtatgaggaggaggaggaggagcttactataaattaaattaatggccttggttgcaaagtctcaagaggcagaaaaatataagtagttatcagtttggaaaacagtgggggtaggggagaattctaagagaacagtacttttaaacaaaaattggaaagttttaatatttggtaaatacagaaaaaattgtaaacaaataagtttaggttatatttctatcaaggcgaatcactggacaaattaaattggtttggtaatttggctttaaaaatagctacatgtcttcccctgatttcatcacagtgtgaaaaatgttggcatattattttctcatgagaaacttaattaattctgatttgctagatttcctatactgatttttacttccattaactgttaaaaattataaaattatcattcaaccatctttggaaagatttgctcttgtgagcttcagataataccataaatcatatagatctagtaactttacttatactacctatatcaaattttaaatatcatatttgtctgatgaactgttttaagatcaaaaaggattgtgtttctctttaatgtcaacctcaaacaatttccaaaatctctggctgacttcaagaccccagactattgttaaactaattaatttcattaaagtagtctttggttatctggatattttctaagtagaactaaattcataaatatagaatataaaaacaagcaaatatcgtttaattatatgtatatatcttattcatttacattctagattgtccattagttaacatgatagaaaaaagatgtgtaaatacctttaggtcattggtttggctgtgtccccactgaaatctcatcttgaattatagctcccataatcaccatgtgtcataggaggggcccagtgagaggtaattgaatcatgggggcaggtttttcccatgctgttctcaggatagtaaataagtctcacaagatcccattgttttataaaaaggcagttcccctgcatgtgctccctggcctgcggccaagtaagacatggttttgcttttccttagccttccatcatgattgtgaggcctcctcagccatgtgggactgtgagtccattaaacctcttttctttataaattacccagtcttagatatgtctttattagcagcataagaacagactgaaacagtaatgtgagtatacatggtcattttttctacttcataaaatatagaaaagatatagaagcgtgttcacagaacattaacaatcttcactggagttcattcagggctaaaacacttgtctatgatagacagttctcagttatctacatcctaattgttctgtgactgtgcccattcactagttagttgcttttgttaaaagatgtaaataaaataatgatatattcattacaaagcaataaatatgcaagataatggacatgttttatccatttgtctatcaagggaactggtaaaattttactaagatagtaaaaaaaatttagcatatgcattgttttatgtattaataaggcaagtgtattttgaagctacagtcaagagttttaaatgtgtcatttaaccatatgtgcatttatgtatatttaaaaatatacatacaaaggtgtaataaattagtaaacaaaagatataaataataaacaagggatcattcagagaaacaattggcctataagtatagtttcagtgcctttgtcatactattgaatgactttttaacaaaagttcacctctaaaaaagctaatgtttctaacaattattctaacttgcttttactatttttactattatagtggaaaaaagatttatttcttcacccatcacagggttcatggctgatacacctgtaacaaaatacaaattaacaacaaaaaaaagcctaacaaatttattcaatataagtctttatatatatatatttttttttaattatactttaagttctagagtacatgtgcacaacgtgcaggtttgttacatatgtatacatgtgccatgttggtgtgctgcacctattaactcatcatttacattaggtatatctcctaatgctatccctcccacctccccccaccccacaacaggccccagtgtgtgatgttccccttcctgtgtccaagtgttattgttcaattcccacctatgagtgagaacatgcggtgtttggttttttgtccttgctgagaatgatggtttccagcttcatccatgtccctccaaaggacatgaactcatcctttttaatggctgcatagtattctatggtgtatatatgccacattttcttaatccagtgtatcattgttggacatttgggttggttccaagtctttgctattgtgaatagtgccacaataaacatatgtgtgcatgtgtctttatagcatcatgatttataatcctttgggtatatacccagtaataggatggctgggtcaaatggtatttctagttctagatccctgaggaatcgccacactgtcttccacaatggttgaactagtttacagtcccaccaacagtgtaaaagtgttcctgtttctccacatcctctccagcacctgttgtttcatgattttttaatgatcgccattctaactggtgtaaggtggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgtttgagttcattgtagattctggatattagccgtttgtcagatgagtagattgcaaaaattttctcccattctgtaggttgcctgttcagtctgatggtagtttcttttgctgtgcagaagctctttagtttaattggatcccatttgtcaattttggcttttgttgccattgctgttggtgttttagacatgaagtccttgcccatgcctatgtcctgaatggatggtattgcctaggttttcttctagtgtttttatggttttaggttctaacaattaagtctttaatccatcttgaattcatttttgtataaggtgtaaggaaggaaccagtttcagctttctgcatatggctagccagtattcccaacaccatttgttaaatagggaaccctttccccatttcttgttttggtcaggtttctcaaagatcagatagttgtagatgtgtgttattatttctgaggactccgttctgttccattggtccatatatctgttctggtaccagtaccatgctgttttggttactgtagctttgtagtatagtttgaagtcaggtagcatgatgcctccagctttgttcttttggcttaggattgacttggcaatatgggctcttttttggttccatatgaactttaaagtagttttttccaattctgtgaagaaagtcgttggtagcttgatggggatggcattgaatctataaattaccttgggcagtatggccattttcacgaaattgattcttcctatccatgagcatggaatgttcttccatttgtttgtatcctcttttatttcattgagcagtggtttgtagttctccttgaagaggtccttcacatcctttgtaagttgtattcctaggtattttattctctttgaagcaattgtgaatgggagttcactcatgatttcaataagtcttaacgtgacatgagaaccttcagaaatgaaggcccaaagaaatagggaagcctgtgtatttctatggacagttgatatggcctggctctgtgtccccacccaaatctcatattgaattgcaacccaaattgtaatccccacatgttgcaggagggacatcatgggaggtaattagaacaagggggtggtccctgcatgctcttctcatgatagtgagagagttctcacgagatctgatggttttataaggggctttttccccttttgcttggcacttctccttccttgccaccatgtgaagaagaagtaaaggccattctttctatgctttagcaaagagactggctgcattttgcccatgccctagagatctgtggaactttgaacttgagagagataatttagggtagctggcagaagaaatttctaagtggcaaagtgttcaagaggtgacagagcataaaagctcggaaaatttgcaggctgacaatgcaaaagaaaagaaaaatccattttctgatgagaaattcaagccagatgcagacatttgcataagtaatgaggagcccaatgttaatcccccagataatggggaaaatgtctatagggcatgtcagaggtcttcacagtaatccctcccatcacaggcctggaggcctacgaagaaaaatggtttcttgggccaggcccaaggctttgctgctttgtgcaggcttgggacttggtgccctgcatctcagccatggctaaaaggggccaacatatagcccaggccattgcttcagaacgttcaagccccaagccttggccacttgcaatgtggtgttgggcctgcaggtacaaagaagtcaagaattgaggtttgggaacctccacctaaatttcagaggatgtatggaaatgcctggatgtccaggcagaagtttgctgcagggcagagccctcatggaaaatctctgccacagcactgcagaagggaaatgtggggtcagagccccaatatagagtccccactggggcactgactactggagctgtgagaagaaggccaccaccctccagaccccaaaatggtagatccactgacagcttgcaccgtgcacctggaaaagccacagatacttaataccagcccatgaaaacagccaagaagggggctgtaccatgcaaagccacagaggcagagctgctcaaggccatgggagcccacctcttgcatcagcatgacctgtatttgagacatggagtcaaaggagatcattttggagctttaagatttgactgtcccactggattgcagacttgtgtgaggcctatagcccctttgctttggccaatttctcccttttggaatgggagcatttacccaatgcccatactcccattgtaccttggaagtaactaactcgcttttgattttacaggctcctaagtggaagagacttgccttgtctcagatgatactttggacttggacttttgggttaatgctaaaatgagttaagtctttgggtaactttttggaaggcataattttgttttgaaacgtgagaaagacaagatttgggatgagccaggagtggaatgatatggtctggctctgtttccccacccaaatctcatcttgaattgtaatccaaattataatccccatttgttggggaagggatcacatgggaagcaattagatcatgggaacaattccattctgttctttaaatagtgaatgagttatgagatctgatagttttttaaggggctttttcccactttgcttggcacttctcttttctgttaccatgtgaagaaggacatgtttgtttccccttccatgatgtttaaaagtttcctaaggcctccacagccatgcagaactgtgagtcaattaaatctttttcctttataaattacccagttttggacagttcttaatagcagcatgagaatgaactaatacaacagtcatgcagtatgattaaaatacaaagaatataatctaatgataataaactggaagtaacttagcaaggctgtttactgagacccttctcagtgtttctgtataatgttccttcccttcaggtatagggcaggacacttggcatatgatagtcctcaggggaggaagaagggaaggtcagagagtgaccttcctagattgtatggcctgctttaggaaagaagggagaggtgagagtggccttcatgcttctgatgttttttccaaatgccaaggtgccctattttggggtagtgtctcccaatccctgtcactctaaaccaggggttttaggaaatctgaagatacagttcagggaatcctgaactttgatgggaaaaaaaaggatttttttgacatcctgactaaaacttaacattatgagcatgggcaaacaaataaataaataccactgtaatattagtagtgcctatgattttgtctcaaatgggaattatggatattttataatatattacagctgttgcagaggttgaaatatattttagattcatgttattttgaaattacaataatttttagatcacaagctatatcaaatgtgattgcagtctttttgtcaatagatgctcttgtgatgtagctgggaaactattgggtaactaactctgtgcctagtagttgttcagcagcaaaatggtaatgttgcatgtctttacaatgatgacccagaaatccctatctataattgactgttgattaacgacacaaagggagaagcatcattttcattctccgttagtattttgcaaatctgggcagttcaaatgagaaatcttgtcttaatccctaaggcaacatggccttttgaaacacaaataggtgtactggctacttgaatagaccagacaagtttaaatacatttaacagttgaggtcactcctgaagtgttatttctatttattacttaaaataaatatagataatggattggacagtgatacaagtcatgtatggtgttgaagttctgtgaatagctagaagaaaggtgttaaaagtgttggtctgccttccattcacttccttcaagaaatggaaagggaatggggatccttgggaaaaatttaagaaccaggagacctgatctaatctctttgtcaactgtatttctaggtctattaaatagactaataatattcactagaagaaagataatttatctctgaaaaatctttagcagaatggtcatggccaaggtcttcagtaaatagaatcaggatctatgtcttcttgaagaatgtctcataagctatgtaactctctaagatataaaatatcttagatataaaataggatgcttcatggtttaaacactatgcctgagaaatcccacaaaactcacttaggaatctcacctattctggagcagaggtgtatgcctgtactgaaaagcaaggacctagtgacctgctctcaatgcctcagaatctctctgcttcttctgaacctctggattgcctgtagccttgaaagtatttaataagtcttgatactgggtaatatctcttacttgtttaagcctgatttataataacaatccactcttgtgtgttagctcagcagcagagattctttcttttatattgccttgtgtattctctctctctctctcattattatttttatactttagggagtatgagtacagctttgttacatggatataatgcatagtggtgaagtctgggctattagttttaccatcacccattagcgtacattgtacccataggtaatttctcctccctcagccctcttcccagcctcccagtttctctctttttctaaacatcatctgtattattaagcaaaaacatgcacatgcagcgtgttgtacaaatggtgttcatgagtcattattcttaatactacaaattttataagtaactttgtgcaaaagtaaataacatcagaactgaaaacctttattttgggaaggcacaaaatgccacaagatgacacataaaacaattgccaaattccagaaggatattttaatataattagttttctttgaaattctatgcatttatctaagctttaaaacatatttttgttagaaatggtgtagacttcatcaatctgccacagggtccatgataaaaaatgtttagaatttctgctctgaaccaagtctaattatttcttgcctttaggcatatatgccctatatataagtcttattagaatgacagctcctcagacaaatcttcaggctggagtgcagtgacacaatcacagttcactgtagccttgatctgggctcaagcgattctcccacctcagcctcctaagtaactgggaccataggcatgtgccaccacacccagctaatttttttgttttgttgagactgatctgaaactcctgggctcaagcagtcctctcacttcagccttctgaagtgttgagattatgggtgtgaggcacttcacccagcctagatattgcttttaccgaattcaggccacaaattcaaaataataaaactgctcagatgtcctttatacccagactgtctttgatacttcccagatgaccactgataaacccaaatttgttccatcaccctataaaaaagaatgttgaaataaatcaatgtttgatatttgccataatttaattggcttaactgctctaagtaaataaattgaatgacctagaaccttttccttgggagccaaatgtcaagaagtcatttaccattcttaaacatataagccctgacttgggtattcctaactatgctaaattgtgtacctaaaagcatggttgtagtttaggggtactccttcaaaaacgaggaactcataacaagcacattgcttatcttagtatttctcttgaccctgtagctaagaattatctgccttgtttataccctacagcagaggcagctaatttagttgaagtctctacagacattgttctaggtctacttctcacccacgagtccattgtgtagtagaagactttttactccaaaacaatactcgcactctgggaggccaaggcaggtggatcatgaggtcagaagatcgagaccatcctggctaacacggtgaaacctcctctctactaaaaaatacaaaaaattagctgggcgtggtggtgggtgtctgtagtcccagctactcgggaggctgaggcaggagaatggcgtgaacccgggaggtggagcttgcagtgagtcaagatcgcgccattgcactccagcctgggcgacagagcgagactctgtctcaaaaaaaaaaaaaaaaaaaaaaatccaatactcaactcttcttggccagccacattactgattataaaattatttgattatctgcttccctccttgttacagtagataggcagacctgagcagggcaggagaggccccacacacacacacgcacacgtggaacgtcaggcgaccatcaggttgtgatcgggcagttgttaactatctctctaaaataataattggtcacagccagcttcagagaaaggcagactcccaatagatagaaaaccctgaaacaagtgatcagcttcccagtgagatctcaggagttgggcaagggggctcaagcatgcttattaagaggcaaaatggtggagtttaactggtagataaccttcctctgggaacattcaactggtaagaaaaaaatgcctcaagtgagcacgtgcacaatttcaataaacacactgtacatgcagcccctcccaagtgctggcaggccactgcacttgtagacagctcaccccaagggaagaatcagggaataaggaatggaagatcctggatgtacaccaacatataaaaccctaagtcaaatgtcaaactgcacttgagtctctcaagttgcctacttggccctcttccaagtgtactttacataaactttcgcttctgctctaaaacttgcctcagtctctcactctgccttatgctcccagttaaattctttcttctgagaaggcaagaattgaggttgctgcagacttgtgtggatttgctgctgctaacatcataaatatcaaattctgttccaatctaaatccagctacaagccaggcacagtggttcacaactgtgaaaatcccaacactttgggaggccaaggtgggcagattgcttgagaccaggagttcaagatcagcctgggcagcatagcaagaccctatcactacaagattttacaaattagctaagcatgttggtatacacctataatcgtagctactcaggaggctgaggcagaaggatggcttgtgcccaggagtatgaggttgcagtgagctatgatcacaccactacacttcagcctgggagacacagtgagaccctgtctctcaaaaaagaacaaaaacaaaaaaacagtcccacaaccttatttttccttcttgacaaaagtaaattctatgctaacagttattcaaaaatctaagcatgcaatatcctgactctccttatattcccctggacaattctgatatgaaattcaaattcttgttaatggctcattacttaaaatttataaaagtatatgttgtactggatatgctatgccatctgaccattctgtgattgaaacttcctctttatatcatagctcattctactcagatgactgagttaatagctcaaaccatgacagcttgttaaaggtttaatgttaatatctatgcaaataaacatgccttcaagttttttatgattatgaaaggacattgaaacaaactcagaaactcactcaaaaatgaaaaacaggccgggcgcactgtaattccagcactttgggaggctgaagcaggtggttcaccagaggtcaggagtgtgagaccagcctggccaacatggtgaaacctcatcgctactaaaaatacaaaaattagctgggtatggtggcacatgcctataatcccagctactcgggaggctgatgcaggagaatcacttgaatccgggaggcagaggttgtagtgagccaagattgccccactgcactcaagcctgggcgacagagagactcaaactaaaaaagaaaaagaaaataatgactcatgagagccaatccaacatctgaagggaatctctgtcattaagactgaaacacgcatataatttttttaagctaaaggagataatctaagcaattactctgcaaaatcaacagcccacactgatttaaccactatttagcatctaaaagatagttgcacagtctgatataaagaactcagaaggactaattcaaatataacaattattctatctctacagaagagaaaaagatattggttatttcagacctgtctcatgcatagcaagctggactttagcatttcaaagaaggcaacttggtggtgcctaagtcaattgtcagaacttttgttctcatgtcacatgaaagcacctacaatggcaggacagattggaacaaatgttacaaaaatattggtgaagatgattttacctgacagcttcagctagtaacaaagccttgccttatttgtaattgtaacccaaaaaacaactataaaggtagggtaaagctctgaccaactcaaggactatctaaccatttagaaatggatagcattcaggtgcctaaattgaaaacctagacgtttcatctataattttctggttaaattatattttcttttgccaaatgatttgacccttaattgttacaataaaaatatttataggttttactttctccacatgaggaatacatttaatgacctctaatgataaaggaattcactttacaggtgaaatacttaaggaattataaaaggttctcgctttaaaacagaaacttatttgtctatatagtccttaaagttctagaaagataaaataaactaacattactttaaattaaaattgttcaatgtttcagaagaaagcacattctaaattgtcagatgctgtcaaaaacaaatatagtcacaatcatatgctcaattgatgcatgttgcacattccaagcacaccatcaagcacaaccctggatgatacacaatctggaggctgggtacaatagaaagataccaacaaaagttagccctagaaacatgataaaagggtcattaaggtacttttaaccagaaatactgctctttaaaatgaagggaatatgcctgtggattcatgattttaggtgtaaatgagcaaagaatctcacaaactaaactcgcagttctattgaaaatctaaccctgaagcccattaaaagacctccagaaagagatgacttccatagacagctgccccataatacatgggcaaaaataaagactacatcagcataaacagcttccccccaaaacttttcccatcaaggtagaataaaagacaattttattattaatactctttctctttctatttgcaatactcgtttctttctattgctcgaaagtactggactgctaaaaatggtcaccttactcttctgttcccttctttcaactgccttctttcctataagcccctttgagctccttaatttgcctttctcaaataattataatgcctccaatcttttcaaatttgggttcgtcatctggccttatatccctctaataaagattaatccagattaaaagattaaactaaatcttaactggagtctaagctcccccaaattagctaatgcttctgttatcttatagagcatcaaataaactcagaagttggggatttaaatgactaatgacaaaagttatgtagcttcaggtactatgcttattacctgggtgacaaaataatctgttcaccaatcccccatgacacacaatgtacctgtgtaacaaccctgcacatgtaccctgacctaaataaaagttaaaaaataaataaataaagctatgcagcaccaggaagaattcttcaggtgcccaggaagggagtatttaggctagccctggggcagaggggaatctgatgtctagcaagaggaaagtgggtcctgactggcttcactaccagcttcctaaagtggccttggtccccagatacatttcagctgcatccaggccatagtaactgtggtcttcatgcaagctctcgtactacactgatcttagaatctgtgtgctaggggtacaacccagcatgaaaccagctttggcagccatgggagtgcctgtgttgccagcactcccaactctgggcaatgcagcacagagagacactccttccaactggggaagaaaagggaagagtacaagaaattttgtcttgcaaccaggtaccagcccagtcacagtaaagcacagcattgggcagaatcccaaagcccctgattctgagccactgttccatacatccctttgggccaggccagaagggaaagagaggtagaaaaaaatatattagaaagtttattcaaagaaatagtaacagagaactttcaacttagagaaagatataaatatccaggtataagaaggtcaaagaatacaaagaagattcaaaccaaataagactaccccaaggcatgtaataatcaagctccaaaggtcaaaattaaagggaaatccttaaagcagcaagagaaaaaaagcaaataacatataaaggagttcctatacatctggcaacagactgctcagtggaaattttataggccaagagaaagtggaatgacatcttcaaagtgctgaagggaaaaacttccaactgagtatactgtatccagcaaagttattcttcaaacatgaagacaaaataaagactttctcaggcaaacaaaagctaggagaattaatcaccaccagacctgtcttacaagaaatggtaaaggcagttctttattctgaaagaaatagacacttacatgtagcaagaaataatctgaaggcataaaattcgctggtaaaagtaagtacacacacaaatttggaatactccaatactgtaattgtggtgtataaagcactcagatatttagtataaagactgaaaagcaaatcaaccaacgataataactacaacaatttgttgagataggctatataaaaagacataaattcagaaaacataaagtcaaaaagtagaggaatgaagttaaagtacagagtgttataattttttctctgcttaattgtttattttattcatgattaaagttgccatcagtttaaaataatttctaataactataagatttttttgtaagccccatggtaatcacaaagcaaaaacatttaatagacacattaaaaacaaacagcagagaaattaaaacatactgccagagaaaatcacttatttactaaggaatacagtaagaaaaaagaaaggaggagagaaattctaaaacaactaaaatacaagtaacaaaatggtagtagtaaatctttacctatccataataacatgaactaaattctccaattgaaagatatattaccaggcatggtggctcatgcctgtaatcccagcactttgggaggacaaggcaggcagatcacctgagatcaggagttcgagaccagcctggccaacatggtgaaaccccatctctactaaaaatacaaaaattagctgggcatggtggtgcacacctgtagtcccaggtactctgtaggctgaggtggaaggatcacttgtgtccaggaggtgtaggttgcagtgagctgagatcaagtcactgcactccagcctgcgtgacagaatgagactctttctcaaaaaataaaaataaaagacatagaatgacttaataaattttagaaaaagatc

SEQ ID NO: 128 - DNA, 772 bp, Homo sapiens
ggatcgcaatggccccttttctagagccttccccggccatctacaggcaggatgcggctgggaaaaagacaactggaatttctcgaaggttgatggtccgcacggttgaggattctacgtggttctcttggttcccctggtgtgtgtgtgtgtgtggaggaggccgcggcacttagatcaccttcttgagctcgtcgtacaggaccagcacgaaggcgccccccatgccccgcagtacgttggaccacgcacccttgaagaaggccttgcccccctcatctctgaagatcttcctccaacagtcgacggtgcccgtgtacatgatgtcagctcctttgcgcccggactgcatcatcatgcgccgccgcaccgtgtcgaaggggtaggacaccacgccggccacgcgtcacggtctgcgcgatcatccagctcaccacgatgtgcgtgttcttggggtcggggagcatgcccttggccgtatcgtacacgccgaagtaggccgcacggtagatgatgatgccctgcacggagacactgaagccctggtacaggccccggatgccgtcggacttggtgatcttcaccaggcagtctcccaggcctcggaactcgcgctctgtgcctgactttcccacgtccgctgccagggcggttctggcgaaatccagcgggtacacgaagcagatggaggtcgcgcggtcgtactcgccgaggcaaggtttgccggcaaagtaacttcagaaaatgcttggtgtttttccacgccccccag

SEQ ID NO: 129 - DNA, 2093 bp, Homo sapiens
cggcggcggctgcgggcgcgaggtgaggggcgcgaggtgagggtcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctactaaaaaaaaaaaaaaaaaaaaaaaaaa

SEQ ID NO: 130 - DNA, 413 bp, Homo sapiens
  misc_feature 322, 364, 378, 397, 403: n = A,T,C or G
aagagttgcatattttactttatttttattaaattaaaagctacagtctggcagcgattccagaacagggtaaggaggttcctcacaggggtcagagaagagcggagaaagacagactgacggagactgagacacaggagagaaaggacaaggttaagggagaactgtatctgatgaacacacacagccggctccatggcgggtgacggggagctcacatcagcccaatttctcctccccggcacccgaagttcagcggtggagcagtatgtgggggcggttaggaatcaagagaccctcccttccccaccctaggtccttntctcggcttggtcgtggagcacagcacattaccagaaaaagncaagggcaattgangggcagggaaaccgggagnatattntacacgggga

SEQ ID NO: 131 - DNA, 1464 bp, Homo sapiens
gctgctggagctgcagcccgaccgcgagcgtgccaagcggcttcagcagctagcggacgtggcggcggcccccctcaggacaccaccagattcccctcttcccgcggcctcgccatggcgacccacggacagacttgcgcgcgtcgatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttggctcgccctggagttggaggcttaatccagctgaaagaaacctttgggaatggatatcagaagatttggccttaatatatttccattgtgaccagcagcaggcttttttccccccagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtg

SEQ ID NO: 132 - DNA, 1508 bp, Homo sapiens
gggcgtcttcggctcccaccccggggcgtgggcctgggggtccctcttcactgcgcagccacctctagcccgccgctttcgggactctcagccttcttttcccttccctgagggccggccggcaccacaacggggccaaaggcagtaactcggttgaaaggcgcgccctgggacaggtcagcgggctccgccatgcgcggcacgcatcccgcaggagcgggtgccagagcagggtaggccgggagttagcagcccagccaggccgctggactcgggctaggggcggggccagcgcagggggcgcaggcgcacaccgcctccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttcctacacgggaaggtgaatgaggcctctggggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcaaaaaaaaaaaaaaaaaaaaaaaaaaaaaa

SEQ ID NO: 133 - DNA, 865 bp, Homo sapiens
  misc_feature 411, 647, 664, 665, 669, 675, 739, 741, 742, 749, 750, 754,757, 758: n = A,T,C or G
gcacatagaaacaagacatccatgtgtacagtatcaaaaaatatataccaaggttactggtattgcagttcgtggaaggggaagagaggggagaaaatgaaatcaaccgaaatactggatggaggggaagaaaggtcaaaagaaaatagtttgtctgatatagaatataacatgatctagaggaaactccataaatctaggtttttatatttcaatatataaatacctacaaataaatatatatatagcagcccgaaggggggtggtcgggccttttgagctcaaacaatacatttcaataataacaccacgtacaaacgggagtagagtcagcacttgacaagttagcacggttaaaatataatactagaactctgaggccgggcgcagagctgccctgtccgttccggnggtccatctccagcggggaagggcaggagagggcgagccccgccggcacctcgtggaaggggcctccgcccaggtctgacagccgccgcagggggaacatgttacctccgctcccgcgtcctacccttgggccagcctggtctctcgcgttggcggttgggagaaggagccgccgaagcccagtgctcagtcccgccccccgcgggatgggcttcccttcgacgccctcgctcacncgtactctccttgaagnnaggngagcgntcgggtgactcgtatatattcccaagaagggctgactcgtcacgactctgccagtcgctggctngnnttgagtnntccnccnngttggtgtctgccgcacgcacgcgcccccacccggtttgcttaccttaaggactgcgtcgctccttcgtttgacagcagggcttggctccgttgtttccggagcctc

SEQ ID NO: 134 - DNA, 1637 bp, Homo sapiens
agagaaggcccggaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctctttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttccaaaaaaaaaaaaaaaaaaaaaaaaaaaaaa

SEQ ID NO: 135 - DNA, 575 bp, Homo sapiens
cggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgaaaggtgctggaccatcgagacaaggtatatgagcagctggccaaataccttcaactgagaaatgtcattgagcgactccaggaagctaagcactcggagttatatatgcaggtggatttgggctgtaacttcttcgttgacacagtggtcccagatacttcacgcatctatgtggccctgggatatggttttttcctggagttgacactggcagaagctctcaagttcattgatcgtaagagctctctcctcacagagctcagcaacagcctcaccaaggactccatgaatatcaaagcccatatccacatgttgctagaggggcttagagaactacaaggcctgcagaatttcccagagaagcctcaccattgacttcttccccccatcctcagacattaaagagcctgaatgcctttg

SEQ ID NO: 136 - DNA, 3329 bp, Homo sapiens
ctcttgggagcgggacttctgctcaaatcctgtccaggggcttgaaaaggaggagaattgggggtggttgccgggaggaccagcacctccagttactggagggttgataggggccttctcctttccgtccccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactataaaaaaaaaaaaaaaaaa

SEQ ID NO: 137 - DNA, 1045 bp, Homo sapiens
actatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatataaaaaaaaaaaaaaaaaa

SEQ ID NO: 138 - DNA, 4356 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagccttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattaaaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgtcggttgttcctaatggcaaactactttagctgggaaaattcatttcaacttattttaagcttgtaaaatacactgtggtgataaaataaaagagctgggtttga

SEQ ID NO: 139 - DNA, 706 bp, Homo sapiens
tttttttttttttttgagacatccagacagcttttattgaaaatagttactgcagccaacgttggaaaagtttactgcagcttttgacttcttcaaagagctgataaccctcatccgcttcttcaccttcttcatcataatcatcatcatcatcttcaatagcttctccagtaaaatataacactgatcttgggattatacgctcacgtaaaaagtgaccaatttcgaagtctgcagcaaggattgcttcagcgatcctcatccaaatctccactctcaggaactttcgggggggcaaaaaagttaaagaaagagtcattggaaactgttttagtcacagtacgaactgtgccacgtcccttgtgtttctgcttcttcttaatagttttcaaagtgacattctttccttttttccaatctatctggcaccctgtacaacccataatttctggtccatcaagagaaaagggatcagaatcatctggttctgacctgatcctgtatgtctgttgcagcacttcatttgtaaaatattcattgggttcaaagtgaaattctaagacaaaactcataggctggccagcatctgagaacttcactgtaatagtcttcaagtgcgtcagaatagggtcatgtggtgctgaaccctatcactggcgcagtcaacattcctaaaaacggtaccgaaattcagaatgccgttggg

SEQ ID NO: 140 - DNA, 616 bp, Homo sapiens
gaccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcagtaaaaaaaaaaaaaaaaaaaaaaaaaaaaaaaaaaaaaaaaaaaa

SEQ ID NO: 141 - DNA, 501 bp, Homo sapiens
gccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgccaaaaaaaaaaaaaaaaaaaaaaaaaaaaaaa

SEQ ID NO: 142 - DNA, 412 bp, Homo sapiens
gtatttgcaaaagttttattttaaaggatcaaaaataaatactgcacatatacacagagaaaatccactgatatttatgttctttgacgcacactttcaatacatggcaccttcatcttctttattgagaaaataaactgttatgggtccataactggtatgcacagtctctgtgactctggcaaataaccaggagccaagtccatataataaagttggaataccgaggttgacgaccttgagcgccgtgaagaagcggttctgccgggccaggtcctgccagggagccttggagcagtggtacttgatgaaggggaagcagccggtgcgcaggacgtggtagttggcgccctgcaccggccagttgaagtgcgagaggccgaactggtcgttgcggacggcgctgtagggc

SEQ ID NO: 143 - DNA, 549 bp, Homo sapiens
cctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaaaaaaaaaaaaaaaaaaaaaaaaaaaa

SEQ ID NO: 144 - DNA, 401 bp, Homo sapiens
caccagttgtcaaatgatcctttattgaaatgttttcctttgtgcttaactctgtgggaaagaaaaaaaaaatcagtaaaaagtttaaaaggattatcccaccccaccagtaaccatttccaaaacttcccagcttatctctgtgaatacactgggtggcccccctttcacccctactgtaacaatgaaaatgtcacttacggctgggcattccacagcaccactgttgatgtcatcgatgatgtcatgaggatggcggccatcaacattacagcccactgactgggcagtccccaggatctctttaatggttcctttaagtaaagaaatggtggcattggaggtgctggctcagtccctcacaatctgcagatactggggaatactgaaggggttcatag

SEQ ID NO: 145 - DNA, 843 bp, Homo sapiens
gatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacaccaaaaaaaaaaaaaaaaaaaaaaaaaaaaaatttggggggcgcgcgcttggggccctgggaaaggtttttaaaacaatttcggtggggggcggggggccccaagggggaagggagaacggggcccgaacagcggggttcccaagggaagaaaccggggtcaaggacaagaggcctggggatttctccaccattaaaaaaggcccggggggaacacgcgaagcggtccgcacccaaccacgaagggaggccggaggcacaacgggcgtctaccaccgggggtccagaggagagcgacaaaaaatagcgcccgagtgccgcaaccccagaccgaaaaccagcagaagaaacaaccaacaaacaacaagcccagaccaaccacgaaactaacagcagaccagaccggaacgggcaatcagaacaaaacagccaccagacaaacgagagcgagcaacagggtgtagaaacaggcaaacaagcaacgggacggacagagcgcagagaaccgcagcaacagcacaacaaaaagcgcagccaccgccggacggaacgtactcaacggccgcgcgcgagagcgaccaaaccagcacccaagaaacaat

SEQ ID NO: 146 - DNA, 183876 bp, Homo sapiens
gaattcattgaaacctctcaaactacaaggtatcactaaatatgtaactgcatttagaattttattagccccaaattttgattaagaattacatactgcacagtccagtgctttttgtattattttttctcactcatatatttattattgtgatattaatttattcattttcaccaagggttagctggtgaagaaagaaaaacaggaaaatttaaatcaagcaacattttaacctctggcaaaaaggagattggggttttagaagaagtacaatatatgtgtaggttaatttgtgttatttctcatcttcactccagccatttgggaaaaaaaaaatctcacaagttgttgtgacttaatttgtgaagctgactgagaatcaccaagttatatatagatattatcataataaccttggcaagaactctagaacctgagaaagtgaatatggtgaaaacatactctgaataggagaaaaataccctactgaaaaggagtattacaaatttcttttttttcaacaagtggaaaaatatgtgagctaatatttggcttgattaaagacattaaagttattggtcttattgtcagaaatggccaaactgactataaaatgttgatggactaatggcaattgcttcaaaacaaaaaataaaaacaaggacaataccgatgcaggcaattcagttcagaattttatttctgtatattgggtaacaaatttaatatccatttcgagtatctgagaatcaacacatgcatgaaaacaaccgaagtttaatttgtgcactagcttaactcctttcttatctgttaaagtattctaaagttaattggggtaaaacagaagcaagatatatagatgaagaaaatgaaaaaatgaaagtttaatttgtcagcaatttagttctgaaatctggtcatatgatgttttcttcgtaagcttttttgaacagttttagatttacagaaaaattgtgataataatgcagagttctcaaataacctcactcttagttttccttatttttaacatggcatatttgttataattaatgagccaatgtttatacattattatcaactgaagtccatagtttattcagattgccctaatttttactattaaggacattagtccttttctggttccagaatcccatccaggattccacattacatttatttattgtatcttcttaggtccctctggactgtgacactttcttagactttccttgttgataatgaccttgacagtttggaagagtactcgtcgggtattttgtagaatgtcccttaattgagatttttaatgataatttttcttgtgtttagactggggttatgggtttttgtgtggaagattccagaggtagtgtatcttgtctcatcacatgctatcaggagtaagtgacagcacattttgaacctgtataagttagcatttggaatcattttgctttatgctcaggatttactcttcaccactgaagcagagactcacctgtcctccctaagtttgaagtgtagtacaattcaggacatgctccttcctcagattcctacctatcatacagatgacaaccttcccattttattttactctctcagtctctaataaaacaattgagaataaaatattaatagaaacatattaagtaaatgtgtttccctttccaaatttactaaataggaaatgagtggtgtggtacgtcccactagcaatgaaaatttcggaaatcatggcaaacagtggaagatccagagaacctattgagaccaaggacgaatataatctgataggtcaacttttattcttgctgggctggtcacaaaatcagatggattctgacatgctttatatttttttagcattgtacaaaaattactgattattatgtgatagattgatgccttgaaattcaggtttatctcttggggtatatttgctagctatatttgtccaggaagaaatactgttgaagatgtgtctaatgagagaaaactgtcggcctgttgcttaactctttttaaattttacacctaaaccaattggctctttgacaccacatatttggaagttacaaacatttattgtcaaacactatattcgaagtggaataaggggcagggcatggtggctcctgactgtaatcccagcattttggggggctaaggtgggtggattgcttgaacctaggagtttgaagccagcttaggcaacatagcgagaccctgtttctacaaaaaataaaaataaataggcctggtgcggtggctcacagttgtaatcctagcactttgggaggcctaggtgggcagatcacgaggtcaggagatcgagaccgttctggctaacacggtgaaaccccgtctctactaaaaatacaaaaaaatttagccaggtgtgttggcgggtgcctgtagccccagctactcgggaggctgaggcaggtgaatggtgtgaactcgggaggcggagcttgcagggagccgagattgctccactgcactccagcctgggtgatagagcgagactccgtctcaaaaataaataaataagtaatagccaagcatggtggcatgtgcctgtagtcctagctactcaggaggccaaggtgggaggattgcttgagcccaagagtttgaggctgcagtgagtgatgatagcgctactgcattccaggctgggtgacacagagagaccctttctaaaaaaaaaataaaaataaaaaaatgacaattaataaaaaataaaacaaagtggaagaaggaagtgatttttcataaactaaaagaaaaaagttgtgacgttcagtttagaatgcttctataagaacagttcaaacatatagagcatgttgcatttcaatagcccaaagtaagttttttcccctgcattttctattaataataataatttaaaaaataaattactgaagccgggtgtggtggctcatgcctgtaatcccagcactttgagaggccgaggagggtggatcaccaggtcaggagatagagaccatcctggccaacatggtgaaaccccgtctccactaaaaatataaaaataagctgggcatggtggcatgcgcctgtaatcccagctactcgggagactgaggcaggagaattgcttgaacccgggaggcagtgagcggagatcacgccactgcactccagcctggcaacagaatgagactccctctcagaaataaataaataaataaataaataaataaataaataaataaataaaaataaattactgaatgacgtacgtgagtgccttttagaggcaatgatgataatatgtgtcactatatattttcctatgaaagcattcataccgtatgacacaatgaagctaagaacctaagtcataagctgcttatttctcactaccggaaatcacccatcctccagcagattgtagttcatttccatgcctgggagggagattttatttaaaggttcggtcattagtttcctgaaaagttttggtttacccagttgtatctagtaaagtgtcaagaaaatttttagtacacagccacctgcttcttgcccgggagtgacactgaaagaagctgaattttaatcctaaaggttaagaattcaaagtacttgccttgccggccacccaaataaagtaaacatctaatcagcctaatatgcttatttaagtgtgctaatgaacaaattgagtaatctaagaaatagtccatttatttagaaaaatttcattatctcactcagggatagaaaatgtcacagtagcatttctaatagagtcaactgcaccaactaattagttattaggtaactaagaaagggtgttgagactctgtgacagttaattttatgtattaacttgggtaggccaccgtatcagacatttgctcaaccacttgtctgaattgttgtcaagacattttttagatgagattaactgtaaaaccagtagactttgagtaaagcagattaccctccataatttaggtaggactcgtccaatcagttgaaggccttaaaaagaaaaagacaaacttctatcaaggaagagagaaatctgcaagcaggctgccttcagacttgaacattaacacttctctggggctccagcctgccagcctaccgttcagactttgggctggccagcctcctaaatcacatgagaaaatttcataaaagaaatttctttcttttctttctttcttttaatctttcttcttccttcttttaatctttcttcttcttttttctctttctttctttctctctttttctttctgcttatttctttatttcttcctgtctcttccttctttacttccatcctcccttcctctactattctttttctttcttttcttttcttctttctctctttcctttctatttcctctctctttccttcgtcttttctcttttctttctttctttctttgtttctttctttctctcattctctctctctctcaaaccctgactaatatagatttgaatttaaaaaaaatgaaacatcttaaccaagatctgccaaataaggtcaggcctaatatgatactgtttcatccaatattactgttctgagaagtgtattatttcagtatgtagatggtttagctagaattctatttgtctccagtttaattagtggttaatttcttaggctcttccatcatactaatctacactcaattctcagttactccacttgaaagctgtgttaccacggtgcaatatttaccctttgatcttttttctcgtttataaaataaggctagtgtttggtatactgtgaagaatagtggaaatacgtgatctatgaacattggagaggggaggaactatatggtgaagaagaaagtgagaaaatctttcctgtggagagaagcctatacataattcacctcactagactactgccttttcccattaaactagagtgtgaaatgaagaaaatgaactagtcaatcctacttggagagattgcttcggacctgagacatctgaaatctaaccacctgacaagctgtgggtgctggtcacctattttagtccatttaggatgctgtaataaaataacttagactgggtaatttgtaaatagcagaaacttactgctagcagttccggagactgggaattctaagagcaaggcaccagcagattctgtgtctgataagagccctttcctcttggatgatatcttctatgtctcctcacacagcagaagtgtcaaaaaggctcctcaaagcgtcctttatgagagcactaattctatttatggggtaaaaccctcaaaacttaatcaccttctaaagacctcaactcttaataccatcatctcggtggttaggtttcaatatatgaattttggggggaaacaaatattctaagtcacagcagtctgctcctgaacccacaacttcatttccttctcataagcaaaatacatacatttcattctaatagcccccaaggtcttatctcattcgagcatcaactcagaagtttaatatctcatccaaagtctcatctaagtatcacttaaatcagatataagtgagactcaaggtaagatttattctgaagtaaatttctctccagctgtgaatttatgaaattacacaagttatgtgctcccaaactataatggtggaactcacactggatagatagttcttacaccaaagagagaaagaagaaaaaagaaagcataactagtcccaaataatttcaaaacccaatagtgtaaacattaaatcttaagtcttgaaaataaacttatgtgattccatgtgcagccttttgtacacattgaggtgggggttgggttctccacactctgagcagccctgcttctatggctttgctaggtaagacccacaatgtagctctcatgggttgaaggttggtgcctgcagctctttcaggctgcaatcgcatggccgtggctgtactaatctgaggttgtgaaggtagtcttgtaaccatcttttcactgggtatttccctagtaggggctctttttggtggccctcatagtttcaccggtcattgccctaatgggggatttctacagtggctctaccactttagcagttatttgcctgggccctgaggctctccagggcaacctttgaaatccaggtgaaggtaggcgtgcttccaaagcttgtgcaagttgcaccttcctggagatgacactgtgtggatgctaccatggtttaacacctgtgccttccagtggggcaaccagagctgcacctgggcctgcttgagccacagatggggtggccaaagagtgctttgctggaatgtggagagtagaactttgtcatcattgtgccccaaaagccctggcattttgggcctgtaatgggtggtgcaatcccgaagatctctgaaatgcttttaggatcattcttccattgtcttgatacaaagcatctggcttccttctattcatactaatctccttatcaaacactcacttggccacatccttgatgttctttcctgaacattttcccactctttaaaacatggccaggctgagaattttccaaacctttaagccccccctttccttttgattaagaattccaactttgtttcttttttctcacattttactataagcagtctagtaaagtcatgccataccctcaaccatttgcttaaggatttcttctaccaaatgttctatttcataactccttccctgggacactatgatatgaacataattcagccaagttgtttgctggtttatatcaagaatcacctttcatctagcttttaacaatctttcctcatttcagtctgatatttcatgagaatggccttcactgtcacaaacattctggtggtgatcacttaggtaatttctaagaagactgaggttttctctacagctctcttcttatttgaagacttcaccagaatttccctttttagtcagttcacagcagtacaggctgcttctaccttgcacttcaaaattcctccaggctttacccattaccgagttccaaggtgctttcatatttttatgtatttgttacagcagcaccccacttcttataaccaatatctctctgtgtctatttgggctactataacaaaatatcttaaactgagtaatttataagaaacaaatttattgaccatagttctggaggctggggaatccaagaacaaggcaccagcagattctgtgtctgatgagagcctgttcctcttgaatggcaccttctttgtgtcctaacatgacaaaaggggttaaagtcttcctcaggcctcttttataagggcactaattccattcatgagtcaaagctttaatgacctaattacctcctaaagacctcagccatgaatactatcagtgtggtggttaggtttcaacatacaaattttggggaagatacagtcagaccacagcactcacctaaagaaccaaagagtttgtcattctttattgctttgaggcaccatgtttataggcattttcaaataccttacctgaccatgaccatcacattatggctaaaaatttataattgcaacactgttagtaaggaaggaagtagccaaggaaagaatcaagggaaacaaatatttccggagtgagctagtgagacaagaaaggaaataagtgaggcctgaaagagaatgttcatgcatctgatgagtatttagtgagtgactataatgtagcaagcattgttataggtgatgaaaatacaatgtcgacaagaaaagcagtgtctctgttatggagcttaccatctaatgatatactggggacaaaacacaacaaacgagaacacacagacacctataacagaatgtctgatggtgataaatgaataaggaaaatcaaacaaggtaatatgatacaggctattttatctaagatgtgtatcagttaagatgagtttagctccacataacagaaaaaccctaatgcacatggcttcaaaatgagaagccattattttactttacatgatatcctgaggtaagaaagtttctaatatggtacatcccagctctgaatttgtttctctgtatttccattgctttctcctattgttgttttttgtctttatcttcaggatgatagtaaaattattgctgcagtttcatcgttgcatctggacacagcaacattcttagaaagaggaggacatatccctctttaagaatgagaaaaatctatctcaggagccttccagctgactattttattggccaaaatgaagttgtatgccctaattaaaaccaatcactgctaaactgagtggaaggccatgaataaattagactatatggaacagatttagtgtaagtaccataaccacttttgaaggtatttgtgagaagacatttgagaagacatgagatatgaatcataaaaagaggcaaatatgtgatgacttgagagtgagaagatgttataggtaaaggaaacaccaagagtaattttttggaagccgaagaggaaaataatatcaatgaaatgtgagtatttggttatattaaatgccaaaaatttaagttaatggtctctcaccacaaatggaccttactgctggcctacaaccctattgtattaatttgttttctctcctacttttgtagattattagtccactctctcacagctgatgatcttgtttcctatttcagtgagaatattagagcaacacaaatagaatctccacagctctcaccatcaatccttactttcaactacttgcatctctgactatgtagtcttctttctctcctgtttttatcaatgacctgttgaaactctaatttaaggtcagtcaccgtagatgtgcattggatcaaatcctctgttgcctacttaaacaaattgcttcaacagtcttcccctatcttctatcattagcttttgtatctttactgtacattcttatcaccattaaaatgtgtaattgttactgctacttaaaaagttatttcctgaccttatttcagcctccagttcctattccttttttatctttccccttccaaaaaactctttaggggagctgtttttaatcaatgtctctaattaagccattgattgatctctaatcagctatttgtcccacaactgtaccaaatttcccttaccaaggtaacccatcactccatgctgctaaatgcaatggcaagtttctcaattcttactgaagtattcagaaacatttgacatagtttaagcatccacatcatgcaaatttttcttcacttgacttgtatgacaccaaatgtgtctggtttttcttctacagctctagctgttgcttctattttcaattatgctgggttctcatcatatccccaaggtctttttctgtttcacgcaatctgtttttccctgagatgtaattcatgtatcacaaaatgcatctgcttaaggtgaacaatgaagtggtttcagtatattcaaaaagttgagcaaccatcagtactatataactccagaacacatttcttcatccctaaaagaaatcttttgccaacaaaaagtcactactctacatcccccggtccaaaccctatgcaaccaataatcttctttctgttacagatttacaaattgtggatgttttatataattggaatcacacaatatgtggtcttttgtgattggcttctttcatttatcataacgtttacaaggttaattcatgttgtagcatgtatgattaggttggtgcaaaagtaattgtggatttggaccatgaattttaaatcattataactaggcttaagcacacttttattaatcaaaatagaaaccattacaatcagctcatttttgccaacaagaaataagtatgtttattcctgtaacataaaaatctgtgctttgggattcaatgaactcttggaaggcattttctgcatcttgctggtagtggaagcattttccatgcaaaaagttgtcgagatgcttgaagaagtggtagtcagttggggagaggccagctgaatatgacggatgaggcaaaactttgtagcccaattcgttaaatttttgaagcttggttgcgcaagctgcagttgagtgttgtcatggagaagaatttggccttttctgttaaccaatgcctgttgcaggcattgtagttttcggtgcatctcatcaatttgctgagcatacttctcagatgtaatggtttcgctgggattcaaaaagctgcagcagatgagacaggcagcagaccaacaaactgaccatgacctttttttggtgcaagtttggctttgggaagtactgtggagtttcttctcagtccaaccactgagctggtggtcaccggttgtcatataaaattcacttttcattgcacatcacaatccaatagagaaatggtttgttgttgcgtagaataaaagaagatgacacttcaaaacaattcttttttatttttgctcagctcatgaggcacacacttgtcgagccttttcacctttccaatttgcttcaagtgccgaatgacagtaggatggtcgacgctgagtccttcagcaacttttcatgtagttgtaagaggatcagcttcgatgattgctctcatttggtcattgtcaacttctgatggctgaccactgtgctcctaatcgccaaggctctcatcttctttgcaaaacttcttgaaccaccactgtatgttcattaccagttcctgggccaaatgcgttgttgatgttgcgatttgtctccactgccttatgacctattttgaacttgaataaaaaatcactcaaatttgctttttgtctaacattatttcaatagtttaaaataaatataaactgcaagtaataagtcattagcaaaaaaacaaagcgagaaatgtgcattaaaatgatgtataacataaccacacttatttaaaaatgtattccaatatcaaatcacaaatttcaacaatgcaaaaatcacaattacatttgcaccaacctaatagtagtttatcactattaaggctgaatagtattccattgtatggaaaaacaacattatgtttacccattcctctgttgatagaaatttgtgttattcccactttttaaattatgagtaataatgctgctgtgaatatccacgtgcaaatttttgtgagggccaggcatggtggctcatgcctataatctcagcactttgggaggccaaggtgggagtattgcttgaacccaggagttagaggcaagcttagacagcaaagtgaaatcccatctctacaataaataaataaataaataaaatagggagcaaggtggcatgtgcctgtgttcccagctatattggaggctgaggcaggatgattgcttgagtccaggaggccaaggctgcagtgagccatttttgtaccactgcactctagcctgtgtgacagagtgaaacctggtctcaaaaaacaaaacaaaacaaaacaaaaaacaaaaaccaaaaacgtggataaatgggattagttctctgggtacatacctaggagtgcaatacctgggtcaaatagtaacttcctatctaatctctgaagaactgccaaacactaatttccaaagtggctgtaccattatatatccccaccagcaatgcataaggttcacatttctctacattttcactaacatgtgatattgtcagtcttcttgatgatagccaccctaatgagttttatgtggtctctcattgtttttgactttcatttccctactgattaagagtggtcagcattcttttatgtgcttattggctatttgtacatctcctttggataaatttatgttcaaattctttgttcattcttaattggattatttggatgtttattgctgagttgtaagagctatttatatactctagacacaaaatcattacaagatatatgacatgcatttttttttattctctggttacatttcgtgttcttaaaagtgtcctttgaaacagaacatttgctttagtttatgtgcagtggaaatatcaatattttctctggctgcttgatctttgatctttttgaaaattgttttctacaaacaatctttttaaaaaaattcataagaactttaaaataagcttttaatttttttgccaaaaataatgccagcttaaattttgttagagactttgttctagctattgatcactttggggaatattgaccattttaacatgtcttatgatcaattaagccttctgatcaataaacacgggatgtatttctttttagatattttacaaaatttttctttcaatgatgttttgtagttttcatagtgccaattttgtacaccttttgttaaacttattcctagatattttattgtttttgatgccactacaaatgaaattattttcttaattttatttttgagtttttaatagccagtgcatagatataccattaacttctatgtattggtcatgtatcctgcaatcttgctaaacttctttatgagtgtgtgtgtgtgtgtgtgtgtgtgtgtgtgtgtataatttttttatatatatgcaaggttatatcatctgcatatacagatgtttacttcttcctttccaatatgaatgcctttttaaaatttttctagcctgttttagtttgctgatgctgccatcacaaaacaccacagactaggtggctcaaacaacagaaatttatttcctcacagttctgaagtcctgaagtccacaatcaaggtgttggtaaggtttggatgtatttggggcctctttccttggctcacagatgatggtcttctcactatgttcttaacatttttttcctcagtgcacagacatccctggtgtctcttttgtgtttccaaacccctgcttataagacaagtcagattggaattggacccaccataatggcctaatttttaacttaattacgtttttaaaggtccttagtccaaacacagtcacattctgaggtactcaaagttaggacttcaacatatgaacttgaagggtatgcaattcagctgataatagtaccttgcaacctctaatactgaattcatttatcagatttaggaatcttctggcagagtctttagagatttctaggcataaagtcatattatcagccaacagaagtaggttgacttcctgtttttttttttttttttttttttgtcagtttggatgttctttatttctttgtcttgcctgattgctctgggtaggactttcagtactatgttgaatagaagtgctgaaagtgggcatctttgtcttgttccagttctgaaggtaaatgctttcactttttccacgtcaagtatgatgatggctgtgtgtttgtcatatatggactttatcattttattgtattattttacttaattattttaatattttgaggtatgttatttctatgtctagtttgttgagggataaagagatgctggattttatcaaatgctttttctggaactattgagatgatcatatgatttttgtttttaattctgtttatgtgatgaatcatatttattgacgtgcatatgttaaaacatcccttcgtccctgaaaggaaatccaattgttcctggcaaattattttttgacatgctgttgaatttcatttgatagcattttcttgaggatttttgcatctatattaaccaggaatgttttctgtagctttgttttccttcctttgttgtcattttctgattttaagattagggtaatactggttcctaaaaagcagttaaggaggagttcctccatctcaatattttgaaataatatcagtagcattggtaataattcttctttaagtgtctagtaaaatttagttctgaatgcatttagccctgggcttcttttgttgttggcagtttctgtttgtttgtttttttgtttgtttgtttgttttattactgtttcaatctcaatgcttgttactggcttcttcagaatttctgtttcttcctaagttaagctagggtgaattatgtgttttcagaaatctaacgattagctctggattttctagtttgtttgcatagaggtgctcatagtagttcgaatgatcttttgtatttatgtagtgacattgtaatgtctttattttcatttctaattcagcttatttgaatattctctttttttcttggttaatatacctagtaatttgtcaattttgttcatcttttccaagaaccagcttttgttctattgatcttttgcatattttgcttcaattttatttagttgtgctctgatctgtgttttttcttttcttctacaagttttgagttcgatttgtttttgtttctctagttccttgagatatgaggttagattgtcaaattgtgatctttcagactttctgatgtaggcatttagcaatataaacattcctcttagcactgcttttgctatatctcagaggttttgataactgtgtcagttatataactcattttgaatagttttaaaaatttgtatcttaatttcatttttaattcaataatcatttaggagcagattgtttaatttttatgtatttgtatagttttgagtgtttcttttgcaattgatttctagttttattttgctgtgatttaagatacttatcgctttaatacatagtgctgggataactggctagccacatgcagaagattaaaactgaactccttccttacaccatatataaaaactaactcaagatacattaaagactcaaatgtaaaacccaaaactataaaatccctgtaagacaacgtaggcaataccattcagttcataggcagggacaaagatgttatgacgaagattctaaaagcaattgcaacaaaagcaaaaattgtcaaatggagtatgattaaattaaagagcttctgcacagcaaaataaactaccaacagactaaacagacatcctacagaatgggataacattttttcaaactgtccatcctacaaaggtctaatatccagtgtctaaacttaagcaaatgcacaggtaaaaaacaacctcataaaaagtgggcaatggacaagaacagaaaattttccaaagaagacatacatgcaggcaacaatcatatgagaaaaagctcaacatcactgattattagagaaatgcaaatcaaaatcacaatgagataccatctcacagcagtgagaacgactattattaaaaagtcaaaaataacagatgctggcaaggttgtggatagaaagaaatgctcacacactgttgatgggagggtaaattagtttaaccattgtggaagacagtgacaatttctcaaagacctaaagacagaaataccttgtgacccagtaatcccattactggatacatacccaaaggaatatcaatcattctcttataaagacatgcatgtgtatgttcattacagcactattcataatagcaaagacatgaaatcaacctaaatgtccaccaatggtagactaggtaaaatgatgcatataccttatgaaatactatgcagccataaaaatgaatgaaataatgtccaagataacagctggaggccattatccttagaaaactaacacaagaacagaaaatcaaatacaggatgttctcacaagtgggagctcaatgatgagaatacatggacatgtagagggaaacaacacacactagggcctatcaaaaagtggaggttgggaagagggagaagatcaggaaaaataataattaatggtgatatggtttggctgtgtcaccacccaaatctcatcttgaattcccatgtgtggtgggagagacccagtgggaggtaaatgaatcatgggggcaggtctttcctgtgctgttctggtgatagtgaataagtctcacaagatctgatgagtgtacaaggggaagtttccctgcacaagctctcttctctctgccgccatgtgagaatgcgcctttcaccttcagccacgattgtgaggcctcctcggacacgtggaaatgtaagtccattaaacctctttcttttgtaaattgcccagtctcacctaggtctttatgagcagcatgaaaacagactaatatggtaaattgtatggtaccactagagtaaggcactgctgaaaagttacccgaaaatgtggaagggactttggaactgtgtaacaggaatgggctggaacagtttggagggctcagaagaagacagaaaaatgtgggaaaatttgaacttcttagagacttggtgaatggctttgaccaaaatgctgataatgatatggacaataaactccatgctgaggtgatctcagatggaaatgaggaacttgttgggaactggagcaatgatgactcttgttatgttttagcaaagagactagtggtatttgcccctgccctagagatttgtagaacttttaacttgagagagatgattcagggtatctggtggaagaaatttctaagcatcaaaacattcaaggggtgacctgggtgctgtcaaaggcattcagttttaaaagggaaacagagcataaaagtatagaaagtttgcaccccgacaatggaaaagaaaagaaaatccaattttctgaggagaaattcaagctggctgcagcaatttgcatatgtaagaagtagcctaaggttaatccctaagaaaatggagaaaatgtctccagggcatttcagagggcttcacaaagaccctctcatcatagacctggaggcctaggaggaacaagtggtttcatgggccagacccagagtccctgtgctgtgtgcagcctagggacttggtgctctgtgtcccattcactccagctgtggctgaaaggggccaacatagggctttcactgtggctgcacagggtgcaagcatcaaacattggcagcttccatgtggtgttgagcctgccagtgcgcagaagtcaagaactggggtttgggaaccaccacctacatttcagatatatggaaacaccttggagatctgatgagtatataagggggagtttcttttctcttttcttgctctcttttcttgtctgcctctatgttagaagtgcctttcaacttctgccatgattgtgaggcctctccagccacgtcgaactctaagtccattaagcctctttcttttgtaaatcgcccagtcttgggtaggtctttaccatcagtgtgaaaatggactaataaaaatgggtactaggtttaatacccgggtgatgaaatgatctgtacaacaaacccccatgacacatttacctatgtaacaaacctgaacatgtatccctgaactaaaagtaaatctttttttttttttttttttttgagacagagtctcgctctgtcgcccaggctggagtgcagtggcaggatctcggctcactgcaaactccgcctcccgggttcacgccattctcctgcctcagcctcccgagtagctgggactacaggcgcctgccaccacacccagctaattttttgtattttttagtagagaaggggtttcactgtgttagccaggatggtgtcgatctcctgacctcgtgatccgcccgcctcggcctcccaaaaaagtaaatctttaaaacaatattattttcccttataattttgaaataaaaatagaatatttctataaaaaattttgattttgaagaatttattgaggcttgttgtgtgtcctttaatatggtttgtcttggagaatgttctgtgtgctgatgagaaaaatgtatattctacagtacttgaatataatgatctgtaaatgtttgttatagccagttgttctagagtacagattaagtccaatgtttctttgttgactttctgccttaattatcagcctcatgcagtcaatggagtgttgaagtcccccactgtgattgtgttgtggtctctttactcaggtctagtagtaattgttttatgaatctgatagctcagagattaagtgtatatatatttataattgtgatatctacttatcaagttgatcctttcttcattatataatgatcatctttgtcttttttttttaactgttgttgctttgaagtttgttttatcttacaaaagaacagctattcctgcttatttttggtttcaatttgtgtgaaatatctttctccacccctttgccttgagtatataaaaatccttatgtcttaggtacatttcctgaagaaagcagatatttggtttacgtattttcagctagtctgcctatctgtatttttttaatgaaatatttagaccatttaaattctacataaatactgagctcagaggttccatgccagtcatcatgttgatttttacctagtaacttcgttttcttcattgtggtattgttttaaaagactggtagtttttatgctttcaggagtttttattctggtgtgtattgaccttttatttcaagatgtagaactccttttagaatttattgtaaaactgatataacattgacaaatttcctcagtatttgcttgtctgagaaacactttatttcatcttcatttataaaatagttttgctggatacaaaattcttggcttacagttattcagtttaaggagattaaagataggactacaatcacttctggcttgtaaggtttctgctgagaagtctgcagttagtctgatagttttccttttaggttacctggcgtttttgtctcattgctcttagaattctttctttcacatggattttagatagcctgataactgataagatagcttgtgatgcccttttctcaataagtctcacaggagtttaagcttcttatatttgtgtgtctaaaaactctagggagatgaggaaagtttgtcttaattatttcctcaaataggtttgtcaaacattttgctttttcttttccctaagaacacctataattcttagatttgggcattttacataatcccatttttcttgcagatgttgttaatttcttttaattctttttaaaaatttttttgtctgtttgcattaatttgaatgccttgtctttgatctctgaaatttcttcttctacttgttctagttgaatgttaaaactttccattgcagtttgtattttcctaattgtttcttctatttccagaaggtctgattggtttttcttcaaagtagctatctctttagaaaattttttatttggatcctgaatttaaaaaaaaaaattctttatgttggttttaacctttctcttttgtcctcaagtaagttagtaaccaaacttttgaatttttatctggtattccaaagattttattttgatttggatctactgctggagagttatttggggagaaggaattatataggatcttgttttttcatattgctagaaatacttatttggttccttctcatttgggtaaaccttttcttttcattattttgaatttattttttattcaactaggttttctatttttttccccttgaggatgtgacattaatgtttatagtttattgtcacctagttttgactctgggtgatttcattggagaagtctcaatttgagttccttagttatagacaaattttgtgtcatgtcttctctgacgctggttgtgttagtgttatgctgggtgtacgagaaggttcactgtctcctgtttggctgaagtggcagaggcctcatgaagcttatcttgtttcccagtggtgtgcatttttaacctttttccccaatatttttttcactgggttggacagttcagaactcaggccagtaggagttgcccaaggataaaactcagcagtggctaaagcaggtgagtaaatgcaaataccccaatggtgggaagaggtcccagcttttagagatgttgctatgaaaattctcagtaaaatgcaatgtggtattttaagggggaagagaggaagctaccgcagctcttcttccaggcctcagaaaaacaatttgcctctcaattacattcctgatcagtgttctggctattcagataaggcaggcacctctattcatctataggaaggctgctgttccatgaagagagagattttgcctttacctatagtgcaagctgaacctgtaaggcacttttcctttggggatgcagtcaccctgaagtgatccagaaaggctgcctgcagatgggcccatgccaatttcccatggtagacacctgagttgtaactgcagtggtgggcaagggggagaataagtcttctcctcccagatcctacacaagaatgatgggtgcttaactgttggaaccaaaccacagtcttttcccactgagcccagcattgcacttgtgcctccactgaagaaaacttcccacacatggaaaattcagagatgcaaagcctttggtctggtttcttttatccaattgggtgctaccttaatgtggtattctccccattccctaggattagcagtccctgagggcaagactactgtgaatcctgttgcttctctgggcctagctacccagttgggctgccacactctaggccagtgctgagaaatgtctgcaagggatctggtgatgtgacctgtcctcaagtctcccagcagtgtttacaagcaccctctctgatgcaggttggaggtgaatgatgtagactctcagatttccttaattataaatagccttagcatgctggctttctcaaatgccagcagtagtagtattcacatgcagactcaagatctcttgttcatcagggtgatgcaggcattggaaatagctgaggttatgcaaatgtcttcttcttgagtgctgtgttactgtgcctgcagatgtaatgggctttgctggttggcctctagccaggaggtggcaagtgcaaaagaggaccacctacagcgagaacagtagaatatgttcttgcttcatgttacccacgggaggtactctggtgcctcaggcaataagcagagcaatggatatcccaaatatccccgtccatcatgttacactaccagggtggtgaagggacaaagctgtgttgggggtgtgtcaggcagggctgtcctctggctcccaacgtgcagccacaagcagtagtcctaatggagattagatggcagttccctggctgctggagtaatgttccagggaggagcacaactacctctgttgcacagaagaatctgcactaagagcagggtatagcaggtggcagtaagctccactcagctactacacacttggcaaggcagttctcatatccagagttatgccaacaacagctatctggattccaggtagcctgagctcagaactcaaaactgccccaggccataagccttttcccaggaagactgaaactgtggcttcaggccatgccgctctctatatgcccatgaagcagtgacacccagggtcacggaactcctgcacctatggctgtagcacacttcctgctctcccctcggttctggccaatggcattcattcccactcaagattacatcgcaaatctcttgttgggagtgtctctggactgcagcctgagctagctggcagacttccatgaggtcccctgagaggtaggaacagaaatggcttctctccatcctcactggattctaagagtgcaaacaaagcatgctgcttctcatatattctccactgttcactaaatcagttccagtgtgggatagagttatggccttcccgcatggccaggattgcccggctactttgtgggagtgtatgtcacagcagcagtgtctccatatttcctgcagtggagactcacggttttccttctggttcatattgtaggctgctgcctgctgcttctttcaaagagtctgtggttttgttcagtttttctgttaatttcttgtgttgcttcttggaaaaaatttcaaaacatgaacctgtacacactattttgttttacaagtgagagaggcatgctaacaatactgctaatctgaccccttggggatgaaaaaccctatctttgctgttttatttgattctttaatcaatttacaatcattgattttattgatctaattcggtttatatctggcatttaacttgatgttttctatatgtttcatctttttttgtggctctgttcctttttttactacattgtttggcattcagtaaatattgtctattgtaacattttagttcctttaatgattttttcaatatatttttgagtatttttagtagttcctccagagtttactatacatcctaacttatgaaaatctacttcaaatttatacaaaataagttaaaaatagaaatagaaatgttattcctatagaactctattattttccccacattttgtactattattgttactacatctatgttataaatccaaaaatacgttgttacaatttttactttatatgattttatgtcttttaaagaagagagacgagaatagaatacatctttaaagagttcactatatcaactttcttatcaaaatttctgcttcctttcatttgttcctgtgggtgtgagctaccagcttggtgttctccccttaattcaatgcaactttgctcctactcacctgctttgtgctgctattggaaaatatgttgaatttctacatattgtagaacaataatttatatacatttttatgcaattgttttttaaaactattaagaaaagaagaaatatgctattatactttcttttacaatatgtacagagttacctttaccagcactctatatgctttaaaattaattcgcatttcttcctggagtcacttgcttgcagactgaagaatttctttaagtattttttttaggtgagactgctagtagcaattttttttttttttttgagacagagttttgttcttattgcccaggctggagtgcaatggcatgatcttggctcactgcaaccttcgcctgccgggttcaagcgattctcctgcctcagcataccaagtagctgggattacaggcacgtgccaccacgcccggctaattttgtatcttttgtttttagtagagacagagtttctccatggtggtcaggctggtctcaaactcccaacctcaggtgacccacctgcctcggcctcccaaagtgctgggattacaggcgttgagccgctgtgcttggccagcaattttttcttttggtttctgtttatctgggaatattgttagtttgccattattttcataatatagttttgctaagatttaaaattcctggttgatagcattttttttagcactataaataaatcattccacttcattgtttacagtgagtattcagctgttaatctttttggggttcccctatacatgatgagttttctttctcttgctgctttcaagattttctctttgcatagggctttcaacagtttcgctattatgtgtgtgggtgtgaatctttgggatacaccattcagaagaaaatgttaccttgcaacatttaattgaatgttcaccagattgttttccatcaaatttgggaagtaagcctcaacttcccatttgattcctttattgggtttaacaatactcaaaggcataaattgctccactgattgattaaattacatgctgttccctttacaggtatagtttttgaggatggtctttgaggtttcttataatcccaggaagtgtcttattagctaccattttctctggttgtctggtaaagttctacatggtctacagtttgtcttgttgctctcatggagccaaaagtttcctcttaattgcttatgaccaaactttctgttaccttcaacttacccttaggcgtgaacttctacacagtctgttctaaatatagtcttataactttggatgagcttcacagttttctgttcttacaacctgcctccttccctgtgtacaatttttgagccacttctccagaacttgctatgatgacagtgactcattactaccatagaggcacacctgctttctgaccaaggtggtaggtggtagcttctgattatcttagtttgccttctttagtgtgaaatcctcactttaggagtaatttgaagtgaagacaaacggaccccggtatccttcatcttccacacctggagaagagcttgtatcttatgagtggtgactggatagtagaagagagcctcagaacttttagatgctattgtttggaatagagcatctgtatgtaacacagagctgagagaaaaagaaatggtggtgggctcctcatccctggaatacactgtaactctagactggaagttgagggagagagaaccctgagttcttgggcgaccccaccataagtatgcctcctgttattataagctggaattgaggtgaaggagtgggttatagttcaaatgccacaagcatgctctgttcttgccaagatttagtaaattttctttaaaaaaaattttgttttcaaacttacagtatgcctctagaataattttcagacactttaaatatttgttattaaataatttataccagttatggttcttgttttggggaaaacttctcactctactgttttggaactaaattctctaaaatttgtttttaaaatttgaagaaatggcaagtgaaaacaaaagttaattcttgaaaaataagaatgaaataggaaactgaagagtaagataagaaaaacagttaaaaacatgtcaaataagggatgagaaagacaatatactcacagattttgaagttactgaaacattttaaatgtggaacattattcaagaaattttgaaatctggaggaaattattttatttcaaatataaattaccaaaattgactttaaaatattctacacaaagctgaagtaactaaaaacagcatagtactgatataaaaagagacaaatacaccagtggaacagaatagagaatctagaaataaatccatgtgttgacagccaactgacttttgacaatggcaccaagaacatacattatggaaaggacaatctttttaataaatggtgctaggaaaacaagaaatccatactcagaagaatgaaactagactcctgtctctcacctcatacaaaatcgactcaaaatggattaaaaagctgggtgcagtagcataagcttgtagtcccagctactcaagagattgaagcaggagaatcacttgagcctagaagcttgaagctgtagtgctctatgattgtacttgtggctggctagtcactgcactgaattctgaacaacagagtgtgaccccatctctcatctctaaaaatatttaaaaaatggattaaagacttaacatgagaatcaaaactataaaacaactaggaggatacataggtaaaatgctttaggacactggtctggaaaaaaaaaatgtccgaataagacctcagaagtacaagcaacaaaagggaaaactgacaaatggggttacatcaaactaaaacacttctgcacagcaaaggaaacaatccacagagtgaaggcaaaacctgaagaatagaaaaaatatatttgcaaaatatttatctgacaagagattaatattcaggatataaacagaaatcaacagcaaaaaatacaaataattcaattatgaaatacacaaataatcgaatagacatttctcaaatggagacatacaaatgaccaataagtatattaaagaatgtgcaacattcttaattatcaggaaatgcaaatcaaaactgcaaggaaaaattatctcgacacagttagaatggctattatcaaagacaaaaactaacaaatgctgatgataatatggaaaaacaggaatgctttcatactgtcagtagcaatgtaaaatagtacacccgatatggaaaacaatatggaggttcctcaaaaaaactaaaactggaactaccatattaaccagcaattccgctactgagtatgtatccaaaggaacagatatctgcactcccatgtttattgtagcactcttcacaatagccaagatttagaatcaacctaagtgtccatcaacagatgaatgggtaaataaaatatggtatatatagacaatgaaatactcttcagccataagaataaaatccttcatttgtggcaacatggatggaactggaggacattatgttaagtgaaataaaccaggcacagaaagataaatactgcatattctgtcttatacgttggaggtaaaaaaaaaagtgctcacattgaagtagaaagtacaatagtagttactagatgctgggacggaaaagagcaggaaatacgaagatgttggttaagaaaatacaagttacaggtagataggaggaataagttctagaactctacagccctgtagggttactataattaactataacttattgcattttgtaggagatctgtcagggtagtgggagaaattgtaggaagggctttgcaaagctttggggaagaatgagccgaaggccctggttcttatcctggggcaaagggcatgaagtaggtacaaaagaatgcaggggagtttatctgaatagcttgtttactcatgactccagaaacctggccattaatcatccatgcacaattatccacaagtgtattgactcgaggcctttgtcattaaatatatactgaataaatgcccacagcaccagctggtcagggctgggctgctgactctttacagcaccctccttggggtctgtaagcagccgtgtcccctagccctctctttcactgggtatctgtgtctgagtgcatttgttcatccattgtttggccagggtctgcgggtcagacctggtagttttgtttgtttgttttgttttgttttgtttttgagatggagtcttgctctgtcgctcaggttggagcacagtggtgtgatcccagctcactgcaacctctgccttccgggttcaagcgattctcctgcctcagcctcccgaataactgggactacagatgtgtgccaacacgcctggctaattttttgtatttttagtagagacagggtttcactgtgttagccgggagagtctctatctcctgacctcgtgatctgcccgcctcggcctcacaaagtgctgggattataggcatgagccaccatgcctggccaatttattgtatatttttaaatagctagaataaaagaattgtcacattcccaacacaaggaaacagtaaatgtttgaggtgatggaaatgctaattcccctgatgtaatcattacacattgtatgtatcaaaatattacactgcatctcataaatatgtacaattatgtgttaattaaaattttaaaaaattaatgtggatctaaaatctggaaaaattaatttatttcactgcaaatataattaccaaaactgactgaggaaatggtaaaatatctagacattaaagtaatctcagaagacagagcaaaggcaatttaaatgcaatttaaaaccaatttctttaaaaagagatcaggcttagattattttgcaattcaattgcatataacagtttgggcacataaaaccataaaactcctattttttatttagatttggttcatgtacaaaaaaacgctgtacatattttatgtatacatcttggtgagtttgaagataagtatatgcctataaaattatcaccataaacaatgccataaacttagtcaaaacctataaaagtttcccctctttttttgtgaaaggatatttaacataagatctactcttttcaccaatttttaattacacaatacagtattgataactacatgtgctattctgtatagcagatctctaggacttattcatatagcctaactgaaagtatgtactctttgaccaacacgtcccttatccacactataccccagcccctggtaaccaccattctattttttgtctctatgaatttgcctgttttagatatctcatataaatgaattcatatagtatttgttcttctgtgtctgtcttatttcacatagcatgctatcctccaagtttatttacattgtagcaaataatggtaagatttcattcttttttaaggctgaataatattccattttatgtataggtcacattttctttatccattcatctgttgatggatatttaggttgtttccatgtcttgatcattataaatagtgctgaagtaagtacaagaatgcagatatttctgtaaaactccgatttcaattctttagggtaatatattcagaagtagtattcatggttcatatggtagttctgtttttaattttttgagaatccttcatagtagctatactaatttacattcataccaatagtgtacaagggtttgttctctctacatactcatcaacatttattttattttccttcttttatatttaataatagccaacctaagagatgtgaggtgatttttttttatggttttggtttgcattttcctgttgagcaccatctcatatactgttgtccatttgtatgtcttttttggagaaatgtttattcaggtgtcttactaatttttaaataagtttattggttttatatctgctactaagttgtaggagtttcttatatattttggatattaagcctttatcagatatatggcttgcaaatattttctcccatgccatatgttttttttttaattattatttttttttattttgctggctgtttcttgtgctgtgcagaagctgttaagtttaatgtacttccctttgtgtatgcttttgtttcctgtgtttttggtattatatccaagaaatcattgctaaggccaatgtcaacacgcttttcccttgtgttttcttctaagaaaacttccacattatccaaactcattccatctgtaaaaaactattaaaaatctccataattcatcatatgaaactaaaaaaatttttctacttaaaactaaaaacagtagtgcaaaataagaaaatggtagcaaatgtaattaaaaacataagtgaaaaaatttaaaacaaatcttagtcaatcaaattgagtaataaatgaagagaataatcccatgatgtctgattatgttttatttcttaaatgcaaaatttggtgttttttttaagaaaatctgtctaaagaattcactctatcaataaatttaaggggaaatatatgactgcatcaatagatgtcaaaataaacattcaactaaaataaaaatttaggtagaaattaaaaggaactgtgaaaattgataaatacattttgccacaaaactaggagcaaacatagtttataatgcaatacgaattttcattgctgtcagaaaaagattgatagctgccatcctcagtattattcaacaatatttttggagattttagctgatgcaatgcaataagcaaatgaaacattcagtataaatgttgaaaaaatttttaaaaactcaaaaataaaagtattctagtaattcaaaagacacttctttctgttattagaattaagacaatttgatggtacaattattattaattttttgtgatcaaatttttatcataaaaaatcaatatatacatttttgtatactaccctactaaaaacaaaagaaaaatatctcattcacactaataacaccaccatcaaatactttgtaatgaatttcaaagaaatgggacaaaatctatgtgaatctataaaatttaatagaaaacataaaaacaaatctgtctaaatggaagaacaagccatggtctcagatgagaagacataataccatcaaaatatgaagaccttgtaatgtaatacatttctttactgcatccagtaataataactgccaatggagttattattttgggaatcttcataaaaatattattctttttattttactttaagttctgagatacatgtgctgaatgtgcatgtttggtacataggtatacatgtgccatggtggttttctgcacctatcaacccgtcatttaggttttaagccccatatgcgttaggtatttgtcctaatgctctccctctcctttccccccacccactgacaggccacgttgtgtgatgttcccctccctgtgtccatgggttctcattgttcacctaccacttatgagtgagaacatgtggtgtttggttttctgtccccatgttagtttgctgaggatgatggtttccagcttcatctatgtccctgcaaaggacatgaactcattcttttttatggctgcatagtgttccatggtgtatatgtgccacattttctttatccagtctatcattggtgggcttttgggttagttccaagtctttgctattgtaaatagtgctgaaatgaacatacatgtgcatgtgtctttatagtagaatgatttataatcctttgggtatacacccagtaatgggattgctggatcaaatggtatttctggttttagatccttgaggaattgctgcactgtcttccacaatggttgaactaatttacactcccaccaacagcgtaaaagcattcctatttctccacatccttgtcagcatctgctgtttcctgattttttaatgatcgccattctaactggcatgagatggtacctcactgtggtttcaatttgcatttttctaatgaccagtgatgatgaggtttttttcatgtttcttggccacatgggcaaatacttcataactaaaacaccataagcaattgcaacaaaagccaaaattgacaaatgggatgtaattaaactaaagagcttctgctcagcaaaagaaactatcatcagagtgaacaggcaaccttacagaatgggagaaattttttgcaatctattcatctgaccgaggtctaatatccagaatctacaaggtacttaaacaaatttacaagaaaaaagcaaataaccccatcaaaaagtgggtgaagcacataaaattactttaaaattcaagcaaatattttcttaaaaataagattaataaggagagagaattgcctcaccagatgtaaaaatttactatacaaatatagtccatgtgatatgatatgactgagacagaaatagaaaaatagaactttgaaagttaaagattagagggaaatagatccaagtacatatataatgttaggattaagctttactccaagagacccaaaataccagtggctttaaaaagaaaatgttgctttcctcattcatctggagaaaaaatttaagtctggtatgcaatgctactgtgtcagtgatattgactccttctatcttttttttgttatattgtgtggtctcaattctcaaggtcattcatgatccaaggcagctgcttctgtttcattcatcccacctggattacagtctgcaagaaagaaaaaaaggaaaaataagggcaaaactccatccttttaaggtcactttcagagaagtctacatactcacctagaatttgtcttagccatatgtagtacaagatcagcccgaaatgaaatatttatttttaggcagtcatgtgccttgctgacaagtggaggatatcaaactataaaagaaggggagaacagatattgatagacaactagcaatctcttacacatgtatgacacggttagcatttcaattctgtggggaaaatgcagtgatcatcaaccttgaacatgcatcagaatcactctctcccttgctggcttttaagaagaaagctgccatgttgtgagctgtcttatggagagagccacatgggaataaactgaaagcatcctctgactgaaagtcagaaagaaattgaagctcttagtctaacagcctgcaagaaactgcatattgctgaaaaccatattagtttgaaatcagattctttcccaggtgagctttcagatgagaactcagtcctggccaacatcatgattgcagccttgcagaacacccaataaagccatgacaagaaccttcaccaacaataactgagagataataaatatgtgttgttttaagtcactaagtgttggtaatatagttaggtagcaatagaaaactaactatgctagatgttagtcatactactgctatttgaggcctaattagttatttaatatattgtgtcaccacccatggctatgtgtaacaagggaattcatatatttctataacctcaagtttccatagaatatattccatgcagacaactttcagatatataaacaaatttattctcaatctactgcttattcattcttctcctaagacaagaaggtctcctaatggtagatggtatccattggtccatggttattaattgcatagaactaatggcatattctacacctgcactgtttaatataatagtcatatggcaaacgtggctatttatttttaaaccaggtaaaactgaatcaaataaaaattcaattctctatttacactagaccttttttctgcactccatagccacaggtatcaatggactcatttcatcatcaaggctagtggctatcacattggagactggaattatggggcattttaatcattatataatttttttatagttctggtctatacttaggaggagaggaaagtggtatgtagagatctgtagttttcctcttatcgtctgcattggtaataaagctgacattttcgtcagtatcttgtatactgatacaatattttgtatctaactttcagttgctttccaccttcgggggaaacaagaattttcatgtaatgatctcttaaaatatgctactgttcattggaacaaatatgtagcaagatccttaagtcttaccgcatataaaagcaagtgccaaatgggtttaatacctaataagaaacagaataatatagagtattacatctattttaagatgcataattatttttcatattataactcatttgaaatagaatgtatcttacaatctaatgatgtcttgcaattgctcacggatagatggcaatcatgacatagttgccattgccaacacaactgtcaatttgattgtcattttgggtaaaataactacatagctttactccttgaaatttcattcggtaaatcatataaaaaccacttgatgatgaaatgagtccattgatacctactggtaagaccaagaaaaagaacacattaaaacttacagaatgggtgcctgaggttcctaagaaaattaagtagataatagtgaagtaactgttaatgacaaaggggtcagtattatgtggctaaataataaataaataataaatccatgactgtgagttgaaaaaaaaaaaagattcagaacagttggacctttggtgtaaagaaattataacagcatttttttgagacagaatctcactctgtcacccaggctacagtgcagtggcatgattatggctcacttaaacctcatacttctgggttcaaaggattttcccacgtcagctttctgagtagctgggactacaggcacgtgcctgcatgctggggtactttaatcaattttctccttatgtttttcttttcatgaatgtacaggtgtacattataaaaactatatctaaataagtgttttaaagtctttaatgaaataaagtaataaatgataagaaagcattgtatcagttggactgccagtgccattttctttcttcgtggtacacaaaatgagatgaatcataaaacttatagtatcttagactaaaatataaaacataacaatgataatgatagtaatagatataataagagtactaagtattaatagtagtagatataacagtaaatagtaatattaacattaggaggaaatttagtaaaatgtttatataaacttaggataagattgaagagaatgattaggccagtaagttaatccataatgcataaagcataatatggaaattttggttacctaaataaatagcgtttggtaaagataccataaacaaagacaaaatatgaagaatggactgagcagaaatattggaaaaatgaatgacagagtaagatttaacaacactaatacagagagctcctacaaattgaagtgaaaaaaaaaaaccaaaaaactgttaaaatattcaattaagaggcattttttaaaaaaaccaaaactgttcttttatttacaaagaccataatctagaaatttcctgcagagtgcaaagtccaaagtgctagataaagtctgagtgctgttagacaccccaatcacaagtaagcaataaaggccggatattacatatttaaacaaccaatgtttctcagttttaggaagaaagcaaaaacactgttgttcatttgatagagactaaaagggtgacaaaagtctttcgccaaagactttactactttactaaatttttcaactcactgtaattttaaaaataaaaaatagtatactatatataggggagtgtggcaagttaaatatacccacagattctttgatgctactgccattgagagggagatctataatactgactttgaatttgggtggattccctaactgctttgaccattagaatacaacagacgctatgctgtgccagattctaggcccagtccttaaaagattggtaggttccacttcctgcccagcagaacacttgcctggagccccgaagtgctactactgtgccatggagaagactcgcacaagctctgaaatgatagaaacagcaagtgagcaagcgagtgagcgagagagagaataacttagatatgtgcagcttctagccattgctgatattttggaccctccagagataaccagctgttagctgaaaatcactgagtgacctcagttgacatcatgtctcggtagagaaacacttttgtgaaatagtcactatttctgtggatatttatagtgaccagtaggtcgctatatctcagggggaagcagagttgttgaattttgtatacacaatggaatattattcagccataaaagaataaaatcatgatattgaaaataaaatggatggaagtggaggacattattttaaggaaaataagccaggcatagaaagacaaatatgtcatcactcatacgtgggagttaaaaaaaaaaaatgaactcatggagataaagagtagaatgacagttaccagaggctgcaaagggtagcagagaagggggcataaagtggggatggctaatgggtatgaaaatacagttagatggaatgaataagatctggtattcagtagcaaaatagggtgactgtagttaacagtaatatattgtataatttaaaatagcaaaaagggtagaattggaattttcctaacacaaataaatgataaatacttgagataatgcataccccaattaccctgatttggtcattatatattatatacctatatcaaaatatcacatttaccccataaatatatataactattatatactcataataataattaaaaaaaaacatgttggaaatgggaaggctttcctaattttattttatttgaaatacaagccctagaatgtatattaattccctggaactgccatgtctatttgggaagaaaatgggattttccaaattaatagcacctcatgtctcattttcttgtataatactgcttaaagagagcttttgtttctcaacctctagatagtctgtaaagcatgacctctgtaatagttttattgaaatgcttagtctgaattgaatcgtggtgaaacaattaggtgtatccatgttgtaggaattctaaaaagtaactgccctggactcttcaagatgccaaaagacacgtacatgtggaggaactatttctaataaaaggagcctaacaactgtcttagtccatttgggccactctaacaaaataccagaaactgggtggtctataaataacagatatttatttctcaaagttctagagactggaaagcacaagactaaagctccagcatatttagtgtttggtgaggttccactttctggttgatagacggcaccgtctagttgtgttctcacatagtgaaaggagcaaatgagctctcttaggccttttacaagggcactaaaagcacatgcgagctctgacctcatgacgtaatcacctcccaaaaggctccacttcctaatacattcaatttgtgggtaaggatttcagcctatttgggggagacaaacattcagaacaaagcaaaaaccaagtgcaatgcctgtttattgattagattctggtttgggtgtgggaggtgacgaggactattttcttgaccaaactttaatgaggctgatctgagcttacttctcaactaggaagccttgtccttgggctgaaaagcccagttttagcaaataattgtgctgagtcagcttattgataatagcattacccttgatacctgtggtattatatatatacagtgtgtgtgtatgtatgtattttgtatgtgtgtgtgtatatatatatataaagattttttgtttatggtccctggctcataattcccataacccttgctataatttggggacattttatgcctcagtagcaagcctcggaaaacagattctgtctttctgaccttccattgccctccctccacctgcccaaggcaggactctagtctaattgttgagtcataagaccattactccagagagggtcctgcttcataccctggaggaagaaatgctgcaaggagagaccagaggaatctgaaaagacagaccttgctgggcttccccactcagtctattaatattagatcaaaactttttgcctaattacatttctgcttggttgtcactcatgcctatccaatgaagtctctataaaaggcccaagaggacagggttagcagagctcccagatagctgaacatatggagattcctgggggtggtgcacctggggagggcatggaggctcaatgccactacccactatatctttccctatgcatctctttgtgcctatcctttgtaatatcctttataataaaatggcaaacataggtgtttccctgagttcggtgagctactctagcaaattaatcaaacccaaagaggacatcgtgggacgatcaacttgaagctgattagtcagaagttccagagacctgacttgctgctggtgtctgaagtgtgggacagtcttgggatggagcaatcaacctgtggaacctgatgctatttccagataaatagtgcaggaattgaattgaaggacactcggtgtctgttgcagaactgatggcttgcttaaaataggaagaaccaccccccaacccatcgatatttggtcacagaagtcttctgtgtttattgttgtgctgagagagcagaggaaaaacagttggagtttttttgccacaatatctaatcaagtttctcttcccctacccttgatatctaatcaaattctttttagtaattttctattcactgactttcaccttgcccttcggctgtgaatccccagcttcccttgctgtatttgaagttgagctcagttctgtactgaaatctctccccctactgcaatggctcaaattaaatatgtcttgccatttttaacaagtgttcagtactatttccttttaatgggtggagggcagctctacagaatatttttgtgaatttgaagaaattttaacacatattgtattttaaatgtgattattctttcagtattttgggtgtggtaatggtgtcttgtgtgtctttatcttaggagatacatgttgaatatatatatatatataattttaagatatctgaaacataatttcaaatgatttatctcccctcacaaatgtgtccgtgtgtgtgtgtgtgtgtgtgtgtatgagtgtgtacatagataaaaattataggaagcgctctcactctagtatgcgtcacttgtcctgtagaattgaaaatttacaaaataaactgttgaagaaaacaatagtctcttgaaaactattaatagttgtttatttcatgagaaaaacttacgaacaagaaaagaagagaaactggatgctttcttttcattttatatcttattcataatgtttagattttaaaaatagcattcacatataacttacttcatcaaatataatatggcattgattctaagatgaattatcttatatacttttaagaaaaaatattctgtcaaatagactatgacacaacaattcaatggtgattgtgcatgacacaatgttttaataataatcccacactacacatgaatggcttataataatatcctgtcatcgtagtggattttctttcatctattcccaagatataaaaacttattttgccttaagattcattgcttgtggtgtgattggtaaacactttacacatgtgtctgtaataaaatttaacagagcttcatttacttgtgtgtttctttctttagtcttttaagtaatctgattatttctttgcatgaaaaatgaaactgaactctgtattggaaactatacttccccttcagattagatttcaggaataaagaatataatcacccagctactcagaattttgccactagacagtcctcagccgtaagctttcttcagaattgtctttgctatagacagttgcaacctacacactgggagaaaatatttccaaaacatatgtctggtgtggggttaatatacaaaatttgtaaggagctaacacaacttagtagcaaaaacaaaacaaaacaaaacagagacctgatttaaaaatgggcaaaagacctgaataaatattcctctatagaaaagacaaaaatgagtatcagttatatgagaaggtgcccaaaatcactaatcattaagaaaatgcaagtgaaacccacaatgagatataactccaacctgctaggatgcctattattaaaatataaatgacaaatgctggaaaggatgggagaaaagagaaatcttgtacactgttgatgggaacgtaaattagtatagctattatggaaaacagtatggaggttcctcaataaaaataaaaccatcatttgatccaacatttccaactctgaatatacatttgaaggaaacggaattacaatctctggaagagatgtgcacctccatgttccttgaagcattattcacaatagccaagatacgtacatatatatatgatatacatgtgtgtacatgtatgcttattacagcactattcacaatagcaaaaacttggaaccaacccaaatgtccatcaatgatagactgcattaagaaaatgtggcacacacacacaccatggaatactatgcagccataaaaaaggatgagttcatgtcctttgcggggacatggatgaagctggaaaccatcattctcagcaaactaacacaggaacaggaaaccaaaccgcatgttctcactcatagatgggaatcgaacaatgagaacacttggacacagggaggggaacatcacacatgggggcctgtcgtggggtgggggaagggggagggatagcattaagagaaatacctgatataaatgatgagttaatgggtgcagcacaccaacatggcacatgtatacatatgtaacaaacctgcatgttgtgcacatgtaccctagaaattaaagtataataataaaaataaataaataaataactaaactgtagcttttttaaactcagaaactatatatattctctttcactgtgtggaaatgagtgcagagttttgaaaaatagataatgattattcccagatgtttactctttcatacgaaatttagagtcattttatccaatctttaacttatttaatattggattttaactggaatctttcacttcaagttgttcaatcaactggctggcaagttggagctgactcggagttcagctgagtctgtgagccacggactttggttcctcagtccctccttaagcgggtctccctgcatggctgcatggattttctcatggtaagttgcctggattctgtgaaaaagaaacgtgagcaaaacaaacaaaagtgttatggcttatgcttgaaaatcacaaattgtcacatttgacaatcaaaagcagaatcaaagttacattgtaaaaagattgtaagaagagattgtggcatatggccatttttggatatacattccaacacacagatttaaggtcaaattgggtaaaactctcttaagattcaactaaaaagtcaaataatttagaatagccaaaaacacggacatacagaggcatggaaaaactaagaaggagcttagcgttcaaacataccaaaacaacatggtactggcaaaagtatgaataaatagatcattaggacagaaagagagcccagaggtagatccttgtatataatattcaaccatatataaagcattattttattcaaatagtgaaagatgtttcattcaataaatggaattagcacaagttgttatgtatctgggagtaaaaaaatagaacttctatggaatatcatattcggaaataaattccagatatattaaatatgtaaatgtaaaatctaaagcaataacatatttcgatattttaaattatatatacaaccaataacctgggaggggagaattttttaagacaggaaacacagaagctataaaagaaaagaaagaaatgcttggctataaaaaataatttttttctatgacaacagatgcaatataaaaagtcaaaagataaatgataaatcaggaaaaattgtatgcaaaacaggggacagaacttttttactgaaaaggtacacatttttctagttaaaaaaagacaaaaagctcaatagaaaaatgagaaaaataacaataactattgctctcctaggtaagcattcctggtaaggatctgtgaaaaatgatactcttattcattagcagtagatttataaatttttataatccgtttgaaaaggtaagcttgttagagctataaaaattaaatggaaatgtaccctcattcctctgccactcttaatgtacttggttctccctccttcctcccttttctgtctgtcagttcctccctccctttctctccttttccccctcttttttgctctcttctctcattctgttggtctatttctctttatcttttctctttcagcaattatacatcagggaatctatgtgatagaaatacattcacataaggaaaaatgcagcacttttcatattcataaaacacaggaagaaaacaatgtgattttttttctaaggtggtgaattggaggcaatgttagcatgcctctcccacttggaaagacaaaatatggcatagagattcacactataaacgttattccaagaagtaacacaggaatttaactggaaaactgaaagaaaccacagaccctttgaaagaagcatcaggctgcagcttagactgtgagccaggcaaaaaactgcaaagtcgccagagtgtgagagggagacgactgcctccaggatatagagccccactggggaacctgacaatacagcccacaagggaaggtcttaatcctacccagcactggaattgatttagggaacagcaggggatataaaagtaggagcagcagcagaaagagccttgtgggcattccttgtctccagcacagaccaagggaagccattcccaattctttgtcacaggggactttttggaagtaagctagctaactcagtcagtggtcacaggttgagaaaagcttccaactaaaatacttgctataatcttgattgggggcaaacttccttggctggaaccaggagacaagcaggaagtgtactgcagccatgagtataggagctgggtgtcctggccttgcaggtggactgggaggggtgtggcctgaaagctgaagttgccgtctctgaaggaaggcttatggtttggtgcaactttgagttctgagcatagactgcctggaaattagctatctgctgctagcagaacactgcaggtgtgagacatgcattgccaagtgtgtaggagatggatggggcttacagccacctgctactccccactccctgcatgagcttttctgtgcagcaggtgcagctattcttctccctaaaaaagtactccagtggccagagaaccaccctccctacccccaaaaaggctgctgcctgtcctgtatgtggaaagccagagcacagacctgcctgactcagcccccatctggctttgtccctccacctgccctggtagcttaacacacacacacacacaaacatacacacacacacacacacacaattttgggaggtctgtaacccgacccaccacgtgagaaaccagaatacctccctacgtaatataaggcaagcccaaatttcaatgctattaccacagctggggctttttttcaagtgccaccccctggctggaggccaactgatacagtccattacagcacctgcaggtagaataacactgcacctaggaaggagaaaacttgtggatgacctcagctatcattattgcctgcaccaccctggcaggaagtcctgagtttgtccacattaccagttcattactactaaaactggcatttgaggaaaaatcacactaaggctaattataaccaagaatcacagagtctacaccactcccctgccacccctatcagagctggtgctggtagtcagcactgggagacttgaagatggtcacatcactggatatcttgcaaacattccccagcaccaacctagagtgtgacagcccaactgggtggctaagcccagagaagcatcagtattcatagtaacctggctctcagggacaccccatgggacaaaagaatccagacagcaggacttaagtctgcttaagaagtttcaggagaggcacagttgtagtcctgggctcagtgggtaaagcctgtaactctatcccaacagtcaggcagccccggtgatcaggaagggtcttgtagaagggaacttctttttcctcattcaccactaaagacacagctagggcttcccccatgggaggtcagtgtgtgtgcatgtatgtgtagacagcctttgtggaacacttcagggtgactgcatggccaaaggaggagcatcctccaggttcaggcttgcacaagaactaaagccacagtgcctctctacttggaaaatcaacattcttgcagatgtaaagaggtggctgtgtaatctgaatagccggaacactaggtcagaagtgtgtctgtgaggtggatcactttgctagtggcctgagaggggaggtgagtttgctccaacccttccccctgacaagaacccaatgcattctactgagagcttcccgaggcatgtctgtcagtgcttggatctttgcccaccattacatatttcaattagctttagccacaaacggtttctactcagggacaccacagctactggcctgaaacctgaactatataatgcagtaaatgaaatcctaggggaaaaatgaatagatgtacaccataggggaatgagatatgcttcaagagacctctgtcattccaatcgcgtaggaaacagtgaacttgctcaaacactgagcacatggctaatataaccagcaccatacaaagactctgtaaccaaaaacctcatacagtcttcatccctgaaagcataaagagccaaattaagctacaacaaactaaaagcattaaagtaatataattaaggcaaaaagattacatgaagcacagacaaatcaaaaataaactcaacaataattagaagaaatactaataatataatgtaatataataattataaaaataattataagacacatttagggaattacaaaatgcagtggataatattaactatgacctaaaacaagtagaagaaagaatttcagagcacaaaagcaaggctttcaaattaacccaattagacaaaattaaagaaaaaagggtcaaaataaatgaacaaaatcttcaagaaatatgggataatgcaaaaaggccaaaactaagaataactggcattcttgagggagaagagaaagcaaaatgttcagaaaacttatttgaggaaataattgaggaaatcttttttttagcttactagagatttacatattcaagcacaagaagctcaaagaactcctgggagactgattgcaaaaaggacatcatgaaggcttatagtcatcaagccatctaaaatcaacataaaggaaataattcagagagcagtgagacaaaagcatcaagtaacctataaaggaaaacctctcaaattaaaagcagtcttctcagcagaaaccatacaagccagaagggactggggtctcatcattagtctccttaaacagaatagctgtaagccaaaaattttgtgttcagcaaaaccaagtttcataaatgaaggataaataaaatcattttcagacaaacaaatgctgaaggacttgtcactaccaaactagccctacaagaaatgttaaaaggggttcaaaatgttgaaacaaaagtttgatatgcaccagactagaacctcctgaaagcataaaactcacagggcctataaaacaataacacaacgaaaaaaacatatctagggaaaaattaacataattactagaacagtatctcatatctcaacattgacatttaatgtaagtggcctaaatactccacttaaaaggtacagattggcagaatagattaaaaaaaaatcaaaaccaaatatctgtcatcttcaagagatttacctaacatgcaaggatttacataaagtcacgataaaggggtagaaagagatactccatgcaaatagaaatcaaaagcaagcaggaatatctatttttgtatcagacaaaacagactttaaaggaacacaagtaaaaaaaaaagacattattatataatgataaaaaatcaatttaacaagaaagtattacaatcttaaatttatatgcacctaacgctggagcacccagatttataaaacaattactactagacctaagaaaagagatagacagcaacacactaatagtggaggacaacaacactccactgacagcactacaccaatcattgagacagaaagtcaacaaagaaataatgggcttaaactacactctaggacaagtggacctaaagatatttacagaacattttacccaagaatttcagaacttacattcttctcatcaggacatggaacattctccaagatagaccaaattataggctacaaagtaagtatcaacacattttaagaaatcaaataaatatcaagtaacttctcagaccacagtgaaattaaattagaaatcaattccaaaaagaccctcaaaatggtagaaatgcatggaaattaaacaatttgctcccgaatgatttttaggttaacaatgaaaacaaagtgaagattaaaataaatgataattagctgggtgtggtggcatgcacctgtaatgtcaactgctccagaggctgaggtgggagaatcgcctgaacctgggagtcagaggttgtggtgagccaagatcatgccactgcactcttgcctaagcaaaagagattccatctccaaaaataaataaataaataaatgataagagtgacacttaaaaaatttttttaatgcccacagtgtaaatagtgacacaagatctcgaaatttcccagaaacagcaaaagcaatgctaaggtgaaaatttgaagtgctaaatgcctacatcaaaaagtttaaaagatcgcaaattgacaaccaaatgtcacacattaaaaactagagaaacaagagcaaactaaacccaaagctagcagaagagaagaaacaacaaatatcagagaataactaaatgaatttgaaacaaaaaaatacagatcaataaaatagaaagttggttcttttacaagacaaacaaatttgatagaccactagatagattaaccaaaaatagaagaatcaaataccttcaactagaaataaaaatgaagacataacaactgacaccacataaatacaaaatattatttgagaccattctgaacacctttatacatacaaactagaaaatctagagaaaatggaaaaactcctgaacatacaacccttctagattaaatgaagaagaaatagaaaccctgtacagataaataacaagcaatgtgatgaaatcaggaatttaaaaattgccaaaaaaacagtccattagcagataaattcatggttgaattccaccagacattcggagaagaattggtaccaatcctactgaaactattccaaaagattgagaaagaaacaattctccatggcttattctctgaagctagtatcaccctgatacctaaaccagaaaaggacaaaacaacaacaaaaaggaaatctacagactaatatttctgatgaacatagatgcaaaaatcctcaacaaagtactagctaattgaattcaacagcacatcaaaaagataatacaccaagatcaagtgggtttcatcccagggatccaaggatactttaatatataaaagtcaatagatttgatacatcagattaaaaagaagtaaaaatataaaccgtatgatcaactcaatagaagcagaaagacttcagtcaaattcagcatctgtttataataaaaactctgaacaaactaagcataaaagggacttacctcaaaataataaaggcatatatgacaaaactacagccagattcatactcaatgggggaaacgttgaaagcatgaacaaaccagactggaacaaaacaaggatgcccactctcaccacttctattcaacagactactggagtcttagccagagcaatcagacaagagaaagaaataaagggcatccacattggataagaggtagtcaaactatcagtgtttgtgaataatatgactgtatacataggaaactctaatgattccttcaaaagaaactattaatagagacaaagaaggacattatgtacataattataacaaactcaattcaataggaaattataacaattacagacatatatgcaccaacatcagatgtcctaaatatatggagcatagattgaccagaattgagggaagaaatacacatctctacagtagtaataggagactttggtacctcatttacaatattgtacagaaaaactacccataacttccataaaaaaactagaagactcaaagaaaaactactattggccaattgaaactaacagagatatataaaaattcactcaaaaatagcagcatacattttttctcaagtgttcaagaaataatactgaggataaacaaaaagagagtcttaatagatttaaaaatatttaaattgtattatgtatctgttttgatcacaatggaatagaactaaatcaaaagcagaaaaaaattgaaaatctataaatatgtagaaattaaacacagttttaaacaaccaatggaacaaagaataaattataaggaaaattaaaatatatcttgaaatgaaaataaaaactcaacatatcaaaacttatggaatgcagtaaaagtagtactaagaggtgcatttatagctgaaaatgcttttattaaaaaataagatatcaaatccatagcctgaatatatatctcaaggaactagaagaagaacaaactaaacacaaagctagcagaggaaaggatataataacaattaaagcagaaataaataattgaaaaacaatcgagaaaactgatgaaaccaagaactggttcctcaaatagatcagcaaaattgacaaaactttagctatattgactaagaaaaatataaatgtctcaagtaactgaaaacagaaatgaaagcagatagtaagactgtttttatagaaataaaaaagagaacataaatttttgtatggtaaactacatgaaatgaacaaattcctagaaaaccacaaatatcaaaactaaactactaagagatagaaaatcacaaaagacttattagtagtcaggtgatggcatcaataattacaaacatcccaacaagaaaaagaccaggagaacataatttcactggtgaactctaggaaacaattaaaacattgacactaacaccctttaaaattttccaaaaatggaagtgtagagagtacttctaaatgcattctgttggtctagcattatcccaatatcaaggccagaaaaagataccataaaataagaaaactataaaccaaatttctaataaatactgatgcaaaagtccacaataacatagtagctaacagaatccaatcgcacactaaaaagattatacatgtatacagttgacacttgaacaacatggaggttgttcaagatgtaactgtattcctaggataaagggaaggttcaacatagaaaaatgaactaagctgagaaccaaattcagaatgcacactcattcagaattgccgcacaagaataaaagatctaagaatacatctaaccaggtaggggaaaaatttctacaatgagaattaaaaaacaatactcaaagaaaccagagaagacaaaaataaatggaaaaacattctatgctcatggattggaaaatacaacattaataaaatggtcatactgcccaaagcaatttacagattcagtgttattcctaccaaactacttatgatatttatcacagaattagaaaaaaaagtattttaatatttatgtgaaaccaaaaagaacctgaatagccaaggcaatcctaagcagaaaagacaaagccagaggtatcacattacctgacatcaaaatacagcacagggctgcagtaaccaaaacagcgtggtactggtacaaaaacagacacagaaaccaatggaacagaatatagaccccagaaataaagccacacacctacaaccatctgatttttaacaaagttgagaaaaacaagcaacggtaaaaggacttcaatattcaataaatggtgctgggataactggctaaccatgtgcaaaaaattgaaattggataaattcctgatgccatatactaaagtcaactcaagatggattaaaaacttaaatggaaaacctaaaactataaaaaccctgaaaaataacctgggaaataccattatggatataggatctgacaaaaattttatgataaagatgccaaaagcaattgtaacaaaaacaaaagttaacaaatgggacctaattaaactagagagcttctgcacaacaaaataaactatcaacagaataaacagacagtctacataatgggagaaaatatttgcaaactatgcatgtgacaaaggtctaatatctagaatctataagaaacttaaacaaatttaaaagcaaaaaacaaacagctccattaaaaagtggacaaagaacacaaacagcccctttttaaaagacatacacacaactaacaagtatataaaaaaaggttgacatcaccgattattagaaaaatgcaaatcaaaaccacaatgagatagcatatcacattagtcagaatggttattatttaaaagtcaaaaaataacagatgctgacaaggttttggagcaaagggaatgcttatacactgctgatggctatgtaaattagctcagtctttgtggaaaggagtttggtgatctcccaaacactataagtagaattatcatttaacccagcaattccgttattaggtatatactaaaaggaatataaattgctccaccataaagacacaaagacatatgcatgcatatattcatcacaacactattcaaaatagcaaagaatggaatcaacctaaatgcccatcaatggtaactggataaagataatgtggtacgtctacatcatggaatactattgggttagtacaaaagtaattgtgatgtttgccattgaaagtaatggcaaaaactgcaattacttttgcaccaacgtaatatacgctcataaaaaagaatgaaattatgtcctttgcagcaacatggatagagctggaggacattatcctaagtgaactaaaacaggaacagaaaaccaaataccacatgttctcactcataagtgggaactaaatattgagtccatgtaggcacaaagaagtgaacagtaggcaccagggactactagagggtggaggaagaaagcaaggtgagtaacagaaaactacatatcaggtgatacccttattacctgggtggcaaaataatctgcacagcaaaccctcatgacacgcaatttccccatataacaaacctgctcaagtactccttaacctaagttacaaaaacaaacaaacaaacaaacaaacaaaaaacgcattggaaacttaatccttattgcaacagtgatgggaggtgagaactaatggaagctgtttagatcaagagaagtccaccttcatgaatgccttattgctgattataaaagggcaagtttatattttgctctctcccattatctctttgcccttccaccatagaatgatgcggtgaaaacaccatcaacagacactaactcctgtatcttggacttcctaatctctgaactgtttggaaataaatgtcttcatatgttatcctgtgtgttatattcttatggtagcaaaaaacaaagacacaagtcaatgatagttattagataatcatcattatagtgtaacattgtctcacagggtctataatgtttctatggtttgaatgtctgtttctctaaatgttatgtttaaatttgattcacagttttggaggtggggtctaatgggagctgtttttgtcaaggtggctggtcccacgtgaatagattgctgccctcctttaggaataagtgaattcccgctccattagattctatgagttctggttgttgaaaagaacctgcctcccaacactgcttctctctcaccctgtgatctgtgcacaatctggccatccttcaacttccaccataactggaagcaatctgaggacatcaaccaatacagatgcccaatcttgaactttatagccattagaattgtaagccaaataaatctattttcttgatattatttaattttttgaatgttttaagattggttttgtgacttaacatacggtctatccttgagaatgatcaatgtgctaaggaaaaaaatgtgttttgtgcagctgttgaatgaaatgttatataaatatatgttaggtaaatttggcgtatagtgcagattaagttggacgtttctttgctgattttctgtctgggagatctattcaaggttgataatgaagtgttgaagtttccagatattatcatatcaggatccgtctctctctttagctctaataatatttgctttatacattcaggtgcttcagtgttcaatgtatatatatatatatatatatatatatatatatatatatttaaaattgttatatcctattactgaattgacacttttatcattatattgtgactttcttggatttgtcttacacattttgtcttgaaatctattttgtctgatataattactcctgcatctttggtttatattgaaataaaatatttttccattcttttatttttagagtatgtgtgtcttaatagatgaagtgtgtttgttgtaggcaacagatcacaaagtcttgttttttcatctattcagccacagtctgtattttttaatttttaaaaaaattttgtaggtacatagtacgtgtatatattcatggggtacatgatgtgttttgatacaggcatgcaatgtgaaataagcatgtcatggagaatggggtatgcatcctctcaagcatttattctttcagttacaaagagtcaaattatattaagttatttaaaaatatacaattaagttatttttgactatagttaccttgtcctacaaaatactaggtcttattaattctttccacttttttgtactaattaacctcccctcctaactcccaactctccactacccttcccagcctctggtaagcattcttataatatctctgtgtacaaattcaattgttttcatttttagatcccacaagtaagtgagaacatgtgatgtttgtctttctgttcctggcttatttcacttaacataatgatctcccatttcatctaccttgttgcaaatgacttaatcttattcctttttatggataaatatactctgttgtgtatatgtaccacaatttcttcatcgattcatctgttgatggacacttagtttgctttcaagtcttagctattgtgaatagtactgaaacaaacatagaagggcaaatatctcttttatatactgatttgctattttcgcgtatataccaagcagtgagattactggatcatatagtagctcaatttttagtttactgagaaacctctacactgttatccatagtggttgtactaatttacattcccatcaacagtttataaagactctcttatctccacatcctcatcaacatttgttattgcctgtattttttatgtaattcattttaactgaggtgagatgttatttcagtacagttttgatttgcaattatctggtaatcaatgatgttgagcaccttctcatgtgcctgcttgtgatttgtatgtcttctttcatgaaatttctagtcaaatcttttgcccattttttttaatcagattattagagtaatatagagttgtttgagctccttatatattctggttcgtaatctgttgtcaaatgggtagtgtgcaaatattttctcacattctatgggttgtctctttactttcttgattgtatcacttatgtgcagaagctttctaacttgttgtgatgccatttgtctatttttcctttggctatctgtgcttatagagtattactgaagaaatttttgccctaaacaatgtcctggaaaattttcctggtagttttcttttcttttttctttgtttcaagttgtaatcaaagcttgtgtataagattactttattcctgcatcttctcaattgtttcttccttgtatttgcccttttgctttcctacttggcaagatttggctttccgttcacggatatttttgcggtctttgtccagttttagcctagtgataaccaccttgctggggtgaatgcctacgtggacagttgtgccattagccttttcccgctgcacccgttcaatgtagatagcatatttcttcctgtaaaccttgactattttgccaatttgttgacctttatagtgtcctcgtacaacctgaacttcatcatccttttggatgggcatggatcacccgttatacttctgtttcagctcgttggaaagaggggaagacaatcttcccgtgaatgtaggaaggtgcattgaaatgccttttgcgactcttccttcagttggaagtcacaaagggattaaacttcattttggccgctccctcttcagtgatggatgcaaaagggaagagaactacacactcctgatagttttcttgtagcagttatgtagtttgagatcatagatttaagtctttaattcattttggtttgattttgtatatggtgtgtattattccattctcatactgctatgaagaactacctgggactgggtaatttatagagggaagaggtttaattgactcagttccgcatggccagggaggcctcaggaaacttacaatcatggtagaaggcaaaggagaagcaggcaccttctttacagggcggcaggatggagtgagtacaagcaagggaaatgccagatgcttataaaaccatcagacatggtgaaacactctatgatgagaacagcatgggggataatgcctccatgatctgattacctccacctgatcctgcccttcacacttggtgattacacagattatggggattaaatttaaggtgagattttgggtgaggacacaaccaaaccacatcattgtgagagatagttaaccagttttattattctgtataaggatatctagttttcccagcatcatttattgaaggactgtctttccctcagcatatgttcttggtatcattgtcaaaaatggtttcactgtaggtgtgtggatttgtgtctgtttcattggtttaagtgtctggtctgagttccagcaccatactattttagttactatagttctgtattataatttgacatcagataatgtgattattccatttttgttcattttcctcagcatacctttggctatcctgggtcttttgtggcttcatatacattttagaattagtttttgctagttctgtgaaaaatgaatttgtattttgatacaggctctattgcatctgcagatagctttggtagtgcgtacattttaacaatattgattcttccaatccatgaacatggaataattttccattttatggtgtcctccttaattttttatcagtgttttatagtttttgatataggaatctttcacttctttggttaatttctaggtatttatgtgtggctgttgtaaatgggatttcttgttttgttattttttttcacattgttaactactggcatatagaaatgttactcattttttctacattgattttgtatcctgtaactttactgaatttgtttatcacttctaataatagtttccttgtggagtctttagatttttccaaatacaagatcatataatctgcaaataagggcattttgaccctttcctttcaatttgaatgccctttatatctttctcttgtctgattgctctagctgggactttcagtactatcttaaataacaatggtgccagtgtacgtccttgttgtgctccagatcttagagaaaaccctttcagtttttacgcattcagtttttacgcattcagtattatattagccgtggcactgtcataatggattttattatgctgaggtatattccttaaatttccaccgtttgaaggtttttattatgaagatatgttgaattttatcaaatgctttttccacatcaattgaaataatcatataattttttcctttattctgttgatatgatgcatcgtattggttgatttgtatatgtttaaacatctttgcatcccagggataaatcccacctggtcatgatgaataaactttcttaggtattattgaattcagtttgctagtatttcgttaagaaattttgcaacaatattcatcagaaatatcgcccagtgcttttctttaattaatgtgtctttttatagttttggtatcagggtaatactggcctcatagaataagtttggtcttgccctctattttttaaaatagtttgaacagaattgatatgagtttttctttatatttttgttagaattcagtagtgaaaccatcaggccttgggcttttctttactgtgagacatttcattatgtatttgatctcattatttgttaacggactgttcaggttttggatttctttctggttaaatcttggtaagttgcatgtatctagcaatttgtccctttctttgagattttccaattgtttccaatttgttttaagaattcttttaactttcttttttcattgaactgctggtcacttaggagcatattgtttaaatttcatgtattggcatagtttcaaaaatttctcgttataaatttctagttttattccattgttgccagagaagatgcttgatattatttcaattatttgaatattttaagacttgctttgtgacctaacatattgtttatccttgagagtcatccatgtgttgaagaaaagcatgtgtattctgcagctgttatgtaaaatgccgtgtaaacatctattatatccatttgttctatagtacagattaatcctgatttttttttattgattttctgtctagaagatctgtccagtgctgaaagtgggggtgtcaaagtctccagctattattgtactggagcctatctctttctttagctctaataatattttctgtgtatcggggtgttcccgtgttgggtgactacatatttaaaattgttatatcctcttaccaaattgacccctttatcattatatagtgacctactttgtctattcttatagtttttgtcttgatatctatttttttctaatataagtatagcaactcctgcttttttggggtttgcattggcatggaatataattttccattttttaattttcagattatgtgtgtctatataggtgaaatgtactccatttacacaacagataaatggatcttgtttcttcatccatttagccagtctatatcttttgattagagtgtttagtccatttacattaaatgttattattgataagtaaagacttattcctgccattttgttatttattttctggttgttttgtggtctatcttttctccttttattctttcctgtcttcccctagtgaagatgatttcctctgatgatataatttagtttcttgctttttattatttatgtattcattgtatgttttttggtttgaggttaccatgaaacttgcaaatactgtcttatagcccattattttaacctaaaaacaacttaatatttgcatagagaaacaaacaacaagcaaaacaataactaatacaaacttgccttaactttttccttcaccttttaaatttttgtattttctatttatattttattgtactatgtcttgaaaagttgttttaggtatttttgtttggttctttatttagtctttctacatataataagagtagtttacacaccacagttacagtagttacagctttacaatattatatgtttttctatgtagttgatactaccagtaacttttgtgccatcagatgattatttattgctcattaatgttttttattcatttagttgaagtactcttctgagtatttcttgtaatatgggtcttgtattgattaaattcttcatcttgtatttgtctgggaaaattattatttctttttcatgtttgaaggttatttcaccagatatactattctaggggatacgttttttccttcagcattttaaatatgtcatgccattctttcctggcctgtaaggtttctactgtaaagcatacttccagatgtattggagctccaatgtatgttatttgttgcttttctctggctgctttaagaccctttttttccttgacctttaggagttagagtattaaaagctttgagattagtcttctttgggttaaatctgcttggggttgtataaccttcttgtacttggatattgatatatttctctacatttgagatgttgtattttattatcactttgaataaacttgctatccctatcctttttctacctcctctttaagtccagtagctcttatatttacccttttgaggctattttctagatcctgtcggtgtgcttcattgtttcttcatttttcttttttctcctctgaatgtgtattttcaaatagcttgtcttcaaagtcactaattttttcttcttcttgatcaattctgctattaaagactctgatgcactcttcattatgtcaattgcattatttaacttctccagaatttatgcctgattctttgcaattattttagtcagctttttaaatttatctgatagaattctgcatttctgccctccgttatgttgaattactttgagtactttgtgttccctcaaaacagctattttgaattctctgtctgaaaggtcacatatttctattttccccaaattcatttctggtgcctcatttagcttattttgtgagatcatatagtcctgaataatctggatgcttttggatgtttatctgtgtctggctatttaagagataggtatttattttcatcttcacactctgtgcttagttgtacccaacattcttgggaaagctctcaacatattcaaaaatacttgattgttgtaatcttagctgcatgtgcattagggggaaccccaaatccagtaaagctgtggttcttgcagacttattgaagtaccacctgaaggtcttagatgaaattcttaagaattatctggattatgaggcagagactcttgttctcttcccttatattctcccaaataaatgaagtctctctctctctctctctgtctctccattctgagctacctggatctggtggtggggtgttacaagcacccctatgggcaccacaactgagactgtgctgggttagacccaaagccaacacagcactgggtcttgcccaaggcctgctataaccatgacctggctacggcctatgttcactcaaggctctacaatcagcagctggtgaagccaccagacttgtattcttatcttcagggcagtgaatttcccaatgccatggtggttccagagatgacatctggaaaccagggactatagttaaaaaaaaacaaaaacaaaaaaccaaaaaaaaaaccttagaaatctacatggtgttctgttgcagagtggctgagttggcactcaacccatgagatacagttcttttctctcttccctcccctttccacaggcagaggagcctcgccccatatctatccccaccacaggcctatggggattactgccaggataccaccaatattcgctttaagcccaagggctcttcagcaagattgaggtgaatgttgcctggcctatgactcacctttcagggaagtgggctcctctctggcccagagcaggctttgtgatgccatccaagaggcaagtcctgaaatcagggatccaaaggcctcacttggtgtgctatccctttgtggcctagctgaaatctaaggtgtgagacaaaattttctttactttcccctatgttttttttcaagcagatgaagtctcttccaatagccactatagctgggaatgtgctgtagcagaagcaaggaatcaccagaagtaaaagtctcaaagtcttacccaaggaccatggcatgtaccacctgggtatcactgcttgttattcagtgcccatgaactctttagtcagcaggtgatgggcccttcccttcaaggcagtgggtttccttttggcccagggtgtgtgtagaaatgttgtctaggatctgtcacctgaaaatgggacctcacaacactgactggttccctattttactgttgcttagctggtattcaagaggcaagaaaaagtcctcttacccttctctctcctcaagcaaaataaaggggtttcttttgaggtcatgagctgcacttcatgagttgggcatggatgacacaactactctgttagcaaccccagctggtatctcagtaggtcactcgctccccaaatctactggctctgagcctagttcagcactaggactcacctaggacttgcagtccttatggcctagactgtccttcaaattcacatagggccccagagcagcttagctcgaggtggtgaggcttgtcaaatttcaagtgtcaactacttcaagtggaaaattactctcagagtagggttggtttaaatattccagccatgttttggcatcagctgagttcagttgggttttgctttctgctctgacaaggcagcactgagttcaaagcagtgtctcacaattgctgcactctcactctcccaagcacagagattctgtctctgcaccatgcagctgttgttgtaggatgggagggtggtgacatttgtgattcagcacttcttttctaaccttcttagtgcctcttttagtgatatgaagttaaaaccaggtactttatgtgctcacctgttttgtggttcttacgaaggtgcttctttttgtgtgtagatagttgttaaatttgcatccttgttggagggatgatcagtggagccttctttttggccatgttgctctgcctttctccaaaccttttttctttataaattactcaagcctcaggtgtttctttatggcaatactatgcagactaagacaaaataatccacatttattacactatttaatttcttttctgtttactttactaaaattattacaggtgtttttttaatggttttacccttttatatacccttcagcaaatttctctagtattttattgaatgcaagattgatctctaagagtatgtgatttttttatacctctttcttcttatattgcatctcacaactgctcaaatcagtaatccttctgacaaactttgccgtaaaatgtatgtattctcaattgcaacaataaaacatacgctttggaaagtatttggcaacacactgagaagggttttcacaaacatgactagttaagagtctatgtcttatggaattcaacatagtcttttcattgtagaggtcctgtgtttactaaggtatctaagagcaccaaatgtgctattttccattttgtgtgcctggtcagtcatagaagtataaccatgttaaaaagattagaaacattggaatgtctctgagagtacttgaggataaaccataaatagaaggctttttacctggatacagttacctagataatcccagggaaaagagctcattgtaaattcatagaaaaaatgtagttttatgtaactatgcttgtcagcacactaatttctcttgtcaaattcagcaagattgccccttatagcatgctgtagttacctggcattagtatgcctatgatttgaaaaattattttccctgaatatttttcctggcttactcaaatgaaagacttgtgagtgaagtaacaaattattaataatacatgccataaagtaaaacatattctttttcagatctcgatttattaatcaagaataaatgaatgcatctgaattattttaaaaaaacctaaaattatacagattgtactcaaattgagtattttcaatattctattcaaaatataatgaaaggcatcactcttcacattaacctatacatttatgaggaagcagtcaggttctcatatgaaatatttaacattgtatcttgtatgaattaaaatgaaaagtatgtcttatatattagaaattttgcatcaagttcagactggagagtcagctgctttggccttataagatagacctcaaggggtcagattccaaagcttgtcattctctactacctcagccaagcttcaatcagtgttgctataattatgtgatagcattccatattaagtactatttattacctcttgttgattctcaatgactgcttgacaactggccttctttaagtgttacacataaaaaattgagattttgatttaatctataatgcttatgagagcgtaccaggcttgtgccatgctaaattagggtgtaaaaatctagggttagaggtaacccacttttataatgtccagtatttattttgctctagaccctcagtctataaaaatgtatattccaaatgcatcttaattgagtttgtactgttattggttaattacttaatttgttttagtttcaaaattagttgaatcccactataccaaagataaagacaaaattgggattataaacttcttgttttatagtaaaataatgggttgctgtggagattaaattatttggggcatgcaaatcatagtgctttacaaacagtaatggtggctggtgcacttctaaatataattcgctcatctacatttatacaaaactgttctgccttgctttaaaagttctaccataggtgccttaaaatacatgcttatactgtttcttccaggatagaaaacccatttctgtaagggttctatgtctgttgtcttacttttttttttccaaatttgtaaacaattcttcctttcacaaccagttctgaaacccacaaaagtcttacaatgtcattcaagatgagaaaatatcttggaatggacaggctcacttctatacttgaagaagttgttggagtacctgtaggcagagtcttccactactctgactgatagacaagtttgcactccatcatgtatgttctaagtactcagcctctctagaggttttcaatcccaattattactttttctactagataagagagtttttgagagagacactgggttgacgacagggaattgattgaaagtatgaatattaatgagtaaatttcccattcaatctatcctaaaaaataagtactgcctccacatctggaagtgctagcttccaaatatgatacattgttccagttaaagaaaactgagctatcttagagtgaaattttctgagttcttgcatttgaacattcatcaacataatgaccaaatctctaatcaaaggtctccctaagcttacatgtaagcaagctcgattgacttatacagagcttcttaacagtttttagttcctcattcttaactatgaacatatattctgacttttgagaaaaattggaatacaaaatgtcaataaaacaacaacaataatatgaatcattgatggaaaatttctggagatgtcaataggattctcactgaacagttatcagagtactgatcagttcatgcttgggaggaaactactcaaggcaaaagaactgcccaataatatgaataaaacaatttatccaacccaaagaaagtaacagatatttgattttttgtctaaaaacaaacaataacttgaaaaatatatgaaaataacacttttcaaaacattggagctcaggcaatgcatgacaataattccccaggttaccaccttctgagagtttcccagatgcagctcagagacagggaagccaggggaagcccagcagactctcacagttgaggagatatgcctgtaagtccagagagagcaaggtggctacagtttacaaggtagagtaacttagaggaaaggcctacacagagaaaacacttagaaaatcacaataggatcatcactgagtattcatcagagtactgtgaagttgatgcgtgggagaaaactactcaagacaaaagaattgctcaaaggaattagaggatagaatacttggagctcagacaaggcctagaacaatgcctattcttaccagctgcacaggtcaatgtcataattcacggagcattaggtaaagtgttttttttgtttgtttgttttttagacagagtttcgctcttgtcacccaggctggagtgcaatggcacgatcttggctcactgcaacctccacctcccgggttcaagtggttcttctgcctcagcctcccaagtagctgggattacaggcgcccgtcaccatgccagactaatttttttgtatttttagtagagaaggggtttcaccatgttggccaggctggtcttgaactcctgaactcaagtgatccacccgcctcggcctcccaaagtgctgggattacaggcgtgagccactgcgcctggtcaggtaaagtatttttagaagtctttcctttggattagagataataagccttgcataaaatgttgtttaggtcccacctaacaaaccttaaaaagcatggataaagctgtttatgaaataaaactgcatcccagaataaagcttgagaagaattatagaatagaaaaatcaccaccacatcaagcaagtggaaggattgaatattatgtagagacaagaaaaatattcaaaaagacacaaatcaaatctgaaaaattaaagaatacaatgtctcagatgatattctggatgaatggcagatcagacattacagaagaaaagataattgaacttaaagtcttatcagcaactatcataaatgaaactggaaaaaaaggaataaaaaatgtgaactgggagaaaactttaacctaggaaacatgttaagtggacccccaaagttggagagtggggacagagagaacatttgaagaaaaatatttgaaatatggtcatgacaagccatatgtttctgtcaagaactgtaaagggtctgaaattttactcaaacttgttaggtgagcacaattttgggccagctgaatgggaagaagacttgagactcctggatcagcaaccaagaacagtttattattcacaacaacaacagtagttagagtgtcaccattttttgcactgctttcttgagccccagttctcacagggtgatgcaatagaaagccagttaatatctcctcttacaggagagaaatcttgagtttatgaaactaacaccttttataatgggttctctatatgtcttccttttgctccggagggaaacagtctcaatctttcaaggctgttctctacacacatccttgaaatgttagtttggaaaaagggacacttagtacctcattcacaagacatgcagaaactcaaaaggtagtacctcattcacaagacatgcagaaactcaaaagatctattgaaaattatctcccaaaattactatctaaatttaataaaatttgaaaagtcagttccttaggtgcatgaatcaccttttaagagttcaatagtcacatatggctagaaactgtcatattgacagtgaagatatggaacatttccattactgaagaaaatactatcatatagaatggttgtacatcatataatagcaataataaggtgtaataataatagtagccctataaattatgggttattatctgcactttacagatgaagaaactatgccttaagaaagtaaagcaacttactaagttaatatgtctagcaggtgtcagagtttggactgcattaaactaatttcttatactgctttctataatgcctgtggcagattgtatgttcaagtaatgactgcaacaatatttatgatcccacatgctcttctagatccttgctactatcctgtcaagaagtggagcctagggctgggcgcggtggctcacacctctaatcccagcactttgggaggttgaggcgggtggatcatgaggtcaggagttcgaggccagcctgcccagcatagtgaaaccccgtctctactaaaaatacaaaaacttagctggtggtgcgcacttgtaattccagctactcaggaggctgaggcaggagaatcacttgaacccaggaggcagaggttacagtgtccttgaacttgggtgggcctttgttactgccccaatggaagtgatattacatacagtgtaaatgatgatatgtaaggttaactgtatccttgaaaagatgtcatatctttaacaagatgatagagcttctacatggctcccttttgggacaatagctcctggaagtcagttgccaggctatgaggaatcccaggtcacatatttatatcttttagctgaggccattattgagttcccaggcagcagccagaattaactcatacacatgaattacgaagccttctaaatgtctccagccccagtcacctttggattttagcccgggagatccacaaaaataattatcgacctgatctaatcctaacttatatttcaaatcataaatagtaataataaaaataagtttgtttcatgttattaagcttgggatgattccttatgcagcaataaatcattgaaacaatgtatcttcaaaccaattatttaaaaacctttttttcagccaatgaatcaatatttgtttgctttattcactggtgcattcaacaaatgaatatatacgtgggtaatttcttgtatagcctgtgtcacattttgtagaactagaattaaaaagaaaaagtcaatttatggcttatatgaaaaaatatacatatttaaaaaagaaattttatctaagcaaaattgtttctcaagtagctctgtacattttttatgtattgtcatatttgggtttcataccctagacttctgtctttcatttatttattctggttgataggtaagttgccttatctgcattatttctaaagatgtgaaaaattattatgatttttaaatgttaaagtaaacatacctcatacttttcactaaaatgcaaaatattgtaataaaataaatgacaaatttttcaaagaaacatgaagcatagtcaataaaacatacaactttattaaatctctatgttctagaatcaatttttgcattgacgtatattcataagacacctagaaaataccttgttaattttcatagatttaaacatttcacaggtttaattttagtaagctgacaattttctagaggatatttttatttgcaaatacaaattatttacagttaaactttgaaattggatattctttccaacttgatcaattcttaaagaactgagaaaagtctcaaaataaaatgggttagaaatagtttatatgttattgctttaaaatcatttcaagtagttataatgcactttcacagaaacatcattttgcctgaagcatacaggagggacacggaatcaggaacgaacagaatggaggcccctggagctatgtttatagatccttgctcatttattgtgcaatttattcactatagcttaagggacaagcaagcattcatcacccactgctcccatcattttcaaggctgttcagtagataacacaaatgctaagcaaacaagtcttttgatccatttcaatctacttctgatttttcttttaggtaacaaaagtttattgatttgactctatctatgtgtttctatctctatgtctacatctaaaatttttccatctgtgtctctatttacacataaaattggaaaaaacaccacccttggagtattctctgaacagggacagaaagtaaaattgtttggtacaaaagggattcccatctaagagtttaatatgtgtggagtcttaaatagacaaaggagttaggctggtgagagatgggaaaaacaaaaagaaaaaaacagataagctctaagtacgcctttcttcacggttcaggtcatatagacctcctgtgcaaacaactgacaatcttcctgagcccaactatcattagacacctacaagttaggtcaccgcaaccttagcatttttagtactgcacaaagccctcttcagcagacagcataaacactattttataaaatttccaccgagcctttgtttcccggcagtcagtttctgctggccttcccattgcctccttgcaaactattttcctaataatttttctaataaatctgcctttctttacctacaactgtcttggcaaattcttctatccccatgccaccggcccagatagttgtcgttcacctgtaatattttggtggcccattaggggactttcttttcacggggaactctctcccctgtctctttccctttcccaacttgggaccctcagcagacagcgtctaagcatgagccaattgcaggtcactgattggagctacacacaggtgggaccaaaaggtgtctatgtggaagtgtctgaccaccatcacccgttttggtcaaaggacctgagtttacttatttttttctgtcttcagcagccagtttcttgcatccctctggcaattaaacctgttttccttatatattacccagtctcaggtatttctttacagcagcatgagaacggactaatacagtaagatgatacagcagagagtgggatactgctataaagggactgaaaaatgtggaagtaactttggaactgggtaacaggcagaggttggaagagtttggagggctcagaagaagacagggagatgtgggaaaatttggaacttcctagagacttgttgaatggttttgatcaaaatgctgatagtgatatggacaatgaagtccaggctgaggtggtttcagatggagatgaggaacttgttggaaactggaataaaggtgactcttgctatgctttatcaaagagactggtggcatttttttgcctctgccttagagatctgtggaactttgaacttgagagagatgatttagggtatctaacagaagacatttttaagtggcaaagtgttcaagaggaagctgagcataaaagtttggaaaatttgtagcctgaccatgcaatagaaaagaaaaatccatttttatggggagaaattcaagcaggccacagaatttgtataagtaacgagaagctgaacattatttcccaagctaatgggaaaaatgtctccagggcgtgtcagagacctccatgccagccctctcccatcaaaggcccagaggcctaggaggaatacatggtttcatgggcctggcccagtgcccccctgctctatgcagccttgagacatggtgccctgcgtatcagctgcttcagcttcaggtgattgtaattacctgaggcctccccagccatgctgaactctgagtcaaaaaacctcttttctttataagttacccagtctctggtatgtctttattagcagtgtgacaacagactaatacagagggctctgattgtctcacagctgtatgtagtagaggatcttcacttagtgcctgagtggctttgactctggagaggcggacccatggagagacacctcggagatttacagccattggggtggtaggaagaactcgatatggcccagtccagatggattctaaaggcctttcctcctatgcgagagttttaagatacacccagtcctcaggcatcagtttaggctgtgtgttctctggaaaagagggattgggttttagactatgaagattttggtaatggttaatggttttgatggtttgtcctaagagatatcacatgctgtgtgaaataatgactttctggatctaacaagaggtctgtttgtaagaagggccttccataaagaacttcaaatgggctgagatgggtttctgaatttggggtaatgcaagaccttaagagggcaatagggagcacagcgggccgtgactgttcagtttcctgtattagctttgtgagatgcctttttatggtttgattagctttttctacttttccagaggattgtggataccagaatgcaagcaagttgtatttcatttgaagggccttagcaacttcttgttttgagaaatgaaggcagggccattgtcttacggaatgagtaagggagcccaacacagggaagaatgtggtccaaaagggccgtggtggcttctaatgcctgttcagttttggtgggaaaggcctctatccccccaagtatctacaaagactagcaagtatttaagttccttgcattggaggcatgtgtgtaaaatctagctgccaatcttctcctggtagggtccctcatcttcgaatggagtagaggagaggaggagatttgtgggtcccttcaggattcattttcgcagcatgtggcacaagcctgcaagatggctcactgaagattgggttattcctttaccaataaacagtggacttactaagttttggagggctttggcccccacattagttgatttgtgttaagctttttaaatgtttccattgtgaagctcctggaacgaaagtctgccgttagagctttttagccagctttctgaggtatgagagaagcctttcactagagccctttgggtttctttctgtgaatagcgtgagacaggagagtggggttaggaaccaaaactgcctgaaggggcagcctggcagctgcttttgcttagtcatcagctcacttgttcccaattgagatttcatcactgcttccctgatgggctctgcagtgaatgatagctacctgtgcaaaaagcaaaattgtctctaacagaatcatgattacaggagcatgtctaatcggagaagtttggtctgttgagagtttcctttttcaccaaatggctgcatgggcatgtactacatgaatgcataggctgagtctgtgtaaatattaaatctcatgcctggtcctaattgtaaggcttgagtaagggcaataagttctgccttctgggctgaggtggtgctgcctggtacgggccttgattctataacttcagtaaggctaacaattgcataccctgataactggctaccttccaacatgaaactactgctgtctgtgaaccaagtggcctctagattggtaaggggggtgtcttggaggtctgttctggtgctacaagttaaatcaatagtttgtaagcaggagtgtttaagtggtccatctgcatttggagatggtaacagggtggcaggattaagaaactgacgtggcttaatgtttaattatggtgtttgcagtactgattgatatctgctaattccactattagagacccagtgaaagggctttgaggttaaaatatttgttacattgtgtggtgtatatattattatttcttggcccagagttagcttggagacccccctcaactaatagggtcacagatgctagtgcatggaggaatggaggccagccctgtgccaaccaatcagggttctctgataactgattggtcattggaagggatccaatggctgggttaggaccattttcagggtacagccctactcctggctgctttcatgggctggcattgagtgtctgcagcttttccaggcacatggtgcaagttgttggtggatctatcattccggggtctggagaacagtggccctcttctcagagctccactaggcagtgtcccagtgggtactctgtgtaggggcttctaccccacattttccttttatactaacgtggcagaggttctccatgagggctctggccctgcagcaaacttctgcctgaatatccaggcctttccatacgtactctgaaatctaggcagaggtttcttaacctcaattcttgacttgtatgcacccacaggcccaacaccatgtgaaagctgccaagggttgggtcttacactctctgaagcaatggcctgagctgtctgttggccccttatagccatgcctggagtggctgggatgtagggcaccaagtcccaaggctgcatacagtagtgggtccctggacctggcccaggaaaccacttttccttcctaggccttggagtctgtgatggcaggggctgttgtgatggtctctgacatgccctggagacatttaccccattgtcttggtgattaacatccagctcctcattacttatgcaaatttctgcagtgggcttgaatttctcttcagaaaatgggattttctttcctatcccatgatcaggctgcaaattttccaaacttttattctctgcttcctcttgaatcctttgctgcttagaaatttctttggccagataccctaaatcatgtctcacaaattcaatgttccacagatctctggggcaggagcaaaatgccaccagtctctttgcatagcaacagtgacctttactccagttcccaacaagtttcccatctcgctctaaaaccacctcagcctggactttattgtccatattattatcagcattttgatcaaagccatttatcaagtctctaggaagttctaaactttcccacatcttcctgtcttcttctgagacctccaaattgtttcaacctctgcctgtttcccagttccgaagttgcttccacatttttggatatctttataggagcactccactcctggtaccaatttcctgtattagtccattctcatgctgctaacaaagacatatctgatagtgggtaatttataaagaaaagaggtttaactgactcaccattctgcattcggcctcaggaaacttacaattatggtggaaggggaagcaaacacatccttcttcacatggtggcagggagaagaagactgagtgcccagtgcagggggaagccccttataaaaccatcagatctcctgagagcaggatgggagaaaccgcctgcatgattcatttgtcttcacctggtcccacccatgatatatggggatttggggaactataattcaaaatgggatttggggaactataattcaaaatgagatttgggtgaggacacagacaaatcagcctctatctattgtttagacaaactcagactctgagttggattcaggtaatactaaccctaattttcaactctagcttcaaggagtttctttttccttactcccttaactttccttaaaaatcaatgaaatctacttttttcctggcttctttacttaattacagctgtaaactgcatcctggtcattactttcattgttctgcacttcaactgcctttttacatctggatgcaataatattctcctttctccttgaacttcactctttaagaataagcatgccaatgactcaaccaccataacatagtctggctactgtagctaacaattaaagctattactgagtcctctgaaatttctggtggggatcccagatagttaatctatttattaaattagcaaacagatactcatcaaggcagtttgcactctatcaagcacataaaaacatgcaagcgctggtggactcaaggcagtaataccaactttgagatttgggtttatctaatcagccatataatttaatgtcacaaaatcaataccacatactataggaaaaatagcataaaattttcagtaaaaacttccttcacttggattttctgaagagataaccaattagaacaatttctaaaaaccagatgcctaaacaatattttatccttgatgaccttgtttgtaactgtgctttctaaattaccaatcaccaaaggaaggaggcatgaacttcaaggttataatttacagagatcccaaaaacatcatttaataccagggcttcctgctttcccaagaaatctagaatattttgatctctcttgaagttgacggaaattagcccaatggctttttaaaactttattcttagagctaactctttttactcaattctattacaggctcacagtaattatccaactgcttcacttaaacagcttcatcctcttgacattaatactattataagggaagtaggatatggttgctatttgcagggggatttccaagattaccacccagataaaatttctttatatttgtcctagtaatctcatatacctccatgccacaaccacaatataccaaggtactaggtgtttgtttgtttttcttatactctgtacagtccttctcctttcctgtctccctgaattcactatatattgtcacctttaacatgtcaggcttcatcctagttacttggatatctctccaattagcattaacacttacaatgaaccttactctgccaagtcttgtggattacactgtacttgaagggactcacaagctattaaggaaacaacattctctgtgtgccaaggattgttggttttgtttactattagtccctgaaaggtatgattccacattccctatttatgctcagaatttcatcccttttaacaccaccttgtatcccaaattcctgttttcccactcccacaggaccctaaaaagcatacataaggcatggtagcttcattctctgcctatttaagtcaatacacaaccaagctaaaaacataaaccctctcaaaggactggttccctgacccaagagaaaatcccctgttgtaggccccctttttaaacaagtccaattcaaacattaagcttttttttttaagcaacagaaaacaaacattacttcaaccctgttggtaatgttcctaaacccctttgcaactacactgtaactataaattgtaccaatagaaaatatgtatcaggggaaaatataatttggtaccagttagaatatcaggcctagccaacctcaatgccccaaatctccaaactataaactatcacttctgtacagtgaggccctctccagacacttgtcctgatgtaactccatggcaaaatggcaaggttatgaattcccctaacaattgcctacaaattctcatgttcagcaaccccaaatctcagatttttctagactctcaatgctttcagttattctgggaaaacaaaatccacccaaatgcaaactataatatccaagccttacagcctcttacaactgctactctagctacctcatacttgttcttcaggtcagaaggccaaaacacacttcgtttcttcactctaagtttaatatcttgccttaaatctgaggaagcattcttcctccataaacaaatgcatgtatttgtcttccagccaactgaactagaacttgtacactagtttacttagccctagacatccaaattgctccttccaatcaattccttccaatcccactttatagttctagcagagaaaactgagcaatccatctgattgccctgttcattggcctagggattgccattgggttaagcatgggaataataggtatgagcctcacagcccatacttattataccctctcaatggaacaccccaccaagctcaaacatatctcggacacccaggaagtcctccaaaatcaggccaacttcatagcacaaattgttctccaaaatggctgtggcataaatctgcttacaggagcccaatggggtatttgtttagtccttgaataggaatgttgtgtttatgttaatcagtcgggaatagtgcagaaccatgtccaaaaaaaaaaaaaaaaaaaaaaaaccatgtcaagctgctgaaatagaaaaaaaaaaaaaaagcatcacaagaatagtcttcatggatatctactttgggatggttctcctggttcctctcctttttggggccacaaacaggtattttattcttccttcttttcagtccttgtatcttcaacttacttgtcaaattttctagatcttgtgggcatgcttcaatctctttattcttttttctttagtctcctttgtgtactttcaaatagcctgtcttcaagctcattaattctttctttgcttgatccgttctgctaagagattctgatgcattcttcagtatgtcaattccatctttcaactccataatttctgtttgattttttaaatttatttcaatgtctttgttaaatttatctgatattattctaaatttcttctctttgttattatgaatgagtttcttaaaaacagctattttgatttctgtgtctgaaacaacacgtgcatccatttctctggcattgtttcctggtgctttatttagtttattttgtgaacttattgtttcccggatagccttgatgcctgtgggtgttaactgttgtctgtgcatcgagtagttatgtgtccgaaattggtgggttcttggtctcactgacttcaagaatgaagccgcagaccctcgtggtgagtgttacagttcttaaagatgtgtgtccggagtttgttccttctgatgttcggacgtgttcggagtttattccttctggtgggttcgtggtctcgctggattcaggagtgaagctgcggaccttcgcggtgagggttacagctcttaaggtggcacgtctggagttgttcgttcctcctgtccggagttgttcattcctcccggtgggtttgtggtctcgctggcctcaggagtgaagctgcagaccttcatggtgagtgttatagctcataaaggcagcgtggacccaaagagtgagcaacagcaagatttattgcaaagagcgaaagaacaaagcttccacaatgtggaaggggacccaagtggatagccactgctggatccagcagcctgcttttattctcttatgtggccccacccacaacctgctgattggtcaattttacagagagctgattggtccattttgacagggtgctgattggtgtgtttacaatccctgagctagacacagcgtgctgattggtgtgtttacaatccctgagctagacacagcgtgctgattggtgcatttacaatcctttagctagacataaaagttttccaagtccccactagattatctagacacagagcactgactggtacgtttacaaaccttgagctagacacagagtgctgattggtgtatttacaatcctttagctagacataaaagttctccatgcccccacccgactcaggagcccagctggcttcgcctagtggatcccgcaccagggccacgggtggagctgcccgccattcccatgccatgcacctgcattcctcagcccttgggtggttgatgggactgggtgctgcagagcaggggggtggtgcccatcagggaggctcgggccgtggggcagcccaccatgggggggctcgggcatggcgggctgcaggtcctgagccatgccccgcggggagatggctgaggcccggcgagaattcaagtgcagcgtggatgggccggcagtgctggggaacccggtgcccctccacagctgctggcccgggtgctaagcccctcactgcctggagcagcagcactggctggccactctgagtgtggggcccaccgagcccacgctcacccagaactcacgctggcccgcaagtgtcgctcccagtttcccgcccgtgcctctccctccacacctccccgcaagcagagggagccagctccagcctctgccagcccagagaggggctcccacagtacagaggcaggctgaagggctcctcaagcatggccagagtggatgccgaggccaaggaggcgctgagagcgagcgagggccgtcagcacattgtcacctctcagttaggtatttactgtagtattctcagtatgtgcttgtttgtgccgtccctcttgggaagggtttcaagacattcaaacagacttgaatgttgtaatctaaaccatatgtacattaaggggaacaccaaattcagtaatgctgtggttcttacagattcatggaggtaccacttcttggactaggatataatctggaagaattctctggacttctcgagagaatcttgtttattttcctttcttactttcaaacaaatggaatctctctttctatatgttgagccacctgtagctgggtgtggggtgacacaagcacccccatggccaccaccactgggactgttctgggtcagacctgaagccagcacagcactgggttttagcaaagacctgttgtaactactacctgcttaccacctatgttcattcaaggtcctgaggctttaaaattagcagctgctgaagccagccagacttgtgtctttcctttcagggaaaacagtgagttcttctaggccctgggcaggtccagagatgctgtctcagagccagggactggagccaaaaacttaggaatctacctggtactctgttctactgtggctaaactagcactcaaaccacaagacaaagtccttccgactctcctctcccctttccatagttagaggagtctcaccccatggccaccattaccacagacccttggagagtactgtcaggttaccgttgatgtttccataaattccaagagttcctcagtcatcttgtggtgaattctgccaggcctgggactggccttttggggcagtgggctcccctgtggcccagagcatgtatggaaagaccattcaagagccaatgctttgaatcagggatcccaagctccctcttggtgctcttctacgctatgatctagctggtatctaaaatgcaagataaattcccctttacttttccctctgcttttctcaagcaggagtctatcctcatagccaccagagctgtgaatgtgctgggtctcaccagaagcttgcacacctcagagtttcacccaaggcccatggtgtgtaaaatttggatcttgctgctggttattcaggaacaaagaccctttggtcagcaggtgatgaatagtgccaggacttggttcttcccttcaaggaagcaggttttcttctgctccagtgtgtttctagaaatgtccaggatctagggcctggaatgggagcctcactactctgcccagtgctatatcagactgtggctgagctggtattcaagttgcaagacaaagtcttctttactctttcctctcctctcctcaaggagaaggaaggcatcattttcattgctgcaagctgaactgtgaggaatttgtagaggggtagcacaagcactctcttagccaccctggttatgtctcactaggtcatgtgccacctaagcccgctatctccaagtccagctcagcactagggcttgcctagaaattacagtccttgtgacctaaactgccttttaagtttatttaagaccccagagaaattttaggccatggtgtcaaggcttgctgaaactcaagttcctatcactaggatgggtgaatctaatctcctctgcctagggctggtctaaatgctccctccatgggtagttgtcagctgagtttagcacagttttgcttttctgtgtgacagggaagcactgaattcaatgcaatttcttacagttgttgcactttgccttccccaagtgaagcggattctcatggccacacagccacggccagagtattcgggaggggtagcatcaaaaattaagactctctttcctaccgcctttagtacctctttcagtgatacgaagttaacactatgtactgtgattgcttacctgatttttggttcttatgaacgtccttttttttgtgtagataattattaaatttggtgttcctgtggagggtaaaattggtggaggtttctatttagcctccttgttctgcccctttgctagatgtttattttcatgtataagagcaaagttaagcctgccagttttgctattgtacaggcacatctttatagaaaaaaatgttgcggaagctttctttatgtgtatcatcttctagcctatgataaaccagaagtaaaagctaccttccacagcttattttcctgtttgcaaaaaggaaaggcagtggctagtgcatttcgaggttaaataaaacaattcatagtgttgattggtgtttatatagtaacctaagaaagattaattacaaagaaaaataaacaaagaaataaataatagttaattgtttaatgtatacctaacttatcactcttcattgacctacaactaataattattatttaaaacaaacaaaatagatttttaaaacctgctgctttatatgactttcatttatctaaaaacacatggtttacacagtaacactgagattcaatctttgataaatcaccgactaaggaagaaaaacttctgattcttcatgttttactttgcatataaattgcctcttgaatatttccacataaatcagaattataatttacaacccagaataaaatggactaaatatatttacttattctttctctgacagaaaagctgcctaaacagaaacaccattgaagaaaaaagagattgcagtcttctctgtttctgccatgttgaagcttggatacattgcttttgtgtcttctgtagaagaaatcatttgatttgtttatttcttttctctgcaatatgtgaaaagtaaatgttggtggtgtctagtttattttaaaaaaaatagtgcattcctcaatgcagttggaagggctaagatttaaataacattgaaaattataactgaaataaagcagaattcctgacttttctattgttcagtaagttctattgatttcctctgtgatatctttggcaggcagagtctcccttcattattctaaatttggtgaaataaaaattgtattagtttttaataaaattatgtatctgggtacagaatttctttgggtaggaactgtcaacagtgtctctacatctctatgtatctatgtatctatgtatctatctatatctatgtctatatctatctgtctatctatctatatctcccctattaattttctttttctagagaactctaattaatatagtgatgcattttggactgtgctataaaaaatattagggggcagcccatagtgtagctctatttgttgccactctggttctactcaagaaactattagacttccttctcccttcatgtggactaacagatgttttacacttccagtttatacataagtcttacttatttgaagttttcattcaactaaatgattccactgattactttctatttataataaatctgttaatcactagagggaacacagacacaagtaagatcatctagagtctcaaaatgctcagatactagctgggatgaagttggaggtggatctataaggtgggagtggaaggaaggctgataagtaaaaaaatgtaaaaataaaaaatccggatggagacaagtggcacgtaaaaatgttcaaaatgatatggaaacaaatgaagacatgattgcatctaattagagggatcaaaagtgctttcattaaagaggtggtgagatactattgcagaattttgacatgtgacattcagggtggggatataagacattctaaaaggatggagttaaatatacatggacaaagcaaaacatgaggcagaaagcacccagtatgtctgtggtgtgatgctttgtagagaatctagcagattagacaattaaaagcctgaaaatatagtttgaaacaaaatgagaagagtcttgaatagaaaattgaggaattctgagttaattttataattagctgtggagaaatgaatgtgtttgagtaggtcaatacttactgaaaggaaattatgctgatagcagggtggtataatttataagttgggaggcagaagacatggagatcagttaaaaacctcttacaatagcacatgactgagtcaatcaagcctgaatttgagtggtggcagaggaaacggagaagaataaagagtttttttgtggaaactaaaatcaatacaattcaacaactgtttggctataaggaatagtagatagggtggaatcaaagatgataaagagatctcaagcctggttagagctgttagaataaactaagtatcaggaaaatgaattaccttgagcacaaaaatgaggatttcaattttcaaaatgttgaatttgttgtgctcatgaggtagaaataatcagtgaagcagttggatgtgtaggtctcctgatctagagagatgttaggacagaagatagagatgtaagagtcatttacatagaggtgatagttgaagctatggatctagatatattttctgattaatagattctaaaacaaaatgtgaataaaatcttaagaaatatacagaagtagtagaatccatattgcgggtaagagtcatcaggacatatctagcaaacgtctaaatagctcatgcgatgggcacacaaagtgtatttgtgtgagtaaaatttgaggaaacagctcggatagagtttggcatgtccatcaaactggtgagctcttccaatagtagtcttctgtcagggaggcttaaaaaccctatgcttgatccagtaacaatacttagttaatttaggtaataataatctaagtaaaacattgtgtcctcagtatgaattttgagaagtggtaaagtctacttgttaagaatatagtttctagagccaaagtgtgtgggtttgaattcctgcctgtcacttactagctgggttactttgagcaagtatcttaacttctctgcttcttagtatcttcattattattattattattattattattattattattattattaagacagggtctggctctgtcacccaagatggagcgcagtggcgctatctcggctcactccaacctctgtctttgggctcaaaccatcctcctaccccagcctctcaaatagctgggactacaagagtgcacaaccatgcccggctaatttttgaatttttggtagagatgggaattcaccatgttgaccaggctcgtcttgaactcctgagcccaagtgatccacccgcctcggcctctcaaagtgctgggattacaggcgtgaacaaccacacctggctgtcttattatctttaaatgtataattgggaaaataatactacaccagaagttagttgtagtaatttaaaaagttaaaatacagtaagtatataagacagttcttgagacttgttaagtccttaacaaatgtttgccattattatgtttagtctcctcaccctaattcagttagattgtctgagacctatggagagatctttcaatgaatgttctttaagatatagacacacaagaataattcttaggaatttctacaacaaatggtaaaagaaataaggagttactcttcatcacactgccatgcaaacctttttagctttggcaactgaaagataactgttgtgcctagcagatcaagtagaaagactacaataaccagaaaagcaggggcatcgtatcagtggcaacagtctgttctatggtactgaagtaatgcctgctgcagtaggcagagcggcaaccattagaattagagaactactgtacttagctgaatggcagtgattattatgtagcacctaagagaataatgcagatacattgggagtggagcactcataaggttttctaaaaaattatcggggcactcattgtagggagactggagtaaaccttgtcagcaaatgtgataacaagatagtgcaatttgtgttatatatatttagcaggctgacagagtaagagaagctgcaaaaggatacagaagagtcagtcagatagaaatgaggagaatatagtattatagaaggcaaagtaagagaaattcctggaagtatggcattatcaacagggtcaaatgctgcagaaatgtcaagaagaatgaataccaacaaaggtgattggatccggaaaccggaaactcatttgtagtatctcataaggcagtttcagtagagcagtggtgtaaagagactgattgtaataagcataattataaacgggtggtgagaaagtgaagaaaattggtgtgaaatcttctctagaggaaatgtggaactatgaaaaatagacaagatagtacgttgaagaggtgataggagtttgtaaatgattttttggtttaggaagagctgagccatgtttgtagacacagaaggaaaacctgacacagggagattttaaaaattcaaggaataggggccgggcgcagtgactcacgcccttaatcccagcaccttggggggccgaggcaggtggatcacgaggtcaggagttccagaccagtctggggccaatatggtgaaaccctgcctctactaaaaatacaaaaattagctggcaatggtgtcgcgcgcctgtagtcccagctacttgggaggctgaggcagaagaaccgcttgaacctgagaggcgggggttgcagtgagccgagatcgcgtcactgcactccagtctgggcgacagagcgagtctctgtctcaaaaaaaaataaaataaataaaaaataaataaaggaatagaaagactaataaatagaatataataccaaagagagaggcaggtaaaagcttcattattttatatgtatctattctagtggaaaggaacagagtctctcaatgactagttcaagttataagcataatgtaaggagacatatgcagaaacatgtactgagactcataaaaagcccaaaagacattggtcatatttcacagagataggaatcatagcatatttctgagactatattatggactgtcaaagactattctagaaatctctgcagcaatttagaatggattttcaatttaatgttcaattattaatttaactcaggtactcttctggttttgatattttatttgtatctattcatgtcatattctatgcattgatttttttaccccattcaatatatttcttatttgagctgatattaaccagatttactatgcataactcaccataccccaatatccccaaatttgtttttttcacgaattcattttgtgtgtaagattgatgtcctacaaaattagccccaatttactcaaaatttccgtgtgcttatcattttgacccatgaactttattatttctcatggtccttcttgcctttttgcccctctttgtgcatagtttcagtcttacttccccatattaactatcccattctctttggactcctagtttaagttccttaaaacataatctgattggaccagtttatctatatttagccagaattatttatgttttgtcatctcatgggctactgattagtataggaaatggcttttcttggtcaagtgaccatttgtagtctaatctcctgttttggcgtactggttgtagagaagcataaagtgaaacatcatgtgggaagaacataatcaagaaaaaaccaggggtcacttcctccagcaggagtcttgctcgcaatcgtgcgtagaatgagctttgtcctagtaggcattatgcttggctgattgaaaacatctgtgaattaaataaattaacacagaaaacctaaatctatttctgaagtgattttgtcttttcctctttattttcatcaatagtgtcttagcttacatattattttcatctcttattaggacctttgctaacttgcctaactgtttctcatcttttcttcataataacctattgtccaaattaatttttgagttttattttaaaaaacacataatagataacataactctcctattcaatatatttaatgtcaatgaaagttagcatgttgaagtgcgatgtgtattctattcacttgacgtgtagttgtttaaaaatgttcttcaagtaatagattactgttatcatcctcctttatacacaaggatattgatactcagaaaattcaaataatctgagcagatgaataaagttagtaagcgttgcaactggaatgtaaaccaatatttattgattctgataccaattcaatatttattattttaaactctatcctacacaactttccattgtctgcagaaagaagttcaacattcctacaaattcatacatagttcttgacaattttccccaagccacatttagaggctcatttttttcctctttctctcatcatgtggctacccttcaatataatcatactaaacttcttgcagtttcataaatacaccactttaaaaatatatctcctgtttattccaaacatcctaggctggaaatgttcaaatgacaaaattcaaagttatttgtagtgtgatatttttagtactacagtaactggaaatatatatctccagatattccttgcaactacggttatgtcggctgtacgtagacagaattctagctgctctctctggccccaagatttcattcttggttactgaatcaaatattaatctaggtatggttgcaaaggcattgtataggtgtaatttaagtcttaagttaatggacattaatatatggtgattatctgagtgaacacgacccaatcaagtgagcccctcctttcttttaaaatatttatttgacaaagattgtatgcattagaagtgtacaacatgatgttttgatatatgcatatattttgcaataattgttgcaatcaaataaattaatacatctatcaacacagataggatccattaggttcccagaacatgatagtcttataactggaagtttatacactttgaccatccttcattccctccaaaccccagctcttagcacccaccattctgccctctgtttctgtaagtttgacttttttagattccacatgtatgtgagattatacaatatttttctttatgtgtctagcttattttggctagcataaagcaaaacattttgtttaaatgtagaaaagaatatcgaaaggctttgaagcaggagaaagatttaatggactcacatttctggctttgaagaggagcaggaccgtgtgcaaggactagagagtggcttctaggatttaagagtgacccctgactgacagccattaaggaaatgtggacctatgtcttacaacctcatgaagctaaattttgccaacaacctgaatgagctagaattacataggtttccaaaccatccaaacctgaactcagactgacattttgatgccagccttgtaatatgctgagcagagaaatcaactatgacatgacagatttctgaactacataaatgcgggctaaaaagtgaatgttgttttaaaccgtagtaacttgttatgtagtaatagaaagctatcatagagtcaaattaagttttactaataagttgcagttacgtaagatttgagggctgaaataaggcatagaccttccaaaataacttttgccattttctggctggcaaacaatgtatgtgaagattctgttgttcaatttccagttttagcaatgaaagtggcagttacagcaataataatggactaacattttttaatctgtttataagcatcatgagtgttgagaaaaatacaggctatcatggtggctagatttcacatctcatttcctagacagtcatgttcccagacaggacaaggtttggctgcttgttcttgtggtccaataacaagacgcagacagactgggaaagaagggagtttatttctgcaactggctacagacagaaggttggagtaactcaccagaccaactaaaagttacaaggtttttcttcagtgctcatataaattcagaccatatgcctatgtgtgagagtgcacctgcaagccaaagtgtttcaccctgtttaatctttaactaggggctgggatctgaaaaattactttagagctttggaagaattacttaatctaaagtggatcctggtacaaggtgtacaaagtgtgtaagaacttttccattatttcaatcaaactctaagttctgaggaagcccaggtggggtgttaaatgccttgttttacattctagcctttgttctaaggtgctagtttctccagttctttagtgtttaacttacacttttatcagagtaactgaagggtgttggtgaaggctgacctctctggttcctcatggcgacccggcctaccacagttgtagtaattatagtagtagtcatagcttcctaaacattctttctaatccctggatcatggcttcaataagattacattaaagctcatgttttagggccaagctttctgattccttacctttgtgattatgatgaaggtagtagtgattctgacatattttcttaggagtagtaggtattgtttctggaggtacagccttaatctttactctctaattcttgcagtaacctcataaatactaaatttattatgttcaatttcttttttttaagtgacttctattacctaaactgagccctgattgatactacagtgcttgatactagaagtaattataggcaataaaacttcaaaattggtaatctagtattggttatctggccttggcatgtataaagctatgacaatcctgttactattggaaaatgtatcactgttagttcataggacacagtggcaaatagttacggttttactgataactgtaatgaatagcaattgtgatagactgttatttttggaatgaataatctaggtttgagggttagatgtttgtttctgaccgtagtagagagtttaatgaaagaaaatgctgacttcaggcttataaagttttggcttaggatttctaccttaagtgcagtgaacctgcactggcttatggcagagataatgaaacagaaatctcagtgaccatacacaacaaggaatacaaacttcgcaaaaatagtttggaaaaatcactgaacaaatgtataatggcatctctcagcaagcaaaaatatgcaatcccttaggaataagaaaatatgatttccagaattgccaaattatgatattcaaaatgtacagttccaaacaacagcaacaataataaaattacaaagcataccaaaaaaaaaaaaaaagaaaaatgaaacacatagcccactcacaggaaaaaaattgacaaaaaccatctctgaggaagcccaaacatttgcatttatagtaaaatacgttaaataaaatgtctgaaatatgctcaaagagcaaaaggaaagcatagaaaatgaatttaaggtatttggaagaacgatgtctgaacaaacagcaaacgtcagaaaagagatagaaagagctttcagacagtggaacctatgaaggttcctggagggtggtgtattagtccattctcacactgatataaagacgtacctgaggctgggtaatttatttagaaaacaggtttaattggctcatgtttctgtggtctgtacaggcttctgttcctggggaggcctcagaaagcttataatcatggtggaaggtgaaggggaagcaggcattgttttcacatggccagagcaggagacagagagagagaagggggaggtgctacacacttttgaataaccagatctcatgagaactctatcatgagacagcactaggtggatggtgctaaacccatagaaatcaaccccataatccaatgacctgccaccaggccccaactccaacactggggatcgcaattcaacatgagatttgagtggggacacagaaccaaattatcagatggcacacctggtgagggcatgaaagctttgtactcctttccatatgctttgccatatgcatctttttataagatgctagccacagaggtgagctggcttgggtagaataaggttccaactgagccagataatttcaggtcatgaccgccacacttggccacatttgtcctgttggttgaacccagtgggcctctctgccatggccaatcttttgggatatcctttataataagatggaagatataagtaaatgtttccctgggttctgtaagctgatctagcaaattgatcgaaccaaaggagggggttacgggatctctgatttataaccagttggtaagatgtacaggtaaaacaacctggagcttgcaattggcatgtggagggggaatacagtcgtggggattgagacctcagcttgtgggatctgagactatattcaagtagacattgtcagaatagaacggaattagaggaaacctagctgatgtgaactgtagaagtgattgctagcttgttggtggagagaaatccccacacattttgtcacagaagtcttctgtgttgattgttgttgatgagagaatagaaactgcactttgagtttgtgtgtgagttttttctactctcaactgagtcagtgaaatggggtttactagaagagtcctggctcacagaaacagatggtttgggacgagaaagaataaaagggtggtgataaggaatctttgattccttaggggacatgtggtcaccatggtttggagccatggatgtgctgcaattagttactaaaggtaaaatttaccagtggaattcagagatgaacctagctcccatggacttggttctgtaaaccaaaaataaaataataaggttcccccaaccatatacatgaattactctctttggccaagggaattccaaagttaacctgagaaacttgttcaggccatgatggtaaggtgaagccagacatgactcattacaccctcctcccttttggaactactgatagaacagattctttaagtctaataagagatatttacaatctattctgtctgaagcctgctacctggaggcttcatctgcatgataaaacctttgtctctaaaaccccttatcataacccagacattcctttctatcaataatcgctcttccaaccaattgccagtcagaaaatctttgagtccgcctatgacttgaaagccctccacttccagttgtcccccctttctggaccaaaccaacgtacatcctaaatgtattgattgataacttatttctccataaaatgtgtaagaccaatttatggccagaccacccttggacacatgttctcaggacctcctgagggctgtgtcacaggcctttggttactcatatttggctcagaataaatctcctcagagattttacaaatattaaattttttcacaacagttcactagatgcattaaaaaatacaacctattagttaaaaaaaaaaaaagcaaaacattcaagcccttggttgttatctgtgaaagctgaaatgaaactaaaagagagtactgagtaagacctttattctatcacaagcacagatttcagtgagtctgagctttagccactagcctctaagctgatgcccaaggtaaaaattatgcagggacaacagacagtacttctaagacctgtggttactaagaaggtagtcaatgtgggggaagggaaaaaccaagtaatgattggaaccagtgggtatagtgtgaaaaaaaattgtttcattttgtaaatctgtatcatcaaatttctgagaagcctttactaaaatggattgtgagagtgtaactggccagtgggtttttcttgtctgttgcccagagtgagcaaatttatcaagacagggaaatgccaatagagaaagagtttaactcacgcagagctggccgaacaggagactggagtgttattattactcaaatcagtctccctgaaagttcagagactgagtttattttaagaataacttggggggtagcggagagtaagtggggagtgctgatttgttgggtcagagataaagtcatagggaatcaaggctgtcttctcgtgctgagtcagattctggattgtggccacaagaccagatgagccagtttattgatctgggttgtgccagctgacctattgaggacagggtctgcaaaatatctcaagcactgatcttgggttttacaatagtgatgttatctccaggagcaattttgggaggttcctcatcttgcagccagaagctgcatgacttctcaaccataatttctaattgtgtagctaatttgctagccctgcaaagcagtctagtccccagccaggaagggagtttgttttggaaaataagctgttatcatctttgtttgaaagttaaactatagactcagttttcccaaagttagttcagcctatgcccagcccaggaatggacaaggacagcttagagacaacaagcaagatggagtcagttaggtcagatctctttcactgtcataattttctcagttataattttttcaaaggcagtttcactggggacctaaagcttttttacacaagaggggataaaatgatctgggggtggagaagagaagttcctaggactagaatataaaaatgtgaaggttgatataattataaaggttggaatgccttaacaggttttatgtaaagaagtcgtgtctcctttagctaaacattttatgaaactggatattatatctgagtggggaacacttttcctacctaatatcataaaacaaaaaccaattgataaagttctaatggaggttacaggtgggaaagtaagagttgataaaatgaaaagtttataggcgagtttgtacatgtgaacatgatttatatgaagtggtaatgtctcctttacttgattgtataatgagcatggacattgtatctgaatgggaaatctcctacccagttgtgtaaaatagaagaaatataaatatgccaatttagcaatattaattggacatcatgttaaacagaaatcagcaagattttctgagcccacacaatgtagaatagaagctggagttctggtaggaataaactctccctttaatagccctctgtgcagtgagagaaaagaaaaatagctcagagcaatctgaactgtgtgaggtatgcagaaccaagagaaaatgagtacaggattttagtcatctccctctgctcacacttatgcctggagaaaatttttaaaagtcattttgtttctgaatagctgtctcacccattatttttatgttcctggaattcgtgataaaaagaacaatgtatagctgatcaatagcttatgtaattttaatgtaaattccggggaaacaactcagaaactgactcttcttttctttacaaatccacctgtaactgctgccaattgaagttgtcctgccatattcaggacaatatgaatctatgctctcagggtgcaaattctcaattttggacccaataaaatctctacttttgttaattttgccccagcttcttccatttaggtcaacaagtgttagcagaggtagagcttatggcaaaagcgggtgagtgcctctctgtgatgattacctggaagtttggattaaaatctttttacttgcaggacatttggtgctttactatgggacattaagtgaagctaccctttatgactgaaatgaagctccccttcattttataaacctcgaataccaaactatcttgggtgatatcagagaaatactctaacatagtagcagtggccagaagagtttcataataaaactgaaattgtttatacagaatcttgctacctggggaatccaaaaagaagatactcttgagcaggaaacctctttttccctagaaatgactaagaaactctgtccaaagctgctggattctatcaaaagtttgaaagtgccctataaacaaccctcttctgactaacaaagagctgcttgggatgtaaatgacaattctgaggtaaacagctgacatcctatttggaaggatgccagtctgattaaagaaggtaatgcccacttgctcactgctagcgcagcagtctgagatcgacctgctaggcagcagcctggcagggaaggggcgtccgccatggctgaggcttgagtagataaacaaatgagacttgagtaggtaaacaaagcctctggagaagctcaaactggacggaccccacctctggggacagggcatagctaaacacaaggcagcaaaaacatctgcagacttaaacgtccccgtctgatagctctgaaaagagttggggttctcccagcatggtatttgagttctgagaatggacagactgcctcctcaagtgggtccctcacgcccaagtagcctaactgggagacacctcccagtagggaccgactgacaactcatacaagccggtgcccttctgggacaaagcttctagaggaaggatcagccagcaatatttgctgttctgcagcctccactggtgatacccaggcaaacagtgtctggagtggacctccagcaaactccaacagacctgcagctgagcgacctgactgttacaaggaaaactaacaaacagaagggaatagcataaacatcaacaaaaaggacatccacaccaaaaccccatctataggtcaccagcatcatcatcaaagtccaaaggtagataaatccacaaagattgggagaaaccagagcagaaaagctgaaaattctaaaaaccacagcgcctcttctcctccaaaggatcgcagctcctcaccagcaatggaacaaacctggatggagaatgacttcaacaagctgacaaaagtaggcttcagaaggtcagtaataacaaacttctccgagctaaaggaggatgtttgaaaccattgcaaggaagctaaaaaccttgaaaaaagattggacgaatggttacctagaataaacagtatagagaagaccttaaatgacctgatggagctgaaaaccatggcatgagaactatgtgacacaggcacaagcttcagtagccgattcgatcaagtggaagaaagcgtatcagtgattgaagatcaaatgaatgaaatgaagcgagaagagaagtttagagaaaaaaagggtaaaaataaacgagcaaagcctccaagacatatgggactatgtgaaaagaccaaatctatgtttgattggtgtacctgaagtaacgggcagaatggaaccaagttagaaaacactcctcagaatattatccaggagaacttccccagtctagcaatgcaggccaacattcaagttcaggaaatacagagaacaccacaaagatactcctcgtgaagagcaaacccaagacacataattgttagattcaccaaggttgaaatgaaggaaaaaatgttaagggcagccagagagaaaggtggggtcacccacaaagggaagcccatcagaccaacagcggatctcttggcacaaactctacaagccagaagatagtggggggccaatattcaacattcttaaagaaaagaattttcaacacagaatttcatatccagccaaactaagcttcataaatgaaggagaaataaaatcctttacagaaaagcaaaggctgagagattttgtcaccaccaggcctgccttacaagagctcctgaaagaagcaataaacatggaaagtaacaaccagtaccagccactgcaaaaacataccaaattgtaaagaccattgatgctaggaagaaactgcattaactaatgggcaaaataaccagctaacatcataatgacaggatcaaattcacacataaccatattaatcttaaatgtaaatgggctaaatgccccaattaaaagacacagactggcaaattgggtaaagagtcaagacccatcactgtgctgtattcaggagacccatctcacatgcagagaaacacataggctcaaaataaagggatggagaaagagttaccaagcaaatggaaagcaaaaaaaaaaaaaaaaaaaaaaaaaaaaaaaagcaggggatgcaatccatctctgataatatagactttaaaccaacaaagatcaaaagagacaaacaaggctattacataatggtaaagggatcaattcaacaagaagagctaactatcctaaatatagatgcacccagtacaggagcacccagattcataaagcaagtccttagagacctacaaagagacttagactcccacacaataataatgggagactttaacaccccactggcaatattagacagatcaaccagacagaaggttaacaaggatatccaggacttgaactcagctctgcaccaagcggacataatagacatctacagaactctccaccccaatcaacagaatatacattcttctcagcaccacattgcacttattccaaaattgaccacatagttggaagtaaagcactcctcagcaaattaaaagaccagaaatcacaacaaactgtctctcagaccacagtgcaatcaaattagaactcaggattaagaaactcactcaaaaccgcacaactacatggaaactgatcaacttgctcctgaaagactacagggtaaataatgggacacatttaaagcagtgtgtagagggaaatttatagcactaaatgcccacaagagaaagcaggaaaggcctaaaatcgacaccctaatactacaattaaaagaactagagaagcaagagcaaacaaattcaaaagctagcagaaggcaagaaataactaagatcagagcaaaactgaaggagatagagatacaaaaaactcttcaaaaaaatcaatgtatccagaagctgttttttttaaaagatcaacaaaattgatagacttctagcaagattaataaagaagaaaatagagaggaatcaaatagacactataaaaaatgataaaggagttatcaccactgatctcacagaaatacaaactaccatcagggaatactataaacacctctacacaaataaactagaaaatctagaagaaatggataaattcatcgccacatacaccctcccaagactaaaccaggaagaagttgaatctctgaatataccaataacaggctctgaaattgaggcaataattaatagcctaccaatcaaaaaaagtccgggaccagacggattcacagctgaattctaccagaggtacaaagaggagctgataccattccttctgaaactattccaatcaatagagaaagagagaatcctccctaactcattttatgaggccagcatcatcctgataccaaagcctggcagagacacaacaaaaaaaagagaattttagaccaatatccctgatgaacatcgatgcgaaaattttcaataaaatattggcaaaccaaatccagcagcacatcaaaaagcttatccaccatgatcaagtgggcttcatccctgggatgcaaggctgattcaacatacacaaatcaatagatgtaatccatcacataaacagaaccaacgacaaaaaccacgattatctcaatagctgcagaaaaggcctttgacaaaattcaacatcccttcatgctaaaaagtctcaataaacaaggtattgatgggacatatctcaaaataataagagctatttatgacaaaccaacagccaatatcatactgaatgggcaaaaactggaagcattccctttgaaaactggcacaagacagggatgccctctctcaccactcctattcaacgtagtgttggaagctctggccagggcaatcaggcaggagaaagaaataaagggcattcaattagttaaagaggaagtcaaattgtccctgtttgcagatgacatgactgtatatttagaaaaccccagtgtctcatcccaaaatctccttaggctgataagcaacctctgcagagtctcaggatacaaaatcaatgtgcaaaaatcacaagcattcctatacaccaataacagacaaacaaagggccaaatcatgagtgaactcccattcacaattgctacaaagagaataaaatacctaggaatccatcttacaagggatgtgaaggacctcttcaaggagacctgcagaccactgcttaatgaaataaaagaggatacaaacaaatggaagaacattccatgctcatggataggaagaatcaatatcgtgaaaatggccatactgcccaaggtaatttatagattcaatgccatccccatcaagctatcaatgactgtcttcacacaactggagaaaactactttaaagtttgtatggaaccaaaaaagagcctgcatcgccaagacaatcctaagcaaaaagaacaaagctggaggcatcacattacctgacttcaaactatagtacaaggctacagtaaccaaaacagcatggtattggtaccaaaacagagagatagaccaatggaacagaacagaggcctcagaaataacaccacacatctacaaccatctgatctttgacaaacctgacaaaaacaagaaatggggaaaagactccctatttaataaatggtgctgggaaaactggctagccatatgcagaaagctgaaactgtatcccttccttacaccttatacaaaacttaattcaagatgtattaaagactaaaattttagacctaaaaccataaaagccttagaagaaaacctagcaaataccattcaggacatagacatgggcaagggcttcatgaataaaacaccaaaaacaatggcaacaaaagccaaaatagataaatggggtctaattaaactaaagagcttctgcactgcaaaagaaactaccatcagagtgaacaggcaacctacagaatgggagaaaatgttggcaatctacccatctaacaaagggctaatctccagaatctacaaagaacttaaacaaatttataagaaaaaaacaaccccatcaaaaagtgggcaaaggatatgaacagacatttctcaaaagaagacatttatgcagccaacagacacatgaaaaaatgctcatcatcactggtcatcagagaaatgcaaatcaaaaccacaatgagataccatctcacaccagttagaatggtgatcattaaaaagtcaggaaacaacagatgctcaaaaggatgtggagaaataggaatgcttttacgctgttggttggagtgtaaactagttcaaccactgtggaagacagtgtggcgattcctcaaggatctagaactagaataccatttgacccagccatcccattactgggtatatgcccaaaagattataaatcatgctactataaagacacatgcacatgtattcttattgcagcactattcacaatagcaaaaacttgaaaccaacccaaatgtctatcaatgatagactggattaagaaaatgtggcacatatacaccatggaatactatgcagccataaaaaaggacgagttcatgtcctttgcagggacgtggatgaagctagaagccatcattctgagcaaactatcacaaggacagaaaaccaaacaccacatgttctcactcataggtgggaattgatcaatgagaacacttggacacagggcgggggacatcacacatgggggcttgttgtggggtggggggcagggggagggatagtattaggagaaatagctaatgtaaatgactagttaattggtgcaacaaaccaacacggcacatgtatacttatgtaacacatctgtactttgtgcacatgtaccctagaacttaaaataaaataataaaaaaaaattctaatgccctaaatcaagtcaaatatgatagactgatatagagattatttttacaggaaatgcaccaataaaacgaacaagtttaacaacaacaacaaaaaaaggtaacagcaacaacaaaataaccctggtgggatgaactgcattctgtaaaataaataaattaataaataataaaagcccctgtgcttgggtttttgttgattcacgggcagtggccaatggctgggccacatgatcaggcagaagggcaatgaaaatctggcttattaatgggatgcccatatgaccttatggaaatttgaggagttcattaaagtagaacatgtctatgcttatcagaatagccccttttcaggttcagaaggtaattagaattgacaagctgatatccatccaccatgcgatcccttgaagtggctgcctgggtccatgaaatgagtggatataggcatatttcagcaattaagagatgaacttaatctagacatgtttctcttacaccctattagacacataacaacaataaaaattcttatgtatgccagcaaagagacagagcctgccaatggttatgtggcagattccctggtgggaaggccataaaactagctggcaagtgggactgaagctcgtagacctgagggagctacaaatgggtcttgacaggaagaaacaggtaggttctggactaggctttgattatcctgtggaagttgcaaatgttcagagtgttgtaagaaaaccagaacagaagatattgcatagatgtgaatgggcaagcatcattacttcaggctgagagacccaccatacaggcaataacgttcaacagtgggcaaagatatctcctttcagagtaatagtttgatagaaaagtgaaacaggcaatgaaaacattggctgcctaaaacaaggggagataaaagaataacggaatggcttatgaatgtgagcacagggcttcataaatgtgtgaccacactcaacataagtgaggttaagggaaggttcccattggttagattccttcacatttctgtggtttttgtgaagaggggatgggaaaggatgctagtgtgactatgtgacccttgccaagagaggagtatattaatacaaggactatactttttccctacataacctcaaaaaaatatttctcctgtttgatgcagtggttctaggaccagggcagtaaaaacaagtgctgaaagcagagacgatttttaagaaagaaactataactatgtattaaagctttatgtcagaatttcaaaaggccagatgcgggtggatgttgccttcaccgcatctggcaaaattggagttaacagtgaatgtagctacattttctggaggtaaaaatagctatctaaatgtgaatggactgaggaggaggtacctgctagactagtgcttgcaacgtagatcaacacgactgcttattctaatgtctcatccaaaggtggaagtctgagtattaatggagagatggaatgatagctgagggtaaagggatgaataaatgggttttgaattgagggaaatcctatattacattaaaacctcaaaagaggcttaaagaaagagattatattgtctcttagctcaagtatgccagatgcctgaaagggtgaagctatgtttgctaagaccactgctgcttttgtatcctgccaagattgaatgaatatctgtaaacattaatggccttaccccggaagagattcatgcaatataatggactgaactaatgattaatgattatatggaattctagaatttggcagtgtcctctgagtcatatgtccttttgatgtaagggatttgaatttgaagaccaggggcagtctgtgatattgtaaaatacatatttagtcttcaatcttgtttccagcaatacaacttctaaaatctttagaaactccaaagtgatgtctttgtatatgctaataagttgactgatgactggcatccccaaggtagcttcaggataggagctggttacgggaaacactaaggcaggattagagggttgagagatttccccaaattccagggaagggagaggggctgaagactaccatgatcaccaatagccaatggtttaatcaatcatgcctatataataaagccttcataaaaactcaaaaggacagggtctggggagcttctgaatagttgaacacatgtaatttcctgaatgatggtatgccaggagagccataaaaactccacacccctcccacatgcttagccttatgaatatatttatgtgcatcttttgcaatattctttataataaaatggtaaacataaaaaagagaaattagaaaaacaaacaaaacaggaactcagaagatgaaaagtacaataattgaattaaaaattcactaaaaggattcaacaactttgagcaggcagaaaaatgaatcagcaaaattgaagataatttaaatgatctagtgtgaggaatatagagaaaaaataatgaaagaaatgaacagaaactgaagtaaatgtcaaacatcaaaaagtgtattaacatatacattatgggaatgccagaaggagaagagaaatgggaaaataaaatatttaaataaataactaatggatgaaaagttaaatatgataaaatatatgaatctacacaccaaagaagctaaatgaacttcaaataggaaaaactaagagactcacattgaaacacattacaatcgaactgttggaatctaagacaaagagacctcttgaaagtggcaagatagaaatgattcatttcacataaagaaatctccaattagattaacaactgattttttattagaatccataaaggcaagcaagaggtgagatgacatatttaaagttctaaagacataaaactggcaacaaaaattctatacttcacaaaactattcttcaaaaataaaggattattaaaatataactagataagcaaaagctgacacagattattaattgtagaacttccctgcaagaaatactaaagggaatactttaggctaaaataaaagaacactagacaataacttcaaggtatatgaagaaataaagaacactggtaaaagtaactatataggtaaatatgaaaggtggtattatcatactttgggtttgtgaatcctttatttcttctacaatttaaagtctaaattaataaaattttaattataaatctatgttaaaggaaacataatatgtaagaatatgatctgtgactattaaaatacaaaagaagaatgaaggagatatatagtagcagtttttatactactgaaattaagttggtattattcaaactaagttgtcttaagtttaatatgctaattgtattctccatggtaaccaataagaaacaagtaaaatgtataaagaaaagaaagaagaaaatcaaaatggtgaaccattaaaattttaaaaagtaaaaataaagcagtaatggaggagtagaatgcatataagacatgcagaaaacaaatatctagatggcaaaggtaagccccttcaaatcaaaaattactttaaatattaacagattaaactctctaattgaaaggcagatattggcataaatgatggagaaacgtgatttatttatatgctggctataagtgacccactttagttacaaatgcacaaagaggttgaaattaaaagaatggaaaaagatttttcatgaaaatagaaatcaaagtgagctggggtggctgtattattgcaaagaaaacagacttaaagtaaaaaagaagttacaaacacaaagaggatgtacactggtaaaaggcaaaatgtggcaagaagatatagcaattataaacatatatgcacctaacaacagacttcagtgctccatgttcaataatggatagaacaaccagacagaactttaataaggaagtagaggacttgaataatactataaaactattagaacttaaagatatatactgaatattccaccccaaacgaccatacattcttctcaaatgcatgcagaaaatctgtagaacagatcatattttaggccacaaaacaatttttaataaattttaaaatattgccatcatataaaatattttatgattataatggaatacaattagaaatcaatacctaaagaaaatctaaaaacttcacaattatgcagaaattaaaccaaaacctctcaaacaactaaaacattaaagaataaatcataagggtaattggaaaatgttaagaaatatgcaaaacaatctatcaaaacttatgagatgcagccaaagcactgctgagaaatctatagctgcaaatgcttaaattaaaaaaaaattaaaatctccattcaacaacgtaactgtatgcctaaaaactataaaaagaacagcaaactaaaccaaatattagcagaggaaagaaataataaatattagcagggaggtaaatgtaacagataatagaaaagcaacagagaaaattaatgaaactgaaagtttttgaaaagatattgactaagaaaaagaagacaaattaatacaataaaaagtaaaaggataacattattatcaacttcataaaaataaaaggattaaaaaacattatgagcatctacatatcagaaaattgactaacctagatgatataaactcacttttagaaagataaactaccaaaactgacacaagaagaaataggaaatatgaagagaacagtaaaaagtaaacatattaaattgttaatcaagaacttccaaacatataaaattccaagatagatcagatgggttcattggtaaattctaccagacgtttaagaaacaattggcactaattcctttgaaacttttcaaaaaagtggaagagaaggaaatagttttacactcattctgtgagactaacattaccccatcccaaagccatataaagacaatacaacaaaactacaggctagtttctttttgactataaatttaaaaatcctaagcataatattagaaaacctaattcaacagcatattagaaggattatacataatatctaagtggtatttatctcaaaaatccaagagtgattaaatatatgaaattcaatcactgtaatatactatactaacagaccaaagaaataaagccacattatctgaattgatacagaatatgcattgaataaaatacaatatcctttcaggataaaaacattcaaaaactaagaatggaagaaaatgttcccaagattaaataaataccatatacgaaatacccacagctaatattgtactcatttgtgaaacactgaaagctcttctgaggattcctgctttagccatttctattcatcatagtcctggaagccctaacaaggagattatgcaagaaaaaaacctacaagcacccaaattggaaactacatggaaaattatctgttttcgcaggtgacctaacattatatgtagaaaaccctaaatattacacaaaaaataatctgtcagagataatagacaaatgtatcaaagtttcagaatacatagttaccattcaaaaatcagttgtatttgtatacagtaacaattaaaaaattattatattttcaatagcatcaaaaagaataaaatacttatgaataaacttagccaagaaggtaaaggacatacatcaaaaaaccataaaacattactgaaagaaattagggactgtgatggttaatattgaatgtcaacttgattggattgaaggatgcaaagtatcggtcctggctgtgtctgtgagggtgttgccaaatgagattaacatttgagtcagtggactgaaaaaagcagacccaccctcaacatgggtgggcacaatctaatcagttgccagtgcaaccagaataaaagcaggcagaggaatgtgaaaagacaagtctggtttagtcttgtgtcatacatctttcttcagtggtggatgctccctgcccttgaacatcagactctaagttcttcagctttgggactcaaactagcttacttgctccgcggcttgcagatggcctactgtgggacctcaccttgttgttgtgtgagtcaatactccttaataaactcctctttatatatacatctatcctattagttctatccctccagagaaccctgactaatacaaattttggtaccagaagtggttctagagcaatagaatattaagatggagttattttgttggtttggggtttctggagttggctacttaatatggattaggcctcaaaatgctaaggactctacttctaattgtatgaagaacactgatagtccttaccgtgaactgtttggagagttaggcataatgaacacatttgatacttctgatttcactgctcatgagaggcaaggaggttagttactctacataatacctttgaccacatgtggagaaccaaggatataataaagttggttggttgcttctgagttcactggaaagggatgaaagaaaatgatgaactcaaggattccaactcctggcttcagaagcagacacggagccttaaaccttctaagactgctctgagtgagagtattatctcttgtaggaaaagaactgaaattgtggaaaatcagacacaagttcttatcatgtaagcggctgacctgcaacaaaaggtgcatgcacagcctttccaggtgtctactgttaaagtgagggcattgactcaaaaagaataggaccctgaaacttagaatgggaatgtgtgagaggaccctgatgaggctggggacattgaacttgtaaactctgatgagacttttttgccagaaaacaaaaaacagcttccctatccccagtagtggcaacatcccccctgccccaacccatgctgccatcaacctttccacctttgtctgaggagataaaccctgcactgcctgaggcaacaatgatggcctcccctgaggcagttgtcagcaagacaatgctgattctcctcaggagccacccccaacacccctgtttgcatctagtcctataactagactaaagtcctggcagggccccagaggtgaggttcagagtgtgacacacgaggaggtacactacactccaaaagaactgattgagttttctaatttttataagcagaaatctggagaacaggcatgggaatggatattaaaggcgtggaataatggtggaaggaacatagaattggatcaggctgaatttattgatttgggcccactaagcaggggctttgcattcaatgttgcagtttggggaattaaaaaaggttccaacagtttatttgcttggttagctaaaatatggattaaaagatggcatattgtgaatgagctggaaatgcctgatcttccttggtttaatgtggaggaagggatccaaaggcttggtgagatttggatgcaggagtggattagtaaatttagacctactcatcctagctgggagggttcagaagatgtacccttgaccaatattttgttaaatagatttgtgaggacagtacctgcatccttgaagagctctgttattgctcttctctgtatgccagatcttgcagtaggaaccacagtcactcaactacaaaatgggaataattggatcccgaggtggcagaggccaagtggcaacactcaaacgtcaaaggcaaggtgggcataggtacgataatggaaagcaaaggcagagcagcaatcagagtagtctgactcttgtagagctctggcattggctaattaatcacagtggtcctagaagtgaaattcataggaagcctactgcactcttacttaatttatataagcagaaaacttccaggccaagtgaacaaaagacaaatttgaattataaaaatagagaatcatggcgcctccatcaatttccagacttgaaccattttacagacccagaaccccttgaatgaaggggaagccagttccccttggggaaggaccccactacactaccaacaatttatgctgttaatttttcttccatcttttaccaaggagacctccagccttttaccagggtaactatgcattggggaaagggaaataatcagacctttcaaggactggacacagtctctgacctgatgttgattcccggagacccaaacgtcattgtcgtcctctagtaaaagtaggggcttatggaggtcaggtaattaatggagatttagctgaggtctgacttacagtaggtccagtgggttcccagactcatcctgttgtcattttcccagtgccagaatgcataattggcatagatatactgagcagctggcagaatcaccacattgggtccctgactggtagggtgaggactattatggtgggaaaagccaaatggaagccattagagctgcctctacctagaaaaacagtaaatcaaaaacaatattgcatccctggaggaattgcagagattaccactaccatcaagaacttgaaagacgcagggtggtgattcccaccacatccccattcaactctcttatttggcctatgcagaaaacaggtggggcttgcagaaagacagtgaataattgtaagcctaaccaagtggtgactcaaattgcagctgctgtaccagatgtggtttcattgcttgagcaaattaacacatgtcccagtacctggaatgcaggcattgacttggcaaatggttttttctccatcactgtccataaggcccaccagaagcaatttgcctttagctggcaaggccagtaacataactttactgtcctacctgaggggtatatcagctctctggctttgtgtcatcattttgtttgaagagctcttgattccttttcccttccacaagattgatccattacattgatgacattatgctggctggatccagtgagcaaaaagtagcaaacacactggacttatttgtgagacatttgtgtgcaagaggatgggaaataaatctgactaaaattcagggaccttctatctcagtaaaatatctaggggttatggggtgtggggtctgtcaagatattccttctaaattgaaggatgagttgctgcatttggcccctcctacaaccaagaaagaggcacaacctatttagatattgaatacaacacattcctcatctgggagtgttactctggctcatttatcgagtaaccgaaaaagctgccagttttgagtggggtccagaacaggagaaagctctgcaacaggttcaggctgctgtgcaagctgctctgccacttgggccatatgacccagcagatccaatagtgcttgaggtgtcagtggcagatagaggtgctgtttggagcctttggcaggtccccataggtgaatcacagcaaaggcctctaggattttggagcaaggtcttgccatcttccgcagataacgactctccttttgagagacagccgttggcctgttactgcgctttggtagaaactgaacgtttggatatgggtcatcaggttaccatgagacctgaagtgcttatcataaactgcgtgctttctgacccatctagccataaagtggggcatgcacagcagcgttccatcatcaaatgaaagtggtacatatgtgatcagactagaacaggtcctgagggcacaagtaggttacatgaggaagtggctcaaatgcccatggtccccatccctgccaccctgtcttctctcccccagcctgcaccgatggcctcatgtggagttccctatgatcagttgacagaggaagagaagacaagggcctggtttacagatggttctgcacaatatgcaggcgctacctgaacatggacagctgccgcactgtagtccttttctcggacatccttgaaggaaagtggcagagggaaatcttctcagagggcagaaccttgagcagtgcacctcattgtgcactttgcttggaacaagaaatagccaaatgcttaattatatactgattaatgagctgtagccaatggtttgcccggatggtcaaggacttggaataagcatgattggaaaattggtgacaaaagaattttgggaagaggtatgtggatggacctctctgagtggtcaaaaattgtgaagacatttgtatctcatgtaagtgctcactgaagggtgacctcagcaggggaggattttaataatcaagtggataggatgactcattctgtggataccactcagcctctttcccccgacactcctgtcatcgcccaatggtcccatgaacaaaggggccatggtggcagggatggaggttatgcatggattcagcaacgtggacttccacttaccaaggtgacctggctatggccactgctgagtgcccaatttgccagcagcagagaccaacactgatccctcgatatggcaccattccttgggtaattagccagctacttggtgataggttgattacattggacctctacaatcatggaaggggcagaggtttgtcctcactggaacagacacttactccggatatgagtttgcctatcctgcacacaatgcttttgcgaagactacatccatggattcacgaaggtcttatctaccatcatggcattccacatagcactgcctctgatcaagacactcaccttacagctaaagaagtgtggcagtgggctcatgctcatggaattcactggttttactatgttccccatcatcctgaagcagctggattaataggatggtggaatggccttttgaagtcacaattacaatgccaactaggtgacaatactctgcagggctggggaaaagttcttcagaaggctgtgtgtgctctgaatcagcatccaatatatggtactgtttctcccgtagccaggattcatgggtccaggaatcaaggggtggaagtggaagtggcaccattcatcatcacctctagtgaccgactagcaaaatttttgcttcctgtttcctcgacatcatgttctgctggacttaaggttgtagttctgatggaggaatgctgccaccaggagacacaacaacaatttcattgaactgtacattaagattgccacttggccactttgggatccttctacctctatgtcaacaggctaagaagagaattacagtgttgtctggggtgactgaccagggctatcaagttaaaatcagtctactactccacagtggaggtaaggaagagtatgtgtggaatacagaaacatttttagggtatctcttagtattaccatgccctgtgattaaggtcaatgggaaattacaacagtccaatccaggcaggactacaaatggcccagacctttcaggaatgaaggttttggtcattgcaccaggtaaaaaaacacaacctgctaaagtgcgtgctgaaggtaaagggaatacagaatgggtagtagagaaaagccgtcatcaaaattagctacaaccacgtgaccagttgcagaatcaaggaccgtaattgtcatgagtattttcttcttattttgttaagaacatgtttgtgcatgtatacactgtactaagaaaatatcttcaatttatttcctttttattttatcatgtgacataagatttattgacttcatatcaacatttaagtgttattaactatgtaatagcatttgtgttagcgattgtgcatttcctactgtacaaaagacagttgtattatgttaggtgtaattatgaccttattattgtctttacttaagattatgtatgatttcaggagatgtgtatgagttcaagttgacaaggggtggacttgtgatggttaatgttgagggtcaacttgattggatcgaggatgcaaagtattgctcctgagtgtgtctatgagggtgttgccaaaggagattaacatttgaataattggattgggaaaggcagatccaccctcaatatgggtgggcacaatctaatcagctgccagtgcggccagaataaaagcaggcaaaagaaaatgaaaagactagactagtttagtcttctggcctacatctttctcccatgctggaagcttcctgcccttgaacatcagactccaagttcttcagctttgggaaccggactagcttccttgctcctcagcttgcagacatcttattgtgagacctcaccttgtgattgtgtgaatcagtattccctaataaattcccctttatatatacatctatcctattaggtctgtccctctagagaaccctaatagatacacaaaaagtaaatgaaaagacatctgtgttgttaagaggacaatagtccccaaagcgacatacaggttcaatataatttgatttttctttaatatataacttttttaatagagatgtggtctatgttgcccaggctgtcctgaactcctgggctcaagcaatcttcctgccttcacctcccaaagtgctaagattgcaaacatgggccacaatgcccagcccagaatttttttaatggccttttaaaaaaatgcatgattttaaaaatagaattatctattctaaaattcacatggattttcacgataccctgaatagcaaaaagtaatctcaaaaagaaacacaagaaacaaagtggaggactcacatgtcctgatttcaaaacttactatagtacacaaaacatagtatggttctcacatagggatatacataaaggccaagagaatagaaatgagagctcggaagtaaaccttcgcatatatcactaattgatttataacaaagtgccaaggctattcaatgtggaatgaaagttgttcaacaaatggagctgataaaactggatatgcaaatgtattgaatgatgtgaaatccttactttacagcgtatctgaaaatagctcaaaatgaatgaaagacctaaattgaagaggtgagactccaaaattcttagtagaaatcataggaacaaattttcatgaccctttatttggcaatagttacttaaatatcataccaaaactacaattaagagaaaaaaaaggtaaattcgacttcataaaaattaacttttgtatatcaaaggacactatcaagagaatgaaaacacaacccacagaattgaagaatatatttgcagataatatcttaagatttaacatctagaatgtataaagaactcttacaaaaaggtaactcaattaaaaatggtcaaagtacttcaacagacattgttccacagaagatatataaatggctaataagcatatgaaaatattcttaacatcattagtcttatgaaaatgcaaatcaaaactacaatgagataccacttcccacccactagaatggctactaaaaaatattcaaaaataacatcaattgtaacggatgtggggaaattggaactttttgcattacttgtgcaaatgcaaaatgttgcagcctccatcaaaagcagagtttgagagttcctcaaaaagttaaaatgtagaattaccatgagggactcaaactgatagttgtacatgaatgtgcatagtaacattattcacaatagtcaataggtggaaataacctgtgtgcatcaatggatgaatggataaaaaatgtatatttatataatagaatattattcaggcattaaaagggatgaagttttgatacacactgcaacatagataaaccttaaaaacatctattttaaataaagtaagccagacacgaaaggacaaaaatgaaccatgtaaaacagacaaaaatgtagagatagaaaatagaggtttccagtggttggcaggagaagcactggagatttattgcttaacaggtttatagtatttgcttagtgtgatgaaaaatttctagaaatatacagtggttttggtgcagaatattgtgaatttgttgaatgccactgaactgtacagttaaaaatggttcaaatggaacattttatgtcatattttaccacatcaaaaaatgtataatctctgaaagaagagtaaacatctgaacaggcgagttaattttgaaacaaccaagaagaaagcatacttagaactccacaaactgcaattatatatatattgtcagacatgaaatatagagtagctaagcacaaaatgtttaaagagtaaaaggtgaaattacaaagatcatttagtaagaaaatatcagaaaacaataggcatacttgaacaaagtgaaacttcccgaaatgaaaaactatatattcagtgtaataacaaaactcaaatccagggattaaatggcagattgcaattttcactagaaaataaatttgaagaacttattcagagtgcagttaaagatataagatggagaatataaaaaagaggttaaaagaaatggaagatagactgagaatgtgtaacatttgactgattaggtttaccaagagaaaatgaaaaagaaaaatgaaatacaaaaatcaaaactgaaaaaaaaattgtggcttccatttctaataatagtcatatggatattccagaaataataaaaaaaaattagatttaagatataatacatagatttaattagattacatttaattgattagatttcagatataataatagatttaagatatataagatataaatgtattatatcttaaatctaatcttactaaatttaaaatcatttgtaaaaactattgtggagatatctgtagaaatttcaagacaccaaatgaattgcgtatgtgataaatataaataaatcatcactaggtatgttctaataaaatttcagaacaccaaagatgaagataaattttaaaagtagccagaggaaaaaggtgaattacctttaaaaggttacagtttaacaagaagtctgacttttcaactacaaagattttcagaataatatcttcagtatgctgaatgaagttttaaaaagcagctgccaaaagagttttaaactgtgtaggtatatttcaagactaaagggaaatgaaaacatctgtagataatgaaatctgtaattaccaactgaacttaaggatatgcttcaagtggaagaaaagttaattgaaatggagggtctgagatgtaagacagaatgagaaataaataaaatagcaaatatataaataaatctagatgaacactgactgcaaaaagctacaataatgataacatctttgggcatttaaaaagataattaaaataagtaagaggagtgacaaattctttgggaggtgattaaattgaatgaaagtattctaaggtacttgcacagtcacaaggggtgaaaaaaggttttgtttatagtaagactttgtcaagtaggcatatgtaatttccaggttacccataaaaaattcaaaacagaaagtgaaatttccaaattagtagagaaaaaagtgacataataaaaattattcaattcaaaatgaggcaaaaaagaagagacaaagaaacacgggatatttagtacaaataaaaatcacaacataatacagttcattaaaactcaaatttgttagtaattccattgattatatatgaattatgtgttccatttatgaagcaaaatatcagaagaaaaatccacccatatactgttttaaagaaacatttaagacataagaatacagaaagtttggcagtaaatgaatcaaaaatgaaataatgagtctacgtgaggataatcaatgttcactgaaatattagggtgaaatgctgatggagaactttataatagatataccaggtctataacacctgagcctaatcaaatgtaacaccataaaagtgaaatatccagacgctatccaccagattataggaaatgcaaagcaaaagaatattaaaagacataaagatgactcaatcttgcaattccagaacatgggaacttctaaaagataaattgttttaatcaatatgtagtaaaaagggaaagggaactgttattgaataaaagtgacatcgtgaccaaatgtaatgtaataactttggacactgcttgaagaaaccaactataaaaattcatattgagtcagtcaagaacatgtttatattgactggaattttattactttaaggattagtattaatttttcagtgtagtaatggattgtagttatagtaaaaaaaaagttcttatttttgaaatttacattgaattattgatgaataaaattatgtgatatttggaattttctttaacataattttcattattaataataaaatcatgaaaaggaacaactcttgttgaatgcacattggaactctgttgaagcaggcatttctgacctagggggaaaaaaaacataaaagagaagatttttatgtgataaatacaggtggttgccaggggctgccgggtggggaaaatggggagatgttagtcaaatggtacaaagtttcagttgtgcaggatgagtaaataagctctggagatccagtgtacaacatgatgactatagttaataatactgtattatatacttaaaattttctgagtaggtttgaaacgttctcgccatacacacacagaaaagggtaactgtgaggtgatgaatacgtattcaagctaatcacgtaattagctcgattgtggtatttatttcacaatgtataagtaaattaataaatcacattgtactcaactatatatattttttgtcaattatacctcaataaagctggggaaaatgtaaaaataaataaataaattaccgaaaaaacccaaacatccataaatgaaaatgataccaaatctggcgccactttttacaatggatgtaaaagtcaagagttaaaatctttaacatgcatgcttactatgtcgaaagatcacgtacatgaaaacaaacatactttattgtgatttttttgaatgtaagcgatgaaaatccatcataaaatagcttatgtaaaacagggaatgtagcaacctgtataatagaggaagactaagagtagtttcggtttcaggcctgacaataccaagatattcaaaagctgttttctgtttggctctccctcattcttttggctctgcttcactttgtgaactgtgtgttccctcattctcttctcctacatgtgagtttccctcatgtggcctataagaagttggaagacagagcaatacatatccatggaaaaatataaatgattagcaataatgttggttcaattatagttatttaatacattccaactttgcttgactatgagaaataatgctatagacacatatttaattatgtagcagtgttgtgaaagtgccttcagatatataaatgcaatgtctttttttattgtctacaattgatttgacttttattttaggacctgttcatgaccctattagatagcaataaaaataataaaagccaccccccacccaaggttgaatataatcctgtaatctcattttactccaataacttaaactatctctttaggtaattcagttcatgtctccttggaagacccaagtacctcagtttttagtgttctgcctccctcttcttgatcctctctcagatggcttgtgggtatgtttagaattgaagtggatgtggcttatgtgaccctccgggcaataaaagggatatgggatgtcctgcattcttatggaaccctttggacttccgttgttctctctggatactcagcagtttgtgctgcttcctagaatgatgagtgctggtgtgcaactggtctcatttgccctcctatgtgtgatgtgctgcacctacttgttgagctcatgttcttggatattggcccctaatcttgaattcccaattcatgataatttctcttcattacaatcccaggtttctgctgctccaaaagtgtcctattaactccacatagcatcctcagtgaggtacactgaaacatctaagtcccaattttccaggccatagggaatcagaaactttgactcaggttcatcaaactatttatctaatacctgcacctcaacagcatagctcaaactttgtgttgaaagtaagggcatgtgaggattcttctagaggtttgcagcctctgcctagtgtgtcaataatcttaatatttacatccatctgactcctccacctctatctatttgttctagtaggggtttgtgaaagtcctggtgtctaatctcctaaccctctttgtgtctcaatttttcttcccagaatttcctggaacaagaatgagctagatttcttttcttttcccatcttggtaatattgttatttgaaactttataatcaaatcaattaagtctgcctcttaatttcttaaatgggagataaagttactaaactatttcctcttgtctgagctttaacaataattcccttgctaaataatttgagaaagtcaattttgacactcacgactaatcaaggaaattgatcacatttagccaaagaaatttgattcctgagaggactggaggtacaaagttgcaaataagcagtgtttaagaaaggaggagaatatttgaatgctttaacttttctaaaatacaatttactataaggggatacttgaaaatattgctacatgaaaggagaggcagatgaggatggtactttttatgatttaaataaaaagtggaggatcatgcgtaattttggttttcgtgatttatcataagtcatgtcacactgaactctaattactttatcaatataaaaattatacagtaatagttcaggcagacaagtaaaacaagcatgtaggataaactgatctgaggacttgaagtaatttccatcgtagcataaggcagatactttttcagtgccctgaatgttgtttattatggatactggtaataattcttctgagtgtatcagaatcaccagtagagcactgatgaaaagtgatactaatagataggagtaggtaagggagttttcttatggaaaggagtgagaatgaaaggtaaatatagaaaaaataaagatagaggaaaaagattatgacataacatttcagataatcaaatgagattgaaaagaaagattatataattctaccacatagccagtgaaattctaacttttaaccatagcttcttccaactggttcagctgaatccttgacatcaattcttctgattcactgttatccaaaatgatctgtaaatacttagtttgcctattcagttaatattcagctggacaccttttccagagttcaatctcttattttttcattttcccgttagtgccctctatttggatactcatcttaagtattttgtattattgttttattatgcacagcatttctggttcaaaatcatcatcttcaatttgaacggataattccaacatcacatcgcttaacattctcactagtaagtttatcctacccactatcagatctagcactatagcaaaatgatgagccaacaactcaaacctgattattatgaatccaattactggcatttttcagtctgtctagttctagctcaatgttttttctcccccaaacaatgtatagattcaaagaaatcctaatcaaaattacagccagctgtttttgaaattgaccagatgattattaatttatatgtacttgcaaagggttaaaaatagccaggatagcttgaggatgaaaattatgctttatttaaaaagatatgataattaagatggtgtgatttttttaataagaataggacaatgaaggaaataaaaattccagagcccaaaaacagacctacataaagtcatctgatttacttcaaaggtgacacatcagaatagtggggtaagaaatttccgttcaaaaaatgatgctgtactaattgtatatccacatattttaaaaaattgacattttttaatgccgtagaatttgaagagtgaaaagaataaaaaatcttttcagaactggaggggaaaaaaaaagcagctctattgttaataagtctgggaggacaggcagagagaaagtcagatatagtctcaaaaaaaatgtaacattgtttcttccaaggtcttgcaacagttgtgacattcaataagggccacctctttgggcgaccactgctttcttactatcgacatatccagaccagattttctatttttatgtgttactagggaaaacccaattgcttttgtcagtaaccaatccccagttaatctgtacttattttaatccatcctcagaaataacaaccatacttccattagactgccctcagaatccttcagtggtaactcaaactttgcaaaagacacttccttctatcttgtcagatggcattccactagtcctctgaaatacccttccattccagtgagtcaataaatctgattttgtcacactacaggcttgttcctgttgatctttaacaggagtttggacactctaaatatgaaatgtaaaatgagaaacttctggaatataacatagaaaaatgtctttatgaccttgagataggcaacgacttattaaaaagaaaacaaataaaacaaatctcactaggagcaaagagaacaattgataatttgtactacattaaaattcagaatttcttttcaccaaaacacagcataaagcaaaagaaaatgcaagccaaaaatgcatgcaacccaacatttgaaatatgtttaactggaaatatctattatggacaaagttacttgtgtccataatgtatacaaattttctagaaattaataagagacagtcaacctaataggaaaatgaaaacagactttttgagacaatttggaaagaggatatcagtattggtgaaattggtaaaattactttgtagaactgttcatgaactattaaacctgaatatctgcataggttttgaaccagcacttccaatcatgggtctattacctacagaaatgggtacgtatgtgcaccagaaggcaagtgccaaaccatctatagcacaacaggtcctaacatccagaaactagaaattactgtaattgccattaacaataaaatgagccaaagaacatgtttatttgcaggagatgtaacacaatggaatactatgaatgatcaatagaggaaaaagtgctactacatgcaataacatagatgaatttcacaaatatattattgaacaacaaaaatgctagtcacaagataatacatactgtatgattcgattaatatgaatttcaaaaacagacaaaagtaacttacaatgttagaaaagagggtggcaatagtgataggtatggggcacaaagagagcttagatactggaagaaattcaatatgtattgacttaaatggccaattcagctacctgcacatttatggtttggtaacattactgtctgtaggttattcgttttttagatactaattttttaaaggacagttaagcacagacaggaggcaattcacaaccctagtacaaagaaaatagcaaaaaccaaagtgagtctacataattgagagattctcagttcccaaagtgtattcaatattttcttttcattgtcacccatataaaataagactttatatgtgagagattatctgggaagtgacaggacagttgaggttttccctgggagatttttcaatcattactgggtgaatagggcactttaggtatgttgattaagaataaaaggaaaaaaaattgcacagcatttctctaacgtttgcatctaatctgttaaactttagttgagttttgcaagattgtcatctgggaacaccacttcaaaaaagtagttgattaacataatctcttgattaattcagaggtgtgaatcccaatcccttagcaaatgaattggtaggtaatgattaatgatcaggaaaaagacaggaaattgggcaaaatgtgaaaaaaaaaaaattagtacctacatcagtttgctaggactgccataacaaagtaccacagactaagaggctttaacaagagaaatatatttactttcagttctgagggctacaagtctgaggtgaaggtgttggcagagttatttatgttggcataattgcctgtttgtcttgcagatggctgtcttcttgtgtcttcacatgctctctctgtgtgcacctgtgtcctaatttcctctacttataaagataacagtcacatagaattagagcttgttgaagtgacctcatgtaacctcaattaccaatataaaggccttactttcaaatacaatcatatcctggggtactggggtttaggacttcaacatattaattttagggagacaaagttcatgctgtaacattacatataactttacattgaaaattaatgtaaaaatagcccataattattttttaaattatttttaaacattgttcaagagtagttatgcccataaaagtggaaatcatcatgtcaaggcaaacaaattgacaaaaatctaagtgagcaaacacaattgaaaatacctccttagttactgttatagattgaatcatgtcccctttccacaaattggtatgtcgaagctttaacctcgtatgttatatttggacataggatcattaaagagataattaagataaagtgagggcctaagggtgaagccctaatccattagcactgttgtccttatataaaaaggaagaaaatacacacacacacacacacacacacacacacacacagagagagagagagagagagagaaaggcaatgttagtacccagaaagaaaatggccatccacaagctaaagaaataaagaggcctcaggagaaaccaaccctgctagcaccttcatcctgaacttccaccctcaagaacagtgagaaataaatttgtcttagtccatggcaggtgaataaaacataatatcttagactgggtaatttataaataacagaaatttaattgtcacagatgtggaggttggggagcccaagattaaggagtcaacagttttggtgtctggtgagggctggctcctcatagccactgttttcctcacagaatactcttgtggcagaaaatatgtgaatactgagtcctcacatgacaaaaggagcaaaaggataaagggcaaaaaagggtaaagcctgtgtcctcacacggcagaagagatggaccagcaaaaaggagctaatgtgctcactacaacctctctgataagtgttctgtgcataagggtagagcaatcacttccacaaaagtccttccttttaatactattacattggctattaggttccaacatatgaattttcaaatcacagcattgttatttaaggcatctagtcattggtgttttattatgcagtgctagcagactaatacagttacccaaatatatttagtttccttttcacagggtattatgtatggaaagcacatgtttaaataagggagaggactggcacatcaccaagattttgagttttgtttaatgatttcattattcttttttatatcacgcattcaattttcttttttaaaaaaatttatttgaggttcagggttacatgtgcatattttttatataggtaaagtcatgtcatgggggtttgatgtacagattatttcattactcaggtactatgcttagaactcaatagttactttttttctgctcccctccctcctcccattccccaccccctggtaggttgcagtgtctgttgttcccctttttatgtccaggtgttctacttatcagtgaaaaacatgtgatatttaattttctgttcctgcattagttttctaaggatagtggcctccagctccatctatgttacttcaaaggacatgatcttgttctttattgtggatgcatagtattcaatggtgactaggcaccatattttctttatccagttttcattgattggcattaaggttgatactacgtctttgctattgtgaataaggctgaaaagaacttacacgtgcatgtgtctttatgatagaatgatttattttcctttgggtatatactcagtaatgggattgctgggtcaaatggtagttctgtttttagctctttgaagaatcaccacactgctttccacaatgcttgaattaatttatacttccataaacgctatataattgatctattttctctgcaacctcatcattatctcttggtttttgactctttaacaatacccattctgattcgtatgagatggcatctcactgtggttttgatttgcatttctctaatgctcagttatgttgagcttttttcctatgattgttggccacatgtatgtcttcttttgaaaagtgtctgttcatatactttgcccactttttaatggggttgataatttttttcttgtaaatttgtgtaagttctctatacatgctggctattggacctttttcaaatgcataatttgcaagtattttctcccattctgtaagttgtctgttattctgttgatagtttcttttgctgtgcagaagctctttagtttaattagatcctatttgtcatttttacttttgttgcaattgcttttgggttcttcatcataaaacatttgccaatttctttgtctagattggtgttgcctagcttgtcttccagggtttttatagcttttgcttttatatttatgtctttcatttatctttagttaatttttgtatatgttataaggaaggggtcaagtttcgatattctgcaaatggctagccagttatcccaccaccatttattgaatagaaagtcctttccccattgtttgtttttgttagctttgtcaaagatcagatgattgtacgtgtgtgaccttatttctgggttctcaattctattccattggtctatgtgcctgattttgtacaagtaccatgttgttttggttattgtagccatgcagtagagtttaaagacaggtactatgaggcctccagctttgctctttctgcttaggattaccttggctaatcaggctcttttttggtttcatattaattttaaaacaatttttttttgagatggagtttcactcttgttgcccaggctggagtgcaatggagcaatgttggctcactgcagcctccgcctcccaggttcaagtgattctcctgcctcagcctcccaagtagctgggattacaggcatgagccactgcacctggccaacaattttttttctagttctgtgaagaatgtcattagtagtttgatagaaatacaactgaatctataaactgctttgggcagtatggacattttaatgatattgatttttcctactcatgagcatggaatgtatttccatttgtttgtgtcatctctgatttccttgaacagtgttttgtatttatcattgtagagatctttcacctccctcattagctatattcttaggcattttattcttattgtgtcaattgtgcatggtattgtattgcattcatgatttggctatcagtatggctattgttggtgtataggaatgctaatgatttttgtacattgattttgtatcctgagactttgctgaaggtgtttatcagcttaaggatcttttggcctgacagtatgggtttttctagatatagaatcatgtcatctgcaatcagggatattttgacttcctttcttcctatttggatgtctttcattcttttctcttccttgattatttgggccatgacttccaatggtatgttaaataggagtggtgagatggcatccttgtcttgtgtcagttttcaagaggaatgcttccagcttttgtccattcattatgactgttgactgtgggtttcccacagatggctcttattattttaaggtattttccctcaatacctatgttgttgtgagttttaatatgaagaaatgctgagttttaatgaaaactttttctgtatctattcagataatcatgcagttgttgtacttctgtttatgtgatgaattgtgtcattgatttatatatgttgaacaatcttgcttcctagggataaaatctaatttattgtggcagattcactttttgatgtgctttggtttgccagtattttgttgaggactttgcatcaatgttcatcaaggatattgacctgaagtttctttcttgtggtgactctgacaggatttggaatcaggataatgttggcttcacagaatgaattgtggaggagttcctcctcttcagttttctggaatagttacaagagaaatggttccagttcttctctgtacatattgtagaatttggctttgaatctgtcttgtccagggcttttctggggggtgtgggcatgtggtaggctatgactgattcaatttaagagctcattattggtctgttcaggaatgtaatttcttccaggttcagtcttgggagggtgtatatatccaggaatttatccaattcttctagattttttagtctgtgtgcatagaggtattcataagagtcttagtaatggttgttctgtgggggcagtggtaatatctcctttgtaatttctgattgtgtttatttggattgtctctcttttcttctttattagtctagctggtggtctatctatcttataaattttttcaaaaaatctagctcctggctttggttgtcttttgaatggtttttcatatctcaaactccttcagtttacttctcattttggttacttcttgtcacctgctagctttgggattggtttgctcttgcttctctagttcttttagttgtgccgttaggtagttaatttgagatctttctaattttttgatgtcagcatttagtgctgtgagtttccctcttaaccctgctttagctttgtcccagagattctggtatatctttattctcattagtttcaaatacttcttgatttctgccttaatttaattatttacccaaaagtaattcaggagtagattgtttaatttccatgttattccatggttttgagtgattttttttttagtctcaaattctatttttattgtgctgtggtccaagagagtggttggtatgattttggttttttgcatctgttgaggattttttaatgtctaatcgtgttgcaacttttagagtatgtgccatctacagatgaaaagaatatatattccatagttttggagtagagagttctgtagatgtctatcaagtccatttgatccagttttgagttcaggtcctgaatatcttaattttctgcctcgatgatctgtctaatactgtcagtggtgtgttaaagtctcccattattattattatgtgaaagtctaaacttctttgaaggtctctaaagaattgttttatgagtctaggtacttctgtgttggatgcatatatatttagaatagttaagtcttcttgttgaattgaaccctttatcatgatgtgctacccttttttgtcttttttgttctttgttggtttaaattctaattttgtctgaaattacaattgcaacccatgcttttttctgttttccatttgcttggttgatttttttatccctttattttaagtctatcagtgtcactgcatgtcacatggcttgcttgaaggcagcatacactgggccttgcttctttatccagcttgccactctgtgtcatttaattaaggcatttagtccacttgcatttaaggttagtattgattatctgtggatttgatgtcattgtattgtcagttgtttgttatgcctacttgtttgtggttgctttatagtgtcactggtctgttcatttaagtgtgtttttgtagtggctggtaatggtctttcctttccaggtttaatgcttcattcaggagctcttgtaaggcaggtctggtggtaactacttttttcagcatttgttcatgtgaaatggatcttatttatcctttggccagatataaaattctgagttgaaatttattttctttaagaagatttaatataggcccccaatctgttttggcttgtagggtttctgctgagaggtctgctattaatctgatgggcttctttttgtaagtgatctgtcacttctctctgattcccttaattttttttgttcttgttgtttcggccttagacaatctgatgtttatgtgccttggggataatcttttgaaatattttgtgggagttctctgcatttcctcaattttaaggttggcctctctatctaggttaggaaagttctcatgtatgctaacctaaaatatattttccatgttgcttacactcgtctcatctctttcagggatgccaatgagttgtagattcaatctctttacacaatcctgtatttctcagatgttttgttcatttctttttattctttttttaaaaaactattttctgactgtcttatttctgaaagccagtcttcaagctcacagattctttactcagtttggtgtattctgctgttaatacttgcaatttcattaggaaatacttatagagtgttttttagtgcagtaacatcagttacattattttttatactggctatttttttctgtcagctcctgtatcattttactgtgattcttagcttccttagattgggtttcaacattcccctgaatattgatgatcttcattcctgttcatattctgatttatatttctgtcatttcagctatctcagtctggttaagaattcttgctgtagaatgagtatgatcatttggaggaaagaaggcactctggctttttgaggtgtcagagttcttttgctgggtctttctcatctttgtgggttgatgttttattcagtctttgaagtagctgttttttggttaagatttttccttttttcctacttgaaaccttgagggtttggttatggtataaggtaggttcagtcatctggtttcatgactggaagcttttaggggccaagtttcatcttaggactcctgaactgggtgttctaactctgggagactgatatccagccccagattttatctctgccccctcaaaggttaagaacctgctgtgctggagagaccaaagtgcttttggacttctggtcacaacattctcatgagtggtgtcagacaaagcacttcatagggcagtggaagctggatccatcttaattcacatgtggcagcaatagcatcagtggcagcacaggacaggagtgttgcatgctttttggtagtgacagggtgttactgtgtgcttggttggtggcctctgtgcaggcgttcacagcagtgttgatggcagtacagctcagtgggggtagggatcccccaccagtcatggtgcacatgttcatgctgatgtcagcatgggggtaccatgcttgagagtgtagtattaggtgctccctctttgtgcacactggtggcagtagccactctgagtgggggcaggtctgctgttttccatgcctagtttcacaccagcagtagagtcgctccagaagtgggcaatggttggggcagggttggcaggctccatgcctgctaactctccaaaaacaatggccatgcagtgtaggtgggtgtgtgtgcactcacttctgcaacagtgacacagcagggtgcatgtgcactccagcactggcagagtgtgctaggtctttccatgcacatacatgctgccaaagcaatgggggaagctggttgtgagtgagtggctgcagggaaagtggcatgggggaggctgcagtaggggagggaaagggtggactggtgcacgtctgtggggtcaacctattggagcactctgcctgtcagacacaatctgcctgcacaggagctatgatatgggcccccaaagttacctgggggctgcactataagaagacacagccaggctggggactcagaagaggcaagcagactgaggggtgttggggcgggggaggtgccccgactcatggacaccaccaccatgcagagttcaggaccaacactttgcttagggcaaaaatctcccatgggagcatgtggagccttgggggatggaatccctggccatgctccactacagatgcgcccacaccaaagcctctgggctctgcactggctggagttctgtcccctaccacttctctaagcagctttctctgccaactcaagtgtccatagtcatagaggggtctccgcctgccaggattccagaggtctttggggaaagtgggttgctccttggcagttcaagtaattggctgcctcagtcactgggggctgggaatgagtccctgtgcatggtagccccttgcaggattcccagcttcctcctgcttcgggctagcttctgtgtctttcctccatctactctcagtgccttcccctctgaagatctgttaggagtgcaccagtcatccccatccctctgtggcagctgttccacttggctaagtctagtcagccatcttgatcaaatccaccagaaaactctataaaaatctatgctgagtaattacgataggatccttgattctggcaatcccacttttaggtatttattcaaaagaaatgacaacatatgtccatacaaatacctgtacacatatgttcattataactttattgtaacagccaaataccccagcagccagcccccaaccagtaccagggaccacccaaactcccgtttttgatttttgatacatactttcatcgaaatgttggtaaaataaacatggtgtctctagtgggataaaactttcacacaatgtatagatatgtatgtgtgtatatatatatatacacacatacatattcatatttatacatatatgctttttatgtatacataaaagatctttacaaaaacaagtaaaaattgacataactattttaaaataaaactaagaaaagcaaaatataataaataaaaacatggattatcataagtgattatttcattacaaaatattttaaattgggtatattaaaattgcaagatgaaattttttctactttgatagagtaactggtagtggacttgccctcctttcagaaaaaattacaacactggaaaatacagataaaatactgtttgcagatattggcaaacatgcagcacagaactgtaatcagtgaagaagggttaaaagaaggtaagcaccacaatatcccaaacagagaaataggaaaggtaaactcaggtaaataccagtaatctccctggattgaaaagatcagaattaaaattctggaaagtttagataaactttggaatttgtagagtaccggagttgaaggaatagcacagagaaagagcttcacaagtctgaatagaaaagccgttgagtttttcctcaataaaaagctgtgcatgcataaggtgaaattccacaagttaaaacagacaacagctggaaagtcctgacttgaataatttccagaaattacaaagggtgggaagacatttaaagtctaaccaataggttgaaaaactcatttaatccttctctacggaaaaatctgtcagactttatctgaccaatcaggttgatagatttttctgtagcgaaggattaaactgatctataagtaatatagctgcctgtctaaatataattcaaatcttgctaatgtaggacaacaaatatagacactcaataccataatattcacagatacctactatacagtgaaaaattattagatatgcaaagaagccaaaaattatgacccataaaatgatggataaacatatgccatgctaacaacagcaagaagaaagatgtagtaactatattaatttcagacaaggcagatttgagaataaggaaaaatattcaaagtaaagaagggcattacataatgagaaaggaatcaattctccaaaagatataaaaattcttaatatgtatgtgcttaacaatgagcattgaatatgtgaaaaaagaagtgacagaaatgaaaggagaaatagaaaaatctactttcatatagttggagatttcaacacactccactatcattatgacagattcagaattcataaaatcagtatggccatatttgaacagaatagtatctttaataaactaaatctaacggacatttatagaaaaatttattcaaaaacagaaaaacaaacatttttcttaagcttatattaaacatttaccaacttagaaagtattctgggccataaaactcaccttaattaatttaaattaatagcaatcatacaaagtatgctttcagaccataataaaatgaaactagaaatcagtgactgaaagttacatggaaaacatccaaaatacttggagagtaaacgacacactttaaaataacatatatatctaataagaagggtgaagacaattttagaaaatatttttaaatatctcaaatggaaattattgacttttgtagaatagaaccaaggcagtacttagagggaaatgtatagcatttaatgcatatactacaaaagaagacagaactataatcagcaatcaaatttccaatttagaaaactagggaaatagcaaattaaatccaaagcatgcagaagaaaagtcaacattagaaattataaaaagagcagaaatcaatgaaattgaaaacaggaacccagccaacaaaataaaaattatgagattttgatcctgtcatcatgttgttagctggtttcttgttttcaatttcattgatttctattatttctaatgtttacttttgtatacccaggggaatataagttgttctattacaaagacacatgcaagcatacgttcattacagcactattcacaacagcaaagacacggaatcaacctaaatgtccatcaataatagactgaataaagtgtgttacgtatataccatggaatactatgtgtgtgtgtgtgtgttttttttataggattaaaaaagaatgagatcatgccctttgcagggacagggatggagctggaggccattattcttagcaaactaacacaggaacaaaaaaacaaatatcacatgttctcacttacaagtgggagctaactgatgagaacacatggacaaataaagaggaacaacacacacggagagtagaagatggtaggagggagataatcaggaaatatcagtaatgattattggccttaatacctggatgatgaagtaatctgtagaacacacctttatgacacaagtttacctatataacaaacctgcaaatgtacccctgaacttaaaacaaaagttaaaaaataaatatgaacccggaatggaaatggtcgaaatgcctgacttaaatcgcatagagtgaaaagctggattaaaagacaagacttaactgtctgttatctttatgaaacccatctcacaggtaatgacaccaacaggctcaaagaaaagaaatgaagaaagatcttctatgcaaattaaaaacaaagaagagcaggagtcactattgctatgtcagataaagcagactttaaatcaacaacaattaagaacaacaaagacattacttaattacaaaggttttaattcaacaagaatacttaactatcttaaatatatctgtactcagccttggagcacccagactcataaaagaattttttttttatttacaaaaagcctaaacacacacacacagtgttggagacttcaacaccccactgacagcattagacagatcatcaaggtggaaattctgaaattaaactttacacttgaccaactggacctaataaacatctacagaactccagccaataactacagaatatgcattattttcatctgcatacagaacatattctaagattaaccacctgtttggttataaagcaagtctcaaaaatttacaatattgaaatcatatcaagcatactcttgaccgcagtgcaataaaaatagaaatcaatatcaagaacatctctcaaaactacacagatacatggaatataaacaacttgctcctgaataactcttgggtgaacaacaaaattaaggcagaagtaaaaaaaaataaaataaatgaaaacagagacaaaaattaacaaatcttcgagatacagctaaagcaatgttaagtggaaaatttacagtgccaaatgccttcattaaaaagttagaaagatctcaaattaataacctaacactgcacctagagaaactagaaaaaaaagaaactaatcagctccaaagctagcagaagaaaagaaataactaaaattagagaacttaataaaattgagatacaataatccataaaaagatcaataaaactgagttgtttctgcaaaaaacaaatgagattgatagaccaaacataagattgatagactaacaaagtaaaaaaaaaaagagagagaagattcaaataatcccttgcatcagtgtgtcctagataaggaacatggagtctaaagagattattttggatctttaagatttaatgactgccctgctgtgtttgggactcacatggggcctgtagcccctctgttttggctgatttctcccttttggaatgggaatatttacccaatgcctgtatcctcattgtatcttggaagtaaccaacttattttttattttacagcctcataggtagaaggaactaggctcatctcagatgagattttggacttttgagttaatgatgaaatgagttaagacttttggaggactgtttggaagacatgattatattttgcaatgtgagaaagatgagattttggagggggcaggggcagaatgatatggtttggctctgtgtcccaccgaaatcttatgtttaattgtaatccccaatgttggcccagcacggtggctcaagcctgtaatcccagcactttgggaggtcgaggcaggcagatcacttgaggtcaggagtttgagaccaccttgaccaaaatggtgaaaccctgtctctactaaaaatgcaaaaattagctgggtgtagtagcgaacgtctatagtcccagctactcaggaggctgaggcaggagaatcacttgaccctgggaaatggaggttgcagtgagccaagatcgtgccaccgaactccagcctaggtgacagagtgagactccgtctcaaaacaaaacaaaatcccccatgttggagatggggcctggtgggtagtgattaaatcatgggggcagatttcttgttggtgctgttctcatgatagtgactgaattctcacgatatctggttgtttaaaagtgtgtggcacctccccttctctctcttcctctatctccagccatgtgaagggctgcctcccccttcaccttctatcttgattgtaagttccctgaggcctccccaaaagctgatgccaccatgctttctgtacagcctgtggatccataagccaattaaacctctagtttttgtaaattacccagtctcaggtagttctttacagcaatgagagaagggactaatacaagaatggaagagacaaaaccacgagagttcctctatatcactcaccatgttttgtagcacactgcatacttttatcatatcagttattgctctgtattgtaacatggggtttgcctatctgtttgattcatggtgttttaggtcaaggtgtggtatggatttctagtgtgcagtaatatctaatggagttttcgctcccttcaggtacacaggataattatactttcctttatccttaggctggagatggtgccacagttatggctaattggtttaaaaaaatcagttccagtcttttcttcccctgacatgttatcacatatacgtattctaaatggtgtagcttcaagagagtgaaaagtctatcagcctctgtccctgggtgattgtgcagagcctccgaaatttggcagcttctgtaactgcagcatagcccaacctacttggatgaataaaaaaaaaattaaccttactttctttgtaggtgtggaaacagtaaaataaaataagacattttaatatagcttggaaggatggtaaccatattatacaatgacaagacatttggaataactgtcatgtttcacaaattattcatcagaacatggaacaaatgaacttgtagccaaaaagaagttagaaagcaaagtaaaaaatgaaaatgttattaggctggtgcgaaagtaattgtgttttttgcaacaatttcattgcaaaaacctcaattacttttgcgccaacctaatggtaattgtgttagttgttatttgttgtgtttggcatagtattataagtgaaagaagaactctgaaaataattggttagtttcaaagcgaataataataatggaaatagaaaagtccagaaattctagaccttccagtgtttaaaagactacttctgagctccaaatataaaagataagagtgataagactttaaggaatgaatgcccaataaaacctttaatctgatttaaatttcctctgggaaaagttttcttaagagtgtggcacctaataaaaacttttaatttaataaagtaactcagaacaaaaatcccattaagtgtgtggccttccaagagaccgtactaacagcctcatctcaaggcagtccccattaaattgagggagagaagggaggttcacaaagtgtctctctctctctgtctctctctctctctatatatatgtgatatattatatataataaaactaaagataaatatgtaatatataaatatataacaaataataaaatgaaaatatatagcatagtgtaatccataatatttttataatttatataatattggagaatataacttgaaaagaactggagctatagctactgatttttttgccataagaatatgtttattttggaagtgattttaattctttagccacaatgtccctatatttttacattaccccttatttttccatactatttatacattagatacagaatttgttagaagttaaaagggaaaaacacattcttttgctgaacaatagctcattatatttaacttaaaaattattagcttgttgaatatcaaaacttgaagctgctgggaatcacatttatttttaggttccaaaatagttctgagttctcagtaggaaaccatcttttataaactataacaaaactctcatctcaaaattaaatactataaattgacacaactatatctatattgaatgtctttataatatccagaaacctactggctttttagaaatacaatgaaaatagatttacattctggctttataaatcaatttttattttagaaaattttaaacatatagagaatactatatgaaacagcacatattcaacatctttaatatcatttaaccaataatgttctagtatatatctctaaaattcacacctaaagaaaacacagaaaacatgtttatcacatattaacatttaataataatttctacaataaagtatcactgagcctatttctccaatttcttcataaacattttttacagatgttttttcaaatcagaatccaaagaggctctgcacatgccatattcctggagtgtttcctaagtgtacttgactctatatgttcactgtatttgttggaaaaagtcactggtagtcctgagatcagcagggatcagcatcatctgggaacttgttagaaattaagttctcaggaaacaccccaaacctattgaacctgaaactctagagttaagagcccagcaatatgctgatgcatgctaaagtttaaaacctactactatagttctacacactcaagattttatagattgtattttcatgataccatctaatatgttgatctatctcccgtatgtcatacagattgtggttctcaggtacaattgtttggtaatgaaaattcatatatagtgggtttctttaactttccatagaatcatatacaaagattcataatgtcctgttgtctccttttacagtgataaaaagtttgatcagtaagtcaagtgtgccagcttcattcatcaattcattattaaattatccattagcttttcacataatagtttcagcatccatttatgatcatttctcaaatctgtgatttcactagaatttgcaaaatgggactatactaattctttcaatttgttatttgttagcaaaagtaatttttagaaacgttttgcactgtttggttaccctgaggaacaatttgtacaagagaagcaggaaaactgcctgactctttcctttgccagtttccaaaactggttccacagaaacctgcaaactgaagttgtttttttaaatcaacataattaattcatgaatttgcaatacattttatgtgtttctatccactgcagttattattacttttgatgctcatattatctgaactttggctagcaggaaactctttaggcatctgaatccttttaacatgatgcaaatcatttctttttatagcttccctgttttctggcatgacaacatgctccaggctcattttgtacattttgttcaccacaccttttttttttattatttctccaagactctctggttgccttaattggaaaaatcacagagttcatcattgcaaatttagggcaactcatcacatatatgtttgtcttttttttttttcacagtagaaatcaagaaaatagatttatagattttagaatttatatcataaattcttactgatattttccatttaaaattaggagttcagagtataagtatctgtttaattatactgaaagtcttagcttccaatgacattaacacaaatatttatttgctttctctggcaatatctacagaaaagtttccgaataaaatgatcaatattgttagtaaaaatataatcacaagtcagtttaatgtttctttgcattttcttttgtccttaggataatccctactaaggatacgtagataattcattttaaagtcatttgaaataattatctgtgagtataggcctccaacgagatacacagttcagatgatataatttttgtattttatttttaagtactgatgtttcattttgatttcattttgtttataatgtgtaagacatttatatactaccaaagtcaaatgtataagcatggtaaactgtcttccatttccatcccctacaccctgtccctaccactttttatttaggtgaactttttgctaatttattttagtattaccttattttttgtaaagaaaaaataaacaaatatgtatagatatagatatgcccatctttcttaagtgcaagttagcaaactgtacaaattgttatgcatgtgccctttctcacttcgtaacgtgttttggatgtcattccataatagtatacagaagtcttccttatttctttttacatttgcacagtatttaattgtttggctgctcaattgttttcttaaacagtcccctgttactggacattcagattgtttccagttgtttgcagtgacaaaactagtgctgtaagcaataattatgtgtatacatacttttatattttttgctagatggctttgagatagattcttagaagtggactcagagtcaaaagtaaataaacgtgtttggccattgtgatggttaatattaagtgtcaacttgattggattgaaggatgcaaagtattgtttctgggtgttgccaggatagattaacatttgcatcagtgggctgggagagcaagattcactcttactcaggaaaacacacccacaatgtgggtgggcaccattcaattgcctgccagtgtggctagaaaaagcaggagaagaaggtggaagaagctgacttgctgagtcttccagccttcatctttcttctgtgctggatgcttcctactcttaaacgtaagagtccaagttagttggcttttggactcttgaacttatactagtggcttgccaggggctctcagaccttcagacacagactggaggctgcattgctagcttccctacttttgagattctgggacttggacatagccactactggcttccttgctgctcaacttgcagacagcctattatgggacgtcaccttgttactgtgtgagtcatgtctcctcataaactccctttcatatatacatgtatcctgttagttctgtccctctagacaaccctaataaagccatcctacaaaaatgtgatggaccctcacccaaaatttggtttggatatcaaggctgatggtgccacatatgcaccaagagggtataaaaagttctattactcacacaatgagtttttctgagaagaacagggcaatgtctcaaacttaaataaggatggcttgagaaagtggagaaaggagaccattttgttttttatggtagctgggagtggggttagggaaagaactactgcgtaggggttagcacttgtgtgttttgaacttcctactgacaccaaaggtaagagcatcgaggcttcctcatcagcttgcccagatgtgtgtggaagggcaagtgggagttgttgggcttaaaagttgtctgctgtccattacaaaaacttgagtcagaccctttttgttagatcttgacaaattctactccaaagtggttgtacccttttgtagtgccggattgcctattttttccatagctttgcccccaaaaaacaaaacaaacaaacaaacaaacaaacaaaactatgtggtcaagcttttgaattgttaataatctgataagtgagaaatggaatgaccatgtaattttaatgttaatgtattctgttagcttgtatacatttttatatgtttaagccgtggctaatatgcccttatcttatgcctattttctataaggctattactgttttcttctctttttttacaagctctttgtatattattgacactgtttttctgttatataacttacataattttttaatttatttttttgctgatggtgctttctttctgacgaaagattttttaattaaatgttatcaaacttactagtattttctcttacagaatctgaattttggtctctattaagaaaataactcttctaaatttgcatctgaggttattatatatttttatgtactttattcatccattaggaattctatattgtctctattaatctcctcctagacatatctatgcattttaacactgtttaaataataacacataaaactaaaagtggagttgtccagtcttcataataaaatctaccaattactttggtaaaatgggtctacaaatcaggtagagctcagcaataataagaaaactgattaatcgtgcccatctgactcattttacgttaaacctaatggtttatttaactgacagctagtgtctccttttaggatgatttgaacagtaatttagtgtaatttgagcttgagaaggtactgatgatataacagaaagatctgggttcatcaattggtagctatatttaaggatgatttcatggtattccaaaattctgtacttttgggggattttgttgcctaaagtgaatgtggtataaagaagctgtcattaaatcctaatgattcaaggaaacccaatcttatataacttgccaaggaatacatagccaaatagtattcaatctctgaggaaaaacagctgtgttttgacattttgcataaactttgaaagtaaaacaaaaaatatttgcttaaactgtcctttcagatgctcagagtacttattgtttcaaaagtttttttctaaaacatgatgctgtgtgttcttttgctttaaagcaggcatttggtaattttgacatggtattataaaaatttacttttgagtcacctagcttcagaaatctaaacaatttacatctgaaaaacacacttacacaagtgaagtgagttacattacaacaaaccttttctactagcattcccttttaagagcaagaaaaaaaatgaagtttggcaacatgatttaacagctgcatatagtatttatgataaagaaatcacatagcagattttcagttacccacagaaggaggtccaaggagagcacacaattaagctacacagataatcatctcaaccatgagtttcaaccatctgagctgtcagtaattagccaatttttatttcactactaccctgactattctccccaggaacattacaagagatattcaataatgaggaacaacagtgaattattagtaacatgaaatattccatattctgaatgaatattgtatattaattcttaaatgagaaacatgatatatcaatgaacaacaagagatagaaattgttgacaggacaaagttaatataaacactttgcttgaaggatagaaaggagcttatgtgggatggagcagcgtactcaaaggacaaatagctaaacattctcataatttcttccacaataaaataatgcaatctttccatgaacacactttattttctatgtttccatagcctaaacgctttatttgaaacggccattgatgtatgaagactcggaagtaatcatgtgactattataatttatagcaaatgttgaatggacagttttaaaaaactttgtagtgtttttgtgatccataatatatggctatcttcaaagttagcaattacttcttgcactttttttctgcttgtgaagacttcaaattgatcctttttctaatatttagttcatctcccaaataattacttaacttttatcagcagcatcttttttgtcttaattggttcatgatactatgtcaaaaagtgatttaaaaatctttcagtgtcagaaatgtaataaggaggggtggaaattacgctaaactgtattttactacaaagatcatagtttcatttccaaaataccattgctgctctgctgcagttaattatttccattcaaaaatgtaaggccaagcttttgatttgtgtcaagcttttgaattgttaataatctgataagtgagagatggaatcaccatgcaattctaatgttaatgtattttgtgaggttgtatacattttcatatgtttaagctgtggctaatatgctcttatgcctattttcctataaggctattgctgttttcttctttttttacaagctctttgtatattatcaatattaactatttttctattatataactaacatgatttttaaattttttttgctgatggtgttttctttctgacaaaagatttcttaaatgttatcaaacttattaatattttctcttacagaatctgaattttaagaagaaaatattcatttctcacaggtaataggttaaatcatccttgccttcttctactactggtattgtgtttcacttaacttttcaatcttttcaacctctgatctgcttgaaacacatcaaggtgtgtggtgtgaggaacagatcaaattttgacttttgtgttttgctgctgtgtagttccaacatcactaatttaaaaagcccatcttttctcctaattgttgtgagatgtcatatttgtcatatataacttttttttttatttcttgactgtttttttctgttccactgatccatgtatctatgtatatgcaaatactccactgatttaataaaagaaacatgataatatattttgacatttggtaggatttaccctcctatcaacattgctatttttcaaggtcctcctaaatattcttacttgttggttttatcaaatgaatcctaaaacctaggctcataaaaatgcttgatggcatttttattggaatagtctcacatttaggtaactcaaggaaaattgacataataatgttgattctttattttcaagaccacagtattctactaattttgaaaacatttgtaccactaaagatatcagaaactgcctttgcaaaaattataactgagacaatttttacagtgaaagagatatgacctaactgactccacctagcttcgaaccttaaagttgtccttcattcttgggagtaggccaaactatctttgggagaaacttagtttatggtttagaaacaaagacaataatagccctttcccaaaacaaattcccttcctgcctggggactacactgcctttgcaagactaacaaattagtcacaaaattagaaattatggtttaggaatcatgtagctggaggctgcaagattcttaacctccccaaattgctcctggagataacatcactattgtgaaatgtaagatcactgcttgacatattttgcagactttgcattcgatgtaccagcaggcactatccagattaatcaactagctcgtctggtcttgtggcccctcatccaggaactgactcaggtcaagaggacagctttaactccctaagatttcatctccaacctgaccagtcagaactcccgtcaaactatcttcaaaaattccagtccctgaattctcagggagactgatttgagtaataataaaactttggtttcctacacagctggctctgtgtgaattactctttctttcttgcagctcccctgtcttaataaatcagctccgtctagacagtgggcaaggtgaatctgttgggtggttacaagactatttaagtcctcactttatgtctttgataggttcatggaaacagctacattaaatgaaacaacgtatataacaaaaccattttcttctcttcatcattatgttattcaaggacctgctgtatgttgcgtcacttaatgttgcagtttccaagaacctatccatgatattgacaacatacattacatacaaagcatggagtttaacatgaagagtgtgtgttctacatgagggaaggagaaagaaccacacatttggtaacaacaagacggcaatcctgcatgaacttctgtggccacctacattccgttttcctctatttctgggaacacaggggaattttttttccatctcttgcagtttagtggggttatctgctacgacgacatgagcatgtattttgactaatacataggaactgtatattttcttttttataactctggtgccctgtacattgtatagacaattagaaaatatgtattaaaagaataaaagtaatcatattagaaattccagcagtattatcccatggactcacataatttttccattgtaaatacagttaaatattcaaagttgtattatatattagtttttcattaacctacaattttcttaacacttctaaatttgaatctgagattattatacatttttctgtactttattcatccattaggaattctatattgtctctattaatctcttcctagtcatatctatgcatgttaacactgtttaaataaaataacacataaaactaaaagtggagttgtccagtcttcataataaaatctaccaattactttggtaaaatgggtctagaaatcaggtagagctcagcaataataagaaaactgattaatcatgcccatctgactcattttacgttaaacctaatggtttatttaactgacagctagtgtctccttttaggatgatttgaacagtaatttagtgtaatttgagcttgagaaggtactgatgatataacagaaagatctgggttcatcaattggtagctatatttaaggaaagatgatttcatggcattcctaaattctgtacttttgggggattttgttgcctaaagtgaatgtggtataaagaagttgtcattaaatcctaatgattcaaggaaacccaatcttatataacttgccaaggaatacatagccaaatagtattcaatctctgaggaaaaacagctgtgttttgatgttttgcataaattttcaaagtaaaaaaatttgcttaaactgtccttttaggtgctcagagtacttattgtttcaaaagttttttttctgaaacatgatgcagtatgttctattgctttaaagcaggcatttggtaattttgttaaggtattataaaaatctacttttgagtcacctagcttcagaaatcacctaaacagtttacatctgaaaaacacacttacacaagtgaagtgagttacattacaacaaaccttttctactagcattcccttttaagagcaagaaaaaaaatgaagtttggcaacatgatttaacagctgcatatagtatttatgctaaagaaatcacatagcagattttcaattacccacagaaggaggtccaaggagagcacacaattaagctacacagataatcatctcaaccatgagtttcaaccatctgagctgtcagtaattagccaatttttatttcactactaccctggttattctccccaggaacattacaagagatattcaatgatgaggaacaataataacacgaaatattccatatactgaaagaatactgcatattaattcttcttaaatgagaaacatgatatatcaatgaacaacaagagatagaaattgttgataggacaaagttaatataaacattttgcttgaaggatagaaaggagcttatgtgagacggagcagcatactcaaaggacaaatagctaaacattcccgtaatttcttccacaataaaataatgcaatcttttcataaacacactttattttctatgtttctaaagcctaaaagcattatttgaaacggccattgacgtatgaagactcggaagtaatcatgtgactcttataatttatagcaaatgttgaatggacagttttaaaaaattttgtagtgtttttgtgatccataatatatggctatcttcaaagttagcaatacttcttgcagtttttttctgcttgtgaagacttcaaattgattctttttctaatatttagttcatcccccaaataactacttaacttttatcagcagcatctttttatcttaattggttcatgatactatgccgaaaagtgatttaaaaatctttcagtgtcagaaatgtaacaaggaggggtggaaattatgctaaactgtattttactacaaagatcatggtttcatttccaaagtgccacttctgctctgctgcagttaattatttccattcaaaaatgtaagggcaggattaccacatattccgttatttctaaaagaagccactaatagcatgattttaatggttacgaagattaatatttttatcatctttgtgttctttatacttaaagagcaaaattgcatagtacagataatctatcccttaaatgtgtaattaaacttttcgtgtggacacatagtttcacactttggttcaataactaattacatatttaaacttgccctttctcatcgttaatgccacatgctgaccacaaagacaatacccgtttactaagaaaattttgtttgacacagtaataccatttaccttgctttgaaatacaatttctcattgttctgctatactcttttttttttttgcatcgtaccccaaaaactggaaacatttctcaacggtttccattaaaaacagaaaaagaaataattagctcatatttatatgaaatagataattcataaattctataagacactcagaacaaacactatgatgctagcagaagaagcaagcataaaataagtacaatctctcaaggatatattgattctctcacagcttagcttgcacacaggctaatgatgacaatattgtggcatgaaacctaagagtgtatgtgtgtgtgggggtgtacgtgcatgttagagagacagagcccgctttttaaatctacaacagagaagtccaaaaagtttaccttttacatgcacacacacacttatcacacgcttatcatcttaggaccttttaatatctgtttataaacatgtctcaggagaatgttaaacagtaaattgattttcatttaggccttttttttctaaccacatgctatagaagtatgtgttagtgaaatatttaggagaaaatataacaaattttatttgaatagttgctttataaaaccagctgcatatgctatagagtagggagagattgcctaggtaaacttctgtagttcaaatcttgaagaaaactaaaggttaaacactgaggagacatttcaagtctagtgattccctgagttctctttaaaatacttgcaacatgcacaccataaatatgctagagaatgtattttaagatattaagaagacataggaatgttaatttaaaaccccatggaacagaaatagccataatgtcctgccgtacctcacccacatggagtaaatagtaggggttgatgctactggctaactgaatgctaagactggaaaaaagcaagagtctgaaaagtaaaatatcaagtgttaattttgacccaaatcctgccacactttttacgagacaacatcagactcattgtatgagacatattcacatatttgatgctcgttgttaagcacatacatattaaggattgttataccttcttggagaattgattcttttatcattatgtaatgcccttctttagttttgatatttttccttactctcgaatccgctttgtctgaaattaatatagttactgcagctttcttcttgttagtgttgttagcatggcatatgtttctccatcactttacttttatgcatcataattttctgcttctttgcatatttaataattttttactgaatggtagatatctgtgaatattatggtgttgagtgtctaaatttgttgtcctacattagctagatttgaattatgtttagacaggcagttaagttacttacagatcagtttaatccttctctactgaaaaatctatcatacaaagagttttttcaacctgattggccaggatttaaatgtttcccaactctgtgtcatttctgggaattcttcaagtcaggactttccagttatgtcttgcctcatggaatttcatcttatgcacgcacagctttttattgagcaaaaaattcaaaggcttttctatgcagatttgtgaagctcttccactgtgctattccttcaactctggtactctacaacacaaattccaaagtttagccatctaaactttccaaaatttcaattctggtcttttcaatccagggagattactggtattttcctgactttacctttcctatttctctgtctggggtattgcggtgcttaccttcttgtatcccttcactgattacggttctatgctacatgtttgccaacgtctgcagacagtattttatctgtattttccagttttgtaattttttctgaaaggagggcaagtccactaccagttattctattaaagtaggaaagatttcatctttcatttttaatataccaaatttacaatattttgtaataaaataatcacttatgatagtccatgtttttatttattactatttgcttttcttagttgtatttaactataaaatagacttcctggaaccaccgcccccaactgccgcatccatgtggatttccctgtgatcctctatgagatgtgagcctcggaagcagacaatagcacctcctgctccagcaagaaactcccaggctcaaggtgtggcttccattaaggagcccaggctggggccacaactctgaataacctctgttggcacataaccttcagctgtgagtggttcagtcctgtgatattggttgggtgttggtttgtgtgtggacaagaggaggttggtggctggtggaggctaatggcagagttagccccctactctccccagccacccctgcaagaagcatggcagggcatataccagtcaggaatgcccagtacctggttccttgcctggtctgctttcctccacgtttgcctggggcctaaccctgctagaggctacagcactttataagcaaggtttgccttcttccagctcctaggctgtgggtgctgtatacaagtaggaacttcctttccttcacttcccttttaacccctagtcagagcatttcagctgttgtttgctacttaattcctcccatgttggacagaggctgggggcagtgccagcctgattcttcccacctacctgccatgtgttcccaccttcagatggatggacagtttgctggctgttgataggagtggggactggacgggggcttcaccctctaccaagggctgggctgatccccctactgcaactagttgttgcccccccacccctagttgaggagttgacagggtgcaggctggggtcaggacaggctgtggatgcttgtgcctatagggagttactccaacccacctattctgtctaatcccccatgcctttgcaccaaggcctctacccttccaattgggagggaactattcaccaccttgtggtaagggacaacatcctaaggctggtgccaatagttatgagtagcctaccacccccttcccctacagtaacctccaccccttcaggatgagtcaagggaaagtactggagctgctgggtatgaaaagaaaggagggaaaaagcataaaaggaatatgaaggtttgtaaatagtccacgatgatgtcatggcagagtctgatttctatatagaggtaacttaaaaaaaaatactgtgcaagatctgttcttctagagtgtgggaaatggcttgcggagggtggccctcagcctagaaagactattgtgctatttgttcaatttcaataaaatgatttatagatcctgaaaataaataaatgaataaaatagacttcttatgtcatttttgacttgatttttgtcaagatcttttatgtatacatataaagtatatatgtataaatatgaatatatatgagtgtatttgtgtgtgtgtgtgtgtatatatatatatatacacaaatatacatacatatctaaaaattgtgtgaaatttttatcccactaaagacaccacatttattttaccaacatttcaatgaaagtatgtatcaagccgggctcagtggctcatgcctgtaatcccagcactttgggaggccgaggtgggtggatcacgaggtcaggagttcaataccaacctagccaagatggtgaaatcccgtctctactaaaaatacaaaaaaattagccgggcgtggtggcaggcacctgcaatcccagctattcaggaggctgaagcagagaattgcttgaacccaagaggcagaggttgcagtgagccaagatcatgccactgcattccagcctgggtgacagagtgagacttggtcaaaaaaaaaaaaaaaaaaaaagagagaaagtatgcatcagattcaaaaatgggagcttggattgcctcatgtactggttgggggctggctgctgaggtatttggctcttataatacagttataatgaacatatgtgtacaggtgtttgtatggacatatgttgtcatttctattgaatgcctgaaagtggaattgctggaatcaaggatcctaccataattactcagcatatatttttatagagtcttctggtggatttgagcaagatggctgagtagactcagccaggtggaacagatgccacagagggctggggatgactggtgcactcctaacagatcttcagaggggaaggcactgacagtggatggaggaaagacacagaagctagcctgaagtgggaggaagctgggaatcctgcatagtgctaccaaagacagggactcattctgggctcccaatgactctggggcagccaatgacttgaactgccaagaagcagcccactctccccatagacttctggaatcctggcaggaagagacccctctgcaactatagacacttgagttggcagagaaagctgcttagagaaatggtaggggcagaacttcagccagtgcagagcccacagggtttcgtgtgggagcatctgtagtggagcatggccagggatgctcatccctcacaggctcaacttgtttccatagaagactttagcactgggagagctgtcaaacctaaattctgtcgagcagtcttgcccattagacagaaccagtctggcctgagcatcccttgttatactggcttctactgaggccccagcttggtaatgcctgcttgcagggcagccttgggtgcccagggtttctgcatcatagctcctgcactggcggattatgcctggctggcagagagctccagtgggacagccccacagccatgcaccagcccgccggatcactccccatagtacagctttctccaggcccaccgcaatcctccacatccctttgccagtgtgtgcatgcatagggtttaccttccctgtcccaccagcacgcatgtgtgtgtgtaccctgccctagctctgctgctacctgaagtgcaccccattcccctgtcccaccattgcgtcaaggccttggcgggcacagagcatcccaggcctgctccagccaacaagctgccattgtggcaacactgtgcctgagtgaaactaggcaccaagagcagtgggcccttctccaccctgagcaatcacagaaggtgcacacagaactgcgtctgcaagtgccccaacaccctgttaacatcatctccagtgtgaccattcacacagtagacaatgggagttccttgccatcccagagccatgctgcctttgctgctgctgtgaatgcccatggggagacaaatgcccttgaacccattagcaccctgctgcagatcatgattatgcattttgctgccctgccactactgctggcacatatgaacaagagtgaattttactgccaccaccctatgaaatgctttggctggcatcacccatcagcgtgtagtgaccagcggtccagaagcacattggctccccctagtgcagcaggcttctaaactcaaggagccagagaaataaatcagggcatgatacaagtccccaaggtttagaacacataagccaagagttgggagctgagttttggccccctaaagtcttccagaaatgtgaccagcagactgaatccattttatacaattaaaccctcaaagacatcaaaaaagataaaagaaaaaaaatcggaagaatagcaacttcaaagattaaaggagcatcaacccacaaagatgagaaagaaccagcacaagaactctgacaacttaaaaagtcagactgccttctttcctataaacaactgcactaaccctccagcaagggttctgaactgagctgagatagctgaaatgacagaaatagaattcaaaatgtagatagaaatggagataacgatgtgcagcagtatgttaaaacacaatacaaagaagctaagaatcacaataaaacaatacaagagcggacagacaaaatatgcagtatagaaaagaatgcaaccaccctgatagtgttgaaaacattctacatgaatttcataatgcagtcgcaaattttaacagcagaatagaccaagctgaggaggagagaatctcagagcttaaagacaggctttctgaaataagacactcagacaagaatggaggaaaaaaatgaaatggaacaaacaaaacctctgacaaatataggattatgtaaaaagatcaaatgtactactcattggtgcccctgaaagagattgagagaatggaagcaacttggaaaacatatttcaagatgtcatccatgagaacttccccagcctggctagagaggctgacattcaaattcagtaaaggcagagaatgccagtaaggtacttcgttagaagttcattcccaacatgcataatctccagattccccaaagtcaaaatgaaagaaaaaatgttaaatctagctagaaagttcagttcacctacaaagagaagtccatcagactaatgacacaactctcagtagaaactctacaagcccaaagaaattaaggggaaaaaattcaacattcctaaataaaagacattctaatcaataattttatatctggccaaactaagcttcataagcaaaggagaaataagatccttttcagaaaagcaaatgctgagggaattctttaccatgagacctgccttacaagagctcctgaaagaagtaacaactatggaaaggagaaatcactacagtcactacaaaaacacacttaaatacatagaacactaacagtataaagcaaccacacaaacaagtctgcataataaccagctaacatcttaatgacaggatcaaatccacaaatatcaatgctaaccttgaatgtaaatagactaaatgccctaattaaatagcacagagtggtaaactggataaagcaccaagatccaatggtatgtggtcttcaagagacccatctcacacccttaggttcaaaacaaagaggtgggaaaaactagcaagcaaatgaaaaacaaaaaagcaggggtaggcatcttaacatctgaaaaaataatctaaactcaaaaagataacaaaagacacaggagagcattacataatagtaaagtgtttagttcaacaagaagacttaactattttaaatatataagcacccaacataggagtacctagattcataaaaaaagttcttagcaacctacaaagggacacactcccacacaataatagtgggagactttaacagcccactgataatattagacagatcattgagacagaaaatttacaaagatattcaggacctgaactcagcacgggatcaaatgaacctgacagaacttccatccaaaaacaatagaatatacattcttctcatctgcacatcatatgtactctaaaattgactacacgattggacataaaataatcctcagcaaatgcaaaagaatcaaaatcacaccaaacccactctcagaccacagtgcaataaaaatagaattcaagactaagaaaatcactaaaaactatacaatgacatgaaaattaaacaacctgctcctgaatgattttggagtaaagaaattaaagcagaaatcaagaagttctatgaaattaatgagaacaaagattcaacataatagaatatctaggacaaagctaagacagtattaagagggaaatatatagcactaagtgctcacatcaaaatttataaagatctcaatctaaaaacctaacatcacaactaaaagaactggaaaacaaacagcaaagaaaccccaaagctagcagaagacaaaaaataaccaaaataaaatctgaaagacattgagatacaaaaacgattcaaaaaatcaacaaatgcaggcaagagtttaaaaaaaaagtaataaaatagatagacctctagataaactaaaagaagaaaagagagaagatccaaaaaaaaaaaacacaactagaaaatacaaaggggatattaccactaaccccacagaaatacaaataaccatcagatactattatgaacacctctatgtacacagactaaaaaatctagaatacataaataaattcctgattacatgtattctcccaagtctgaagcagaaagaaattaaagccctgaacagagcaatgatgaacaatgaaattgaaccagcaatagtctaccaaccaaaacaacccagtaccatatggattcacagaagaattctaccaaatgtacaaagaagagctggtactattctcactgaaactattaaaaaaaaatctaaggaggaggaattcctctctaactcattctttgaggccagcattatcctaataccaaaacctggcagagacataacaacaacaacaacaaaaaaaaaaacaattcaggtcaatatccttgatgaacattgatacaaatatcctcaatgagagtactggcaaactgaatctagcagcacatcaaaaagcttatccaccatgatcaagcaggctttgtatctgggatgcaaggttagtttaacatatgcaaatcaataatgtgatttgtcacataaacagaactaaaggcaaaaactcaacaggtgcagaaatgcttctgataaaattcaatacctcttcatgttaaaaactctcaatgagttaggatttgaagaagcaaacctcaaaataataaaaatcatctatgaaaaacccacagccaacataatacttaatagggaaaagctggaagcattccctttaaaaactggcacaaaacaaggatgacctctcactaatcctattcatcatagtattggaagtcctggccagtgtaaccaggcaagagaaagaaataaagggcatgcaaataaaaagagagaaagtcaaactatccctgtttgcaggtgacatgattcgatatctagaaaaccccatggtctcagtcccaaagcgtattaagctgataagagaaacttcagcaaagtctcagggtacaaaatcaatgcacaaaaattactagcattcctatacaccaacaagagtcaagccgagagccaaatcagaaacgcaattcaattcacaattgccacagaaaaataaaatagcaaggaatacagaaaaccaaggagatgaaagaactctacaaagagaactacaaaacacttgtcaaagaactcagagataacacaaacaaatggaaaaacattccattctcatgtatagaaaaaatcagtatcattaaaatgttcatacagcccaaagcaatttataggtttaattttattcctattaaactgtcaatgaaatttttcacagaactagaaaaaatgattttaaaatttatatgaaaccaggaaacattctgagtagccgaggaaatcctaaacaaaaagaacaaagctgaaggcatcacactacttgacttcaaactgtactacagggctacaacaaccaaaatagcatgggatgggtacgaaaacagacatagagcaatgggacagaatagagagcccaaacttaaggccacacatctacaactatctcatcttctagaaagctcacgaaaccaagcaatgggtaaaacactccctattcaataattggtgctggaataactagctagttatatgcggaagagtgaaactggatcccattcttacgctatatacaaaaattaactaaagatggattgaagacttaaatgtaaaacttaaaactataacaaccctggaagacaacctaagcaataccattctggatacagaaatgggcaaagattttatgataacgatgtcaaaagcaattgcaacaaaagcaaaaactgacaaatgggatctaattaaactaaagagcttctgcacagccaaagaaactatccacagagtaaacagacatcctacagaatgggacaaaattatttcaaactatgcatctgacattcagcatctataagaaacaaacaaatttacaatagaaaaacaaacaatgccattaaaaactggtcaaaggacatgaagaaacacttttcaaaacaagacaaacatgttgccaacaagcatgtgaaacaaagctcatcactgattattagagaaattcaaatcaaaaccacaatgagacattatctcacacctgtcagagtggctattattaaaagtcaaaaaataacagatgcaggtaaagtttcaaagaaaaaggaatgattatacacactggccattcctgaaagacctaacaacagaactaacagttgacccagcaattccattactgagtatatacccaaaagaatataaatcattctgttataaagtcatattcacatgtatgtttattgcagaactattcacagtagcaatgacatggaatgaacctaaatccccatcaatggtagactagactggataaagagcgtggggtacatatacaccttcgaatactatgcagccacaaaaaagaatgagattatgtcctttgcagaaacatggatggagctggaggctattatccttagaagactaatggaggaatagaaagccaaataccatgtgttctcacctataagtgggtgctaaatgatgagaacacatggactcatagaggggaacaacagccactggggcctactggagggttgagggtgaaggtgggagaagatcaggaaaaataactaatgggtacttggcttaatacctgggtgatgaaataatatgtacaacaaactcccatgacatgagctcacctatataacaaaactgcacacatacccctgaacttaaaataaaagttaaaaaaaaatgataacgaagtcccaatgaacatatgttctgtaatatattttgccaagtctagcagagtttcagattcaatagtcagatcagatagcttttgaagtaatgtattgaaaaatagaaacaaaatagaaaatcctgaaataatattcacaaccttaagaagaaaaaaatcatatttaaaaaagaaaaaactcaaactttttaccataacaattgtacaccttaatagaaaccatggtttcttaattgtttggtgcatgggtatatttcttataaatatttgattccttgttattttcttaggaagtcttatcaaaccatatgcatttgtaaataattcagaattgcattagatagaacaaaaatatagaactgtcatacttagtttatttttatcaagaagaatagaaatccacttaaattattttaataaatgataaatgccacatatgttggtaaaggaaagagcaattttgtaggattgcaaaatcaattgtatgactgcataactggagatgaaatgcaatttaggaactgagagtgcccaatcttttgggataataattgtcatatttatctcttggtggcctgtattaaacatctttcattctggcaattccttttctcttgtctttgcttctcctgtacttgttactaccaatgattacttcagtctttacacagtccaacttttttctctatatattgttttcataatacctttgtatttaccacttctgcttactcataacttgacttctctatgagtcactttcagcctttcttattgctagcaactgaaagattctttctccatatttagtagtttggctacctagttcatcacctctcatctgatacaaatttttatgtcaggcaacattataagacattaaagacagtggagattgactgcctttgagccaggtgttccagtcataggttgagtgtggccagtaaaatggttaacaggttccagtgtataacaaccaagacttttctccttgaaaggaggctgagtgtagaataagaattatttcctcagaagggggtgtgttatgggtaggaaccaacttaagaaatattgttcaaaaattaaaaacaaaaattatacgatcatctcagtagatgcagaaaaagcatttacaaatccagcatccatttatgattaaaaccctcagcaaaatctgaagggtcatatcttcaggtaaaagaaaaaaaaaaagccatctgtgacaaacccacagtcaacattataatgcaaggggaaaagttgaacgcattccccgtggaactggaacaagacaaggatgcccacttttaccacttctatttgacatattactggaagtcccagctagagcaatcagacaagaaaaagaaataaagggccttcaaatcagtgaagaggaagtcaaaccatcattgttagttgatgatataatcctatccgcagaaaaccctaaggactcattaaaaaagctcctaggtctgattaatgaattcagtaatttcaggatacaaaatctgtatacacaaatcagtagctctgctatacaccaacagtgaccaaactgagaatcaaaccaagaactcatccccttttacaatagctgaaaaaaaaaattaaaatacttaggaatatacctaaccaaggaagtaaaagacctctacaaagaaaactacaaaaacgctactgaaagaaatcatagatgatgcaaacaactggaaacacatcccatgtccatgaattggtagaatcaatattgtgaaaattaccatactgccaaaagcaatatacaaattcaatgcaattcccatcaaaatgccatcatcattctttacagaactagaaaaaacaatcttaaaattcatatggaaccaaaatgtgcccacttagccaaagcaagactaggcaaaaaggacaaatctggaggcatcacattccagatgtcaaattatactacaaagctgtagttatcaaaacagcatggtactggtataaaaataagcacttagacaaaggaaacagaatagagaacccagaaataaagcccaatatttacagccaactgatcttcaacaaagcaaacaaaaacataaagtgggagaaggacaccctattaaacaaatggtgctcagataatacacaagtcacatttagaagaatgaaattggatcctcatccctcacattatacaaaaatcaactcatgatggatcaaagacttaaatctaagacctgaaaccacaaaaattctagaagataacatcagaaaagcgcttctagacatggacttaggcaaagagttcattaccaagaaccaaaaagaaatgcaatagaaacaaagataaatagatgagacttaattaaaaagcttcctcacagcaaaaaaaaaaaaataataataataatcagcaggattaacagacaacccaaagagtgggagaaaatgtattcaaactctgtatgcaacaaagaactagtatccagaatctagaaggaactcaaacaaatcaacaagacaaaaaccaaataatcccgtcaaaagtgggcatgaatagacagttctcaaaatgtaatgaagacatggaatcaacctaaatgctcatcaatgatagaatggatcaagagcatgggggtacatatacaccatgaaatattatgcagccatgaaaagggatgagatcatgtccttcacaggaacatggatggaatggccaagaaacatcaaaaaaaaaatgcttagcatcactaatgatcagggaaatgtaaatcaaaactgcaatgaaatcccaccttactcctgcaggaatagccataattaaaatgaaaaaaaattgtagatgttggtgtggttttggtgaaaagagaacacttttttcactgctggtgggaatgtaaactagtacaaccactatggaaaacagtatggaaatcccttaaagaactaaaagtagatctacaatttgatccagcaatcccagagaaaaagaagtcattccatgaaaaagacacttgcacccgcatgtttatagcagcacaatttgcaattgcaaaaatatggaaccagccaaaatgtccatcaatcaacaagcagataaagaaaatatagaatatatataccatggaatactactcagccataaaaaggaaagaaagaatgcctttcaccaaaacttggatggagttggagaccattattctaagtgaagtaactcaggaatggaaaaccaaacattgcatgttctgacttgtaagtgggagctcaagctatgaggatgcaaaggcataagatgatacaatggactttggggactcagggggaagggtgggaaagaggtgagggataaaagactacacattgggtacagtgtatacttcctgggtgctggatgcaccaaaatctctgaaatcaccacagaagaacttatccatgtaaccaaacaccacctgttccccaaaaactattgaaatatatatatttcagaggtgtcttcagcctttacattttctcttcagtgtgttttattctgtaagactggctttctctataaattgaagaaaatatccaccaatagctcttatattcttatgtctttctgactagaaagaaaaagactctttactgatacctccagttagaaaaatctcaaaaaaggctagttgtctcagttccatttatgtgcccattccttgactatgaatgatgcctgtggtagtagtagtagggtcacataaaacaaaggcaatttctattctgtctatatagctaaagtggagggatgagaaacagttcctcaaaagaaatgtggaaaaacaaggtaaactatcaatataatctaagagtactgtaataactgaagttatatattaacatttgttcttcttttcctgatcatttgcacattcataacatgtttatacactagtatggatagaaaatttaacttttctaccataaagacacatgaatgtgtatgttcattgcagaactattcacaataatgaagacatggaatcaacctaaatgctcatcaatgatagaatggatcaagagcatgggggtacatatataccatgaaatattatgcagccatgaaaagggatgagatcatgtccttcacgggaacatggatggaatggtcattatccttaccaaactaatgtaggaatggaaaaccaaatactacatgttctctcttacaagtgggagctaaaagatgagaacacatggacttatagaggggaacaacagacactgggtcctacaagaggatgaagggtggaagaaagtgaagaattagaaaaaataattaacgggtactatgcttaatacctgtgtgatgaaatgaatgatttgtagaacacaccttcatgacatgaatttacctatataataaacctgcacatgtacccctgaatgcaaaatgaaagttaaaaaagaaaataatttatatctttacaaaattgagtcttagtatgcatgagcatgaagtataccttcattcatttagacctttgggtttttttcacacatacactcagtttttaactagatgtgtatacatgttttgtgtatccatttaatcactgatggacacgtgagttgtttccacattttggccactgtgaataatacttttaacgacatgggtatacaaacatctcttcaagtcattgttttcaattatttgggtatacacccaaaataaggatttgctggattttatggcaattttatgttggattttttaggggccaccatattattttacttacctgttacactattttccatttccaccaactatgtggaagaattccaatttctctacatccttccaaactcttgttattttatgtttttgatagtagctatgctaataggtatgaagtcgtatctcattgtggttttgaattgcatttatccaacaattactgacatcaggcactttttatgattattgacaatttctatattttcaagtgttttgcatatatctttttttttttttttttttgagatggaatctcgctctgtcacccaggccagagtgcagtggcacaatcttggctcactgcaacctacacctcccagattcaagcaattttcctgcctcagcctcccgagtagctgggactacaggtgcacgccaccatgcccagctaattttttgtattttggcagagatgaagtttcaccgtgttgcccaggctggtctcgaactcctgagctcaggcaatctgccggctttggcctcccaaactgctgggattacaggcatgagccactgcacctggcctgcatatatcttaattaggctgttttcaggatttccttgttgttgttgggttgtaggtgttctccatatattctgtatattaacatcttaccagatatataacttgtagatgttatgtcttattaggtgtgttgtcttttcctactgttgattgtgttctgccttagtggcaccaccctagtagattatctctgtgagtactgcacccctgcagcaggcttctgcctaccaggcttttccatacatcttttgaaatctaagcaaaggttgccaagcctccttcattcttgcactctgcacacctgaaggcttaacacgatgtggaagccactaaagcttacagcttgcgtgctccagagttgtggcatgaaatgtacctggagccctttgagccgaggctacagccagagcatccatgatgtaaggagcagactcctggcatgggacaaggcagtggcaccccaggcctgccccccaagacattcaatccttctgggcctctgcgcctataatgggaggggctacctggaagatctctgaaatgccttggaggccctttttttttcactgtcttggctaccagcaccggcctgttttttcagtcatgcaaatctttctaacaaatgattgctccacagtgtgtttggattcttcccctgtaaaaggtttttctttgccacatggctaggcagcaaattttacaaactttaatgctctgcttcccatttaaatataagttccaattgtaggtcatttctttgtattcgtatctgatcataggctgttagaagaagccaggctaattcttaaaatgctgtgcagcttagatatttcttccgacacatactctaaattatcagtctttttttttttttttttgaggcagagtcttgctctgtcacccaggctggagtgcagtggcatgatctcagctcattgcaacctctgcctcccacattcgagtgattctcctgcctcagcctcctgagtagctgggattacaggcgtacaccaccaagcccagctaatttttgtattttttttagtagagacagggtttctccacattgtctaggctggtctcgaactcctgacctcaggtgatccatctgccttggcctcccaaagtgctgggattacaggcctgagccaccatactcgatctaaattatcactctttttttcttttccttcgagacagagtctcactctgtcgcccaggctggagtgcagtggcgtgatctctgttctctgcaacctccgcctcccaggttcaagtgattttcctgcctcagcctcctgagtagctgggattacaggcgtgtgccaccatgcttggctaaatttgtatttttagtactaaatttgtatttctagtagagacggggtttcaccatgttggtcaggatggtctcaaactcctgacctcatgatctgccctccttggcctcccaaagtgcagggattacaggtgtgagccactgcacccagccacttatcactcttaagtacaaacttctgaaaattactaggacataaacacaatgcagccaagttctttgctaaggcataacactagcgaactttgttccaattcccaaaaagtttctcattttcattggagacctcatcagtctggatttcactgtccatatcactgttatcgaaaagaaggtcttgatccagaccccaagagaagatgcttggatctcatgccagaataaattcaaggtgagtctcaaagtatagtgaaaagagatggtttattaaaagctactccattacagagtagggcatccttagaaagtaagtggagaaatgcaccctctctctatatatatatgggtattgcttatgaaaaagctaatcaaaggtatgcccatgtgcaggtggggtgacagcatgacaaaatttattattgtattgatttaaggaaaactaccctcgacaatttagcatgcaagtaaaacaaagcatacctatagttaccttgaaaacatatattattatgggtattgggacctctggactttcttctgttgtaggagtgtgtccttgtaggtatctttaggctgtatcctcaaccataaatattctaagaccacgggtcatgactgaaaagaaatgtgccttgctagttttaagatgaagttgattttaaaatggtgtcactctggttctcctaggctcctgcttccctcacatcactatcagggttttgctcacaacaatttaaccagtctctaagaactttctaattttctttcatctttctatcctcttctgagccctccaaattcttccaacctctgcccactacccaattccaaagttacatccatactttcagatatctttatagcaataccccactccttggtatctattttctgtgttagaccattcttgcttgctacaaagaactatctgagactgggtaatttataaagataaaaggtttaattggctcatggctctgcagactatacaggaagcatagcactggggatgagctcagcttctagtgaggcctcaggaagcttatgatcatggcagaaggcaaagggtgacccagcatattacatgcaagagtagaagcaagagagagaggcaggtggtaccacacacttttaaacaaacagagatcgtgagaactcactgactattgtcaggacagcaccaagccatgagagatccacccccatgaccgaaacacctcccaccaggccccactctcaacattggagattacacttcgacatgagatttgggtggggaaaaacatctaaactatatcagctggtttctggcattcttaaaaaactattttggcctacatattgttctcgtgatgcttccatgggaaagttaagtcctggagcttcctagcccaacatcttgctgaagtcatgctccaaagagatcatcttttgtctatggttccatagtaatacatttgtcatagatttaaatatccataatttgtggagttgttgctggactcgacaatttactattggtctatttgtctgtccttgttacaatgctatatgcttcagttttacaactactctttttttttttttttcctcccccgagacggagttttgctctttcacccaggctggagtgcagcggagcaatcttggctcactgcaacctccaccttccgatttcaagtgattctcctgcctttgcctcctgagtagctgggattacaggtgcctgccaccatgcccagctaatttttgtatttttagtagagatggggtttcaccatgttggccatgggctcaaattcctgacctcatgatcagcccaccttggcctcccaaagtgctgggattacaggcatgagccaccgtgcctggccataactagtcttaatatgtcatagcatagatttgccaacttttgattttttatttttatttttttgtgtgtggtcgtccccttccttctttccttcttctctttctgtctctagaattacttagctgtttctggtgctttgaatttcaatattaggttaagaatccatttttcaatttccactaaaaagcgttagaattttgattggtatcctattgaatctatttgttaatttgagaaagatactgaattttccattccttgaacacagtatatttcctcatttatgtatgacttttaaatttctctctgcatggtgtttaaaatgttagtgtagctgtcttgtacatcttttccttatatgtcatccttggaattttatgttttttggtcacattgaaaattgtacattttgaagatttgttgcttattaaaaatcatttttgatcagttaatctgcatccactgaccttaataaattctcactcaataatttatttgattatttttattttgaacatacacagaaatgtgtttgtgactaatgagaattttatttcaattctttatttttttttgttattgttttttcttcttgtcctgatttcatagtctgttagggctggtatatttttggtttgtcctcatttctgaagtataggctcttaaaactttcaaactggttatctggtatgttgatcaagttgagttaccagataaaatgcaggagagccaattaaatatggaagtcagataaacattaaataatttcaagtgaaagtatgtcctaagtattgcatggtacatgcttacactaaaaaataattgctatttagctgaagttcaaatttatcgaggcatgctggacttttatttgctgattgcagcaatcttattaccaagattcatcctattttctcatccttaactgcagtatttttttctctccaactctgtgagattgctaagagctatatttggcttcccaaccctttgcttgtagctttctcttgtttttctctcaacttgttcttagcctcttagcctcctgtcaattatggaatggaaaatgtattggggacaaattgctacagaatattgggctgacttcaatgtgcttccctttcctgtgagatcttggtcttgaaatccttggaaaacttggtaactctgtgacagtattaagtatatgtcgtctacattgggtaatgcttctctagttattaatactggcagaatcagtctaaaacagtctacattaatattactgaaaaaagtaacctttttcttaaaacattatttgaatattcaagtaaaaccatttgaggtagaatttcatttttgctcagtttctctagtaggtgcacgataattcaaactatctatgttttattttcagtcagttttatatatgacattttaagagaagtatatctcagttgactgaattttcattttattgctgaaaatatatcacaatttcttactgtctttaaatatctgctctatttgtacttatgtgcctttttatgttcctaacattttttgatatgccctttctcttatttttctttatcagtttgaccagtgttttccatattattaaacttttaaaagtactaactcttggctttgtggattcttattctatgaagcatttattttctgtgtgatagattcttgatattctcattattttctcttttattctactttctttacattgattttcttattactttcaaacttctgaagttaggtatatattttagtgtttgttattttttaatacttatcattaagattataaatgttgctaaaagtaacattttgctgctgcatcttgaaaagttttataagtaatatttttattatctttcttttctccatagttttaaaatttcattacaactaattttttgaccaagaaattattgtgtgttttaaaatttctataaatatgactttttagggaatgtgcttaattgattatatcttaattgtagtgtggtagcaaatatgttatttatgattttttggttgaaatttgtttacatcataatctaaaatgtgaattttttaaattgtcttccttgtatgtttgaggataatgtatcttctctaatattttggtacagaatgctacatatgttaattatattataattgttaaatatatttatacaattttctctacatatacagccttttagataacttgatctatcaataatgtagaattagtctccaactattgtggcatgttatttcaactttttcctatcaacatatcaattatggcttgatatattttgagaacttattaggtgaataagtatatcaaattatctagagaaacagagctaatagaatgtatttctgtgtgtatgtgtgtgtctacacgcacatgtataaatgaagagagagacagagagaaagagagacagatttattttaagaaattggctcatgtgattatagtggttggcaaaaccaaaatctgcatgaggggctgctggctggagatccggggagaagccagtgttgcagctccagtctgaaagccatcaggctggagagccagggaaaatcttatattggtgttccagtccaaaggtcgtgtcttggaagaattttctcttgctcaggggaggttagtcttttgttctatccagtttaagtgattggattaggtccacccatattagggagaacaattttgtttactaaaagtccaccaatttaaatgttaatctcgtccaaagttatcttcctggagacatgcagagatatatttgaccaaataactgggcacatcggttcaaacaagttgatacataaaattaaccattataagaagcttagaattgttatattttggtaattaaaattttatcattatttgcaactctctttgttcttaataatgattttgtctgatattagctttcttttaattagtattttcttagtatacctatttcatgctttaacttgtaacccatctgcatctttatacttaagaactgtctcttgtaaagacctttatagctatagcctttacaatgctgtctgattatctcttacttacttggtgaatgtaatctacgtatattttattgcaatggtcattattattatgaggcttatttctgccattctaattttatttgtatttgttctgcattttctatatgcttggctttttatctatttagtttttgtctacttttgttcttttcccatattttccacttacttggaatttatcttcttcattatttaagtaattttcattgtatttttaccaaaataaatgtatcagtaattacataattgcacaatcacaaatctcaatcaacctaaaaaatgcagaaaacatgaaaacaagcaaaacaacacagatatcaaaaagtaaatttatcttgcctcaccttcagaatagtataaagaactcagaacactttaatccaaaacatttgcatcctgattcatgtactacttttgtctcctattttatttttgtttttctctaacatcatgcattacaaattatttttattaattaaaaaatcagtttgagactaggcacggtggcttatgcctgtaatcccagtacgttgggaggccgatgtgggtggatcacttaaggtcaggtgtttgagaccaacctggccaacatggtgaaaccccgtctctactaaaaatacaaaaaaaagaaaaaaaaaaaaaagaaaaaaaaaaaaaagctgggtgtggcggtgcacaacctgtgcaacagagatgctgtctcaaaaaaaaaatcgtttgaatttacacacctgtttatcattgtatttcatcactactctgcatctcaaactattcgtctaacatcagctgttaatccttagaaagatgatttagtacactatctttccttttttctttgcctgaaaatatccttattccaccattattttaaatgtattgatttgctgggtatatgtatcagttgtctgcttttatatcacaaaacagcaccatatattttatcagatgatcataatatgaatcatcaacttgagttatgtttagtgggatggttcttttgctgatctcatctgaggttaatcatgtggctgtgctcagcttgtggattagcttgggaatgttagcctaggataggaattgtaaatctcagaacttttgacattttgagttgtataattttatgtttcgtgggactttcctatgcattgtaaaatgtttatgatattcacagcctctctctattacatgccatgtaactcccaaaattgtgacaaccagaaatgtcttcacatattgactagtgtcttctgacatttctggctgagagacatttaggattttaattcttattgctgctgtaacaaattagcaaacagtgatttaaaatcaaagaaagaggcagagcaagatgacagaatagaaggctccactgatcatctccaccacaatgactaatttaacaactatctccacagaaaaaaacaccttcataaaaaccccaaatcaggtgacttctcacagtacctggttttattttcatatcactggaagaggcactgaagaggtagaaaaaaaagttctgcatcccgatgccaccccttcaccaccgccaacagcagcagtgcggtggtaagaagagcatctctgggcactagggaaggaagggcatggcaattgcaaggcattgaaatcagtgccgtcctgttacagcacaaaggaaagtctgatcaaactcagctgatgcctgtccatgaagggagcatttaaagcagccccagccagaagggaatctctaataccagcagttggaaggtgagttccttcaaacctcgccaccaagggctaaactactctgggtctgtaagaaaacttgaaaggcaatctaggccataaggactgccactcttaggtgattcctagtgctgaactgggccgagagacagtggactaggagagcaggtgacttactgagacttcagcccagctgggccagctaagggagtgctggcatcacccctctcctaaccccaggttgcatagctcatgggtccaaaagaggcctcttccttttgcttcaggtgaggagaaggaagagtggggaggactttgtcttgtatcttggatactggctcagccccagcaggatagggcaccggcaagggtttggaggaccccattccaggcactagctcctggatgacttttctagacacactgtgaaataaaagaaaatgtgttgactttaagggaaagactcagtcctggcagcattcatcaactggtaaataaaaagcccttgggccttgaataaccagcagggatactcaagtactaccttgattactttgagtgagctctaaaacttgctggcttaaggcgagactcagcacattaccagctgtggtggctacaaggcaaaactccttctgctcaagcaaagggaaaagaaaggagactttgtcttgcaccttaggcaccagcatggccacaggagggtagagcaccaaatgagcacttgaggccctgattccaggatttgatacttgagcagcatatctgcacctgccctgggccacaggggagcccactgtcccaaaagagtaagttctatgccaggcagcatttaccacaagatgacttaatagcgcttgggatttaaggttgcatcagtggtagtctgacagtattccccatggcctgtggtgggggtggctaggcattttgtggcttgagtgtcacctcagctgcagtacaatagaacactggtggatttctaaagcttttgactctagtagtttctgactcccagctgccacctggacccactcagggcctgggataacttgttgccctaaaggaaaaaagacaggcctggcttcctttgccatctgctcattgtaggtacccaggtccttgaacaaatatatgcagtagtcagggaggagttacaacaggccttgagtgagactcagtattgtgctggcttcaggtctgatgcagtgtagtcatagtggtgttgaccacaggtgtgccagatgtcactccatcgccagctttatgtcacttagaacagagagagagagcgagactttgtttggtggacaacaagtgaagagaacaacaacctttgcctggtaatccagagaacctgtccagatctagtctaagaacaacaaggtggtatctccaagagtctgcaagaaccacagagttcctgagcttgggtttccctctaaagcaggtaaagcttagatcacatcacccaagttctttcaaatatctggaaagcctttccaaaagggacaggtacaaacaagcccagacagtgaagactaaaataagtatgtaactctgcagcacccagacaccaaagagcatctgcttacatcaacactatccaggaaaacatgacctcaccaaatgaaataaatagagaccaatcttgaagaaggaggtatgtgacatttcaaacagttaattcaaaataactgtgttgagaaaactgaaagagactcaacataacacagagaaagaatttagaattctatgaggtaaacttaacaaaaactttgggataattaaaaagaatcaaccagaaattctggagctgaaaaattcaattgtcatactggagaacatatcagaaccttttaatagtggactcgatcaagcagaagaaagaattagtgagttttaagagctatttgaaaatgcagtcagaggagacaaaagaaaaaagaataaaatacaacgaagcattcctatatgatctagaaaataccctcaaaagggcaaatctaagagttatttagccattaagtgaaggtagagaaagagatagaattagaaagtttactttaaaagataacagagaaattcccaaacctagagaaaaatatcaacatccaaatacaagaaggttataaaacaccagacaggtttaacccatgaagactatccccaggcatttaataatcaaattctcaaatatcaagaattttttttttacaaaaggatcctagaaacagcaagagaaaagaaacaaattacatacagtggagctccaatatgacggacagcagactttttagtagaaaccttagggtccagaagagagtagcatgccatctttaaagcgctgaagtaaaaaacaaaaacaaaaacaaaaactttttaccctagaatagtatacgtggcaaaaatatccttcaaacataaacgaaaaacaaagactttcctagacaaacaaaagctaagggatttaatcaacaccaaacctagcctacaagaaatgctaaagggagtacctcaatcagaaagaaaaggatgttaatgagcaaaaaataatcacctgaaggtacaaaactcactggtaatagttaagtacacacacaaaaaaacacataatattataacactgtaactctggtgagtaaactctcttgtcctaagcacaaagactaaataataaaccaatcaaaaataataacttttcaagacacagacagtacaagaagatataaatcaaaacaacaaaacataaaagaggaggaacaaagttaagacgtagaatttttatcggctttcttttggcttgtttctttatgttatagtgttaagttgttatcagcttaaaataataggttataatataatatttgcaagcctcatggtaacttcaaactaaaaaacacacaatggatgcacaaaaaaattaaaagcaagaaactaaaacatattacaagagaaaaccaccttcactaatggaaaatatggaagaaagaaagaaagagagagagggagggaaggagagggcgagggagggggaaggggaggggggaagggggaggggagaggggagggggggagggggaagaaggtgggagggggaaggggaggagaggagaggagaagagaggagaggaggagaaagaccgcaaagcaaccttaaagcaaacaaacaacaacaaaaagtggcaggagtacgtccttacttatcaatagtaacattgaatattaatgtactaaactcggcccggcacggtggctcacacctgtaatcccagcactttgggaggccaaggcgggtggatcacgaggtcaggagatcaagaccatcctggctaacacggtgaaaccccgtctctactaaaaatacaaaaaattagctgggcatggtggcgggcacctgtagtcccagctactagggaggctgaggcaggataatggcgtgaacccaggaggcagagcttgcagtgagcagagatcgcaccactgcactccggcctgagcgacagagcgagactccctctcaaaataagtaaataaataaataaataaataaataaataaataaataataaaatagataaaaataaaaatgtactaaactcaccaatcaaaaggcatagactgcctgaatgaatgaaaaaaaaaaaatgacccattgagctgctgcctataagaaacacacttcacctataaagacatatatatcctgaaaacgtagggatggaaaaatatttcatgccaatggaaaccaaaatatagcaggagtcgctatatttatatcagacaaaataaattttcagacaaaaactataagaagagacaaataaagtcactatataatgataaaggggtcaattcagcaagaggatataacaaatttaaataaatatggtcccaacactgaagcaaccagatagaattaaaaaatatcatcagagcttaaagagagacaaaagtttgaataccacaatagctggagacttcaacatcacacttttcagcattgaacaaatcttccagacaaaaaagaagcatcagacgtaatctgcactatagaacaaatggatataatatgtatttacagaacatttcatccaatggctgcagaatacacattcttttcctcagcacatggatctatgttaggtatagtatagaccacatgttaggtcacaaaacaagtcttaaaacactcaaaaaaattcaaattgcatcagccatcttctcttaccacaataaaataaaactagaaattaaaaacaagaggaatttttgaaactatacaaatacatgcttgtgaatgacaagtgggtcaataaaatattaagaaaaaattgaaaaaattgaaacaaatgataatggaaaaaagcatacaaaaacctatggtatatggcaaatgcaataaaagggcattgaatagctacaagtgcctacatcaagaaagaggaaaaacttcaaataaacaatctaatgatgcatcttaaagaactggaaaagcaacagcaaaccaaacccaaaattagctgaagaaaagaaaaaataaaaatcaaaacagaaataaaggaaattgacataaagaaaacaatacaatagataatgaaacgtgaaacataaaaatggtttattgtaaaacaaaattgacaaattttaaccagactaagaataaaagagagatgatccaaataaataaactcagacatataaaagtagatgttaccactgatattacagtaattaaaagaagcgttagtgtctcctatgagcaactatgtaactatggattggaaaatcttgaaatggataaactcctagacacataccacaatcaaaataagaagaaatccaaaacctgaacagactaacaagaagcaacaagatcaaagccataataaaaagtcttccagtaaagaaaagcccgggaccctatggcttcactgctgtattctaccaaacatttaaataagaactaataccaatcccattcaaactattccggaatatagaggaggaggaaatacttctcaactcattatatgaggtcagtattgcccaaaaccagagaaagacacattcaaaaaagaaaactacgggccaataactctcatgaatactgatgcaaaaatcctcaaaaaaatacttgcaaaccaaattcgacaatacttcagaaagatcactcatcatgaccaagcgggatttatccctgggatgcaagaatgactcaacatatgcaagtcaatcagtgtgatacatcatgtcaacataatgaaggataaaacaatatgatcctttcaatatatgctgaaaaagcatttgataaaattcaacatccctttatgatgaaaaaaaaaccttcaaaaactggttattaaaggaacacacctcaacataatataagccatatatgacagacccatagctagtgtcataatgaatgaggaaaaactgagtctttatgagattggaagatgataaggatgcccacttttgccagtgtcattcaacatagtatggaagccctagctagagtattcagacaagggaaaaaaataaaaagcatctaatctggaaaggaagaagtcaaatgtatcttgtttgcagatgatatgatcttatacttggaaaatcctaaagactacagaagaaaatgattagaactgatatgttcagtaaatttgtaagatacaaaatcaatgtacaaaaatcagtagcatttctatatgccaacactgaacaatctgaaaaagaaaaagtaatctcatttacaatagccacacataaattcaaatacctagaaattaaccaaagaagtgtaagtagatacaatgaaagctataaaacattgataaaagaaattgaaaaaaaaattctatgttcctgaattaaaagaattaatactgttaaaatgtccatactacccaaaagcaatctacagattcaaggcaatccctattgaaatcccaatgacctttttcacaaaaatatttttaaaaaattctaacatttatatagagccacaaaagacccagaatagccaaaacaatcctgaataaaaggaacaaaactggaggaatcaaattacctatttttaaattatactacacagctatagcaaccaaagcagcatggtacttgcataaaaacagacacatagggccaggtgcggtggctcacgcctgtaatcccagcactttgggaggccaaggcgggtggatcacgaggtcaggagatcaagaccatcctggctaacacggtgaaaccccgtctctactaaaaatacaaaaaagtagctggatgcggtggtgggcgcctgtagtcccaactactcgggaggctgaggcaggagaatggtttgaacctgagaggcagagcttgcagtaagccgagattgcgactccgtctcaaaaaaaaaaaaaaaaaaaaaaggcagacacatagaagagtgaaatataatagagaacacagaaacaatccacacatctacagtgaactaattttcaacaaaagtgccaagaatatacactggggaaaagatagtcttttacatcagtggtgctgggaaaactagatgtccacatacataagaataaaactagaacactgtctctcaccatatacaaaaatcaaatcaaaacggattaaagacttaaatctaagatctcaaactatgtaactaccaaaagaaaactttgggaaaaatttccaagacattggtcagggcaagtatttcttgagcaatactccacatgtacaggtaaccaaagcaaacatggacaaatggcatcacatcaagttaaaaagcctctgcacagcaaaggacacagtcatgaaaagaagagacaacccacagagtgtgagaaaatatttgcaaattactcatctgacaagggataaataaccaaaatatataagaagttcaaagaactctacaggaaaaaaaaaaaaaatatatatatatatatatatgtatatatatatatatataaataatagttctactaaaaactgggcaaaggatatgaatagatatttctcaaaagaaaacatacaaatgacaaataagcataggaaagggtgcccaacatcagtgattatcagagaaatccaaatcaaaactacattatctcatctcagttaaaatcgcttatataaaaaaagcccaagcagtaacaaatgctagtgaggatgtggagaaaagggaactcctgtaagctgttgttgagaatgtaaattagtacaaccactatgaataacagtgtagaggttcctcaaaaaactaaaactagagctaccatataatccagtaatcccactgctgggtatatacccaaaagataggaaatcagtacattgaagagatatctgcactctcatgtttgttgcagcactgttcacagtagctaagatttggaagcaacctaagtgtccatcagcaaatgaacaggtaaagaaaatgtggtgcatatacacaataaagtactattcagccgtaaaagataatgagatcctgccacttacaacatggatagaaatggagatcattacgttaagtcaaataagccaggtacagaaaaacaaatatcatatgttttcacttatttgtaagatctaaaagtcaaaacaattgaactcatggagaaagagagtagaaggatgattactagaggtggggaagtgtagtgaggagttggggaaaggtggcaaaggtttattggcacaaaaaaaattaaagtataaacaaggtctagtattttatagcacaacagggtgactacagttgataatatttttcatcttaaaataactaaaagaaggtaactggattgtttgtaacacaaagggaaaatgaattgattgatacatcgttctccatgatgtgattatttaatactgcatgcttgcatcaaaccatctcatgtacctataaatatatacacctactatatacccacgaaattaaaacaaaagatacaaaaaataaaacaacccaaatttcaccacaaaataccccaaattgctaaaaaaaaaaaaaaaaaaaaaaagaaagaaaagaaaaatcctgcacaaaaaaaaaagcaatgctggaacaatgctggaggtattgcactgcctgatatcaaactgtactacaaagttgtcatacccaaaacagcacgtcatacaaaccagacacagaacaatggaacagaatagataacacataaataatccatgaacttacagccaactcattttcagcattgcaccaagaacatacattggagaaagaacagcctttttaataaaatgatgctgggaaaactgaatatctctttcaaaagaataaaactagatccccatcttttgatatgtaaaactagtaaactcaaaatggactaaagacttaaatgctaggcataaaaattcgaaactaatatttttagggtaaaatctcaaaagaacagaaaacaaaagcaaaaatagacaattgtaatgacctcaaaataaaaagctttcacacagaaaaacacacacatgtaaacacacacacacacacacacaacaaaaaacaaaaaacaattaacatggtgaagagattacctgcaaaattggattacatgttaacaaactatataacaagatattaataaccagaatatataaggtactcaaactcaatagcaaaaataataatccctttaaaaagtaaacaaaggccaggcacggtggctcacgcatgtaatcccagcactttgggaggcccaggtgggcggatcacgaggtcaagagatcaagatcatcctggccaacatggtgaaaccccctctctactaaaaatacaaaaattagccaggtgtggtggtgtgtacctgcagtctcagctactcaggaggctgagggaggagaatcgcttgaacccggaaggaggacactgcagtgagccgaaattatgccactgcactccagcctgctgacagagcgaaattccttctcaaaaaaaaaaaaaaaaagtaaacaaaatagattaatacatatttctcaaaaaagacatgcaaatggctaagctgtatgaaaaaatactcaacactaatcatcaggaaaacgcaaatcaaaaccacaatgaaatgtctcaccttacctagaatggaaatcataaaaaaaaaaaaaaaaattacaaatgctggcgaagatgtgaagaaaacagaatgctcctacacttttggtgggaatgtaaagtagaacagccattatggaaaacgatattgaggttcctcaaaaaactaaaaatagaactaccataagaaactcactgcgaggcattatatatccaaaggaaagaaaataagtatataaaagagatatctttactctcatgttttcttgcagtactattcacagtagccaagatctgaaatcaacctgtgtccatcaatgaatgaatggataaggaaattgttatatatatatatacaatgaatattattaaaataattttaaataaaatagtagaatcctgtcatttttagcaacatggatggaacataaagacattatgttaagtgaaaaaagtcaggcacagaaagacaaatactgtatattctcattcataagcagaaactaggaaagtggatctaataaagacagagagtaaatggggttatcagaggctgtgaagaaaaggaaagtgataaagagaaattggttaatgggtacaaaaatacagttaggagtaagtcctattgttggatagtacaatagaaaattatggttaacaataatttcttgtatatttcaaaatagctagaagagaagaattgcagtgttcctgacacaaataaaaggtaaatatctgaagtgatgaatatcacacttaccctgatttaattattatgtattgtatacagatatcaaattatcacatgtaccacaaaaatatgtacagttatgatgtacaatttttttttttttttgagatagagtctcactctgtcgcccaggctggagtgcagtggcgcgatctcggctcactgcaagctctgcctcccgggttcaggccattctcctgcctcagcctcccgagagctgggactaaaggcgcctgccaccatgcctggctaagtttttgtatttttagtagaaacggggtttcaccgtgttagccaggatggtctccatctcctgacctcgttatccacccgcctcaacctcccaaagtgctggctttacaggtgtgagccactgcaccctgccataaatttttttaagaataaaaaaaacccacaaaaatatgtacagttacgacggataaattttttaaacagtaaaaacataaagaaacccaaatttttatcttatagctctggtgctcagaagttcaaaatgaatcttactgggctaaaatcaatatgctggtggagaagtgctatttcttgggactctagggaagaacctccttacattttctagcatctagggattacttacattccttggtttctgggtctttcctccatctacaaaaccagcaatattagcatctttctcccatttttttctctctgtgtttctgttgtcacatctttttggctcttttagggatatttttgatgacattaggaccactgggatattgcaggacaatggcctcatcctaatgcccttaatttaatcacatatatatttaaagtcacttttgctatgtaaggcatcatatttatacattccagggattaagatgtggatggtttagggagggaattattttgtctaccacaactgatctaggaggatctcacttgagattatttgtttctgctccatatgtttttatcttttagtaagctctcccagactttttcacatgatagaggtagagattccaacggtaagaacctaagccccaatgatcaagtgctttttaagcctcagatttgataaagtctaactgtcaaatcaaatcacagaaccaaccccaaagtcaatatggaagagagtgtacaaggacatggttatagggatatagggaggaaaaaataatttggcacaattactaaaaatttaaaacagtacagtaatttatattgagttactttctctcagaactttgatatgatttcactgtattctagctgttaatgttttaaagaagttgtaattacaattattgtttctttttagataccctttctttccaaatgcttgggtgtgctgtggtttctagacctgtagtcctgtctttatcagttctagaaaatttttcagccattatctttttaaatattgcttccccttaaattatttcagttcttttttttttaaaaagtgctcttttatttaagtgaataattagtgtttacattgttattatgtttacattgttagttgtagcaccaattagtgactgtgattacatttgttttgttttatggcattttcatttttctggaattattaatagcctgattttcaattgtgccatttcaattttgcaatttgcaatctacatattaaaaactcttccccagttttttctgatatcaaaggcttttcttgagtctctctttcctctagattctttacttctaaagcccttggccgtcttgatctaatctaattaatcaaatttgcaacttctttcttttgtctctgtgactttaaagccaagtgtcaattgagacatgttattatgtttttgccatagtataaaaatgtatataaagactgtaatatgtttaagagacatgaaagaaagcacatatgtatgtgaaagaaaataaattttctgagtcctctagacatttgtgtctctaatgcctacttctgacaaacttagacaatgccgaaagctttgaatgactcttcaaaggcataataatgatacattgggctttggggacttggggaaagggttgggagtggcaagggataaaagaatacacattgggtacagtgtacactgctcgggtgatgggtgcatcaaaatctcagaaatcaacactaaagaacttattcatgaaaccaaacaccacctgttccccaaatatctgttgaaataaaaagattaaaataaaaaaaaaattatcgtctaacaattatctttagagaggacctgaaagtcaaaaacaagatgctaaaagaaccaatgaaggacacaaagaactcttgtaaatgaaaaagatagttgttaaaataaaaattgtaatggcagattttgatgataaagttaaagaaatctcccaaagtactagaaaatattaaagaaaagtaaaagactttatcaatccaggaggttcaactttcaccagtaagatttccagaaggagaaaatatagagaaaaaaattgtcagaaaaacaaaagaacatgttctagattgaaggatctcatgagagctctgcagcatagatgagagaagacctaaaacaaagagtaccatgagattcaagaaggtgaatgataagaagaaggaccgaaatacttcccataacaattagaaggaagaggtagaattttaaaaaggaaaataatgggttagagcatcacacttctcagcagcaattctggaagccagcagaatgactttaaaattctgattgactattatttccaacttaagattctatatccaaatgagctgtcaatcaagtgtgaggacaaagaaaagattactatacatgcaaagactcataaaatgtaccttcacagtgtgttccttcttagggaatgactggaagatgtgctgcaccaaaacaagtgaaaaaaacaaaaaataaaagggaaagctacagaatccaggaaacaagaaatcctacctaaacagtaatagagaaaaattctgaggtgacagctgagccttagatctcaagacatactctttgctttagatcttaacactgtctttgtcgcattccagagattttggtatgttacatgcctgttaccatttactttaaagaatgttttgatttcggctataacttcattgtttacttaaaagtcattgaggaacaagtttactttccatgtaattgtgtggttttgaaagagctcattggtattgatttctattcttattccactgtggtctaaaagcattcttgatatgattttaattcttttgaatttattgagttgctttatagtcaagcatgtggtcaatcttagaatacattctgtgttaagatgaggagaatgtatattctgtggttgatgagtggattatgttgcagatatctactaaatccagttggtcaagtgtcaaatttaagtacagaatttctttgttagttttctgcctcaatagtttgtgtagctcactcattgtggtgttgaagtcctccagtattattgtgtggctaagttttttataggtttagaagtacttgttctacaaatctgggggctccaatgttggatgtgtatacatttagggttattaagtcatcttgcttaacattttatcattatgtaatgcccttatttgtccctttatattgttgttggtttaaagtctgttttatctttcataagaatagtgacctctgctttttgttgttgttgttttctatttgcatgataaatctttctctatttttttacttggagcctatgcatattgttacatgtgagatgcgtctcttgaagacagcagacagttgagtcttgcatttaatccaacttgacactctgtgccttttaattggggtgtttagactatttacattcaaagttattattgatatgtaaagattttatcctatcttaatgttgttaggtggtttctttgttgtctgtattgtgtagttgcttcatagggtctccagactatgtatttaagcgtgtttatgtggtagcaagtatcattcttttgtttccatgcttagaactcctttaggaatctttcatatggctggtctagtggaaacaaattcccttaggaattgcctgtctgaaaaagactttgtttctccttcacttataaaggttagtttagtggaatatgaaattctttattggattttcttttctttaagaatgctgaaaataagcccccactctcttctggtctgtgaagtttctgctgagaagtctgtttttacactaataggattccccttgtaagggatctgatcattatctttggctgcctttaagattttttctttcacattgaccttgaaaattctgataactatttgcctttgtggtggttgtcttgtatagtttatcacaggattctcttaattcattgaatttgcatgttgctctctataatgattgggaaaattttagtgaactgtatcctcaaatatgttttccaacttgcttactctttctcctcctctcccaagaatgccaatgcgtcatatatttggtctctttacataatcctatatttctcagaagcttttcatcattttataattctctcctttttttttgcttttgtctgactgggttgagttgaaggacttgtctttgtgctctgaaattctttccttggctttgtctattctgttgttaagtctttcatctgtatttggaaattcctgtagtgaattc

SEQ ID NO: 147 - DNA, 753 bp, Homo sapiens
  misc_feature 343, 346, 347, 351, 352, 353, 354, 357, 358, 359, 362, 371,392, 394, 397, 502, 601, 660, 665, 667, 679, 700, 702, 705,710, 711, 732, 736, 739, 745, 747, 748, 749, 750, 751, 752,753: n = A,T,C or G
gtggtctaaaataaacttttaattgcacatttgtgtcttgggttatctgtggggtgagaaacctcctcacttccaatcccagctatctgggtacaatctggtgttgtggtctggctgtcggcgaggggtagaggtgggtgcaggactggcccccgagtctgcaccgacctcttcagggcagggagctcaaaccatgggtgtacttgcactgcttcagggcctcgctgaagccctcacacagggacaggtcactctgagtggtggaacagtccaggaactgcctgatctcgtaggcgcagggccccatctgcaggggctggggggcagcggggggtggggcctnctnnacannnngcnnnganggctcttanctcccccccctaaaagctccngncanggcactgcccatgacgtgtccgacagtccgacccgaggctacccctgcggacgtggtctacatatgaaccatgaactctagctgcccagaggagctgggactgancgactgcctctgaccgttcgtgctcagtccgctggctatggtcgcgacggtcggatggttgctcggtagcctactgatgtttcctaggtatggtcgtanggatgaccacgtcgctttagtaacgaggcacggtactgatcgtaccgtatgctaaggantgtangnctggaatgtgantgacagtagcgaaagtaggtngncangccannttagggaagtagtcgtaaggnaagnaanggaagnannnnnnn

SEQ ID NO: 148 - DNA, 664 bp, Homo sapiens
cccacgcgtccgcccacgcgtccggcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaactataggcctgaattttgtaacagtaatatttaacggtggtccgtgataattaaatacaatgcttaattcatgtggctaacaacaccaaacaaaaaaacaaaacaaaaa

SEQ ID NO: 149 - DNA, 2016 bp, Homo sapiens
ggcacgaggggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtcccttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtatattaaactaaaaaaaaaaaaaaaaaaaaaaaaaaaaa

SEQ ID NO: 150 - DNA, 870 bp, Homo sapiens
gagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaaaaaaaaaaaaaaaaaaa

SEQ ID NO: 151 - DNA, 530 bp, Homo sapiens
tcaaagtttgagtgctttattagaatttttaaatgaggcgaactatgattttaatttcacatcttggctaaggagatgccactggagtacagagataatctcctgtcttaagccacggatcagtcagtgtagccctccctacccctcaatctcaagaccctcttacttccgaactaaacaacacaattggcaaatgaagccagcacgaaactgtatcaaaaaacaagagagtctgcagtgagccagtgtattatgtaaccactgtaataagtgattacgtggcctcccatatggacctttcatatcctggtgggagatgggagaccaatttaatagctctgagcatgctccatggtgcaatcacaagtgccatgccaattccaagacaaggcagcgcaggtgaatttccctagtgtacttttcaggaacacggttactcagttcagggacaggactacattgatgcacctgcaaagtaaagttggatgcttcagagcacatggatgatacccaggtcagcacggtgtaag

SEQ ID NO: 152 - DNA, 1590 bp, Homo sapiens
acacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaaaaaaaaaaaaaaaaaa

SEQ ID NO: 153 - DNA, 1683 bp, Homo sapiens
gaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcgcggggattactttgctgctagtttcggttcgcggcaggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgtgttatgccctttcccccagtattgtagagcaagtcttgtgttaaaagcccagtgtgacagtgtcatgatgtagtagtgtcttactggttttttaataaatccttttgtat

SEQ ID NO: 154 - DNA, 441 bp, Homo sapiens
tagatgtttacagtgattacatttatctaagcaacatacatacatgttcagttgtaagatgttaactaaatttctgtgacaaatatgctttttttttaataccaagaacattatagagttaatgcagagtcctaaggataatctagtagtcactaagtttttcttaagtcttcactttagatgctgttatttctagcacaattaagcaggcagagtctttcatatgctcaaacactggaatctttggttggttaccatatcagctggcttgcagacaagaagccaaccattttaagaatgttttaagtgaacaacttgcaaaccccagggatggaaaaaccctaagaatgcacaattgtgagcatttaacaaccatcacaactgtggctgaagactgttcatgccgttcttctgaaatagatctcaaagcagtatagttca

SEQ ID NO: 155 - DNA, 906 bp, Homo sapiens
ggggtgagtggtacccaacgggccggggcgccgcgtccgcaggaagaggcgcggggtgcaggcttgtaaacatataacataaaaatggcttccaaaagagctctggtcatcctggctaaaggagcagaggaaatggagacggtcatccctgtagatgtcatgaggcgagctgggattaaggtcaccgttgcaggcctggctggaaaagacccagtacagtgtagccgtgatgtggtcatttgtcctgatgccagccttgaagatgcaaaaaaagagggaccatatgatgtggtggttctaccaggaggtaatctgggtgcacagaatttatctgagtctgctgctgtgaaggagatactgaaggagcaggaaaaccggaagggcctgatagccgccatctgtgcaggtcctactgctctgttggctcatgaaataggttttggaagtaaagttacaacacaccctcttgctaaagacaaaatgatgaatggaggtcattacacctactctgagaatcgtgtggaaaaagacggcctgattcttacaagccgggggcctgggaccagcttcgagtttgcgcttgcaattgttgaagccctgaatggcaaggaggtggcggctcaagtgaaggctccacttgttcttaaagactagagcagcgaactgcgacgatcacttagagaaacaggccgttaggaatccattctcactgtgttcgctctaaacaaaacagtggtaggttaatgtgttcagaagtcgctgtccttactacttttgcggaagtatggaagtcacaactacacagagatttctcagcctacaaattgtgtctatacatttctaagccttgtttgcagaataaacagggcatttagcaaaaaaaaaaaaaaaaaaaaaaaaaaaaaa

SEQ ID NO: 156 - DNA, 882 bp, Homo sapiens
  misc_feature 212: n = A,T,C or G
caaccatttacttggtgtaaagaacttaatttcagtataaactgactctgggcagcatggtgatgctgtatcctgagttgtagcctctgtaattgtgaatattaactgagatagtgaaacatggtgtccggttttctattgcattttttcaagtggaaaagttaactaaatggttgacacacaaaaattggtggagaaatgtgcatatgccnaatttttgttaaaacctttgttttgaactatactgctttgagatctcatttcagaagaacggcatgaacagtcttcagccacagtgtgatggtgttaaatgctcacaatgtgcattcttagggtttttccatccctggggttgcaagtgttcacttaaaacattcttaaaatggttggcttcttgtctgcaagccagctgatatggtagcaaccaaagattccagtgttgagcatatgaaagactctgcctgcttaatgtgtgctagaaataacagcatctaaagtgaagacttaagaaaaacttagtgactactagattatccttaggactctgcattaactctataatgttctggtattaaaaaaaaagcatattgtcacagaaatttagttaacatcttacaactgaacatgtatgtatgtgcttagataatgtaatcactgtaaacatctatatgatctgggatttggtttatttgaatgggagctttttgttacagtccataaaactaaacgttctgtaaaaaaaaaaaaggggggggctaaatcctgggggcagttcgggcccgtttgcagggccaggggggttaagagggggggggtaagcggggggaaggcgggtgggaccctcggggctgggcccaaaggggaaaggtgggggggggcgta

SEQ ID NO: 157 - DNA, 548 bp, Homo sapiens
ccctcaaaaactgtttattatacaagtgagttttgagtcacgatgggcttatcggtaggatttctggtagcgagcgcgtgcaccagggcctccaaactttttggactcgcagcgacgagggtcagctaccagcagggtccggtcatactggatgaggatgtctttgatctccttcttggaagcctcatccacatctcatgggaaggacccatgctcactcacatttctggtaataggccaccagggctttggagatggactgacggatagcataaatctgggccacgtgaccaccaccctttacacggacacggatgtctacaccagcaaatcgctccttgccgagaagcagaactggctccagcagcttgtactgtagcgtgcgcggctcaatcatctccaggggccgcccgttcaccttgatgagaacattgccgcgtttgcagtgcgccacagctgtcgctgtcttcttgcggtcgaagacctgcaccgactgcagcggaacttggacggcatggctccgagcgtggactagaaacctcaacgcg

SEQ ID NO: 158 - DNA, 942 bp, Homo sapiens
tacgaatctcgcgagaagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaa

SEQ ID NO: 159 - DNA, 1396 bp, Homo sapiens
gacgccgcccgaccctgcgactacgctgcggactcccgcccgctcccgctcgctcccgcggtcctcgctcgcctcgcgccggtagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgttaatttctggtcagtgattccaggttttaaataatttgtaagtgttcaagtttctacacaactttatcatccgctaagaatttaaaaatcac

SEQ ID NO: 160 - DNA, 1322 bp, Homo sapiens
tagcttggcacgaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgccttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggacccggcgggtgtgcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgagccgattaaaagaccgtgtgaaatg

SEQ ID NO: 161 - DNA, 1384 bp, Homo sapiens
cgcacggccgcgcagatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtaca

SEQ ID NO: 162 - DNA, 745 bp, Homo sapiens
ggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccggtgggtcattgatagcggtgctgtttctgactggaacgtgggccggtccccagacccaagagctgtgagctgcctaagaaatcatggcattcacacagcccataaagcaagacagattaccaaagaagattttgccacatttgattatatactatgtatggatgaaagcaatctgagagatttgaatagaaaaagtaatcgagttaaaacctgcaaagctaaaattgaactacttgggagctatgatccacaaaaacaacttattattgaagatccctattatgggaatgactctgactttgagacggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagtttgtgttcggcaggagaatcaataaaaatcttgattcagacagtaaaaaaaaaaaaaaaaaaagggcggcggctaaaaa

SEQ ID NO: 163 - DNA, 512 bp, Homo sapiens
gcagccctcgcgcggtccggcacagcggacaccaggactccaaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtgtgctgattgcctgcctgtctgccgtagccaaaaaaaaaaaaaaaaaa

SEQ ID NO: 164 - DNA, 1032 bp, Homo sapiens
cttttacttcggcccgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtggatccccaaaggatgtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagaggattatgatcatagctactacttcattgcaacctttattactgaccacatcagacatcatgctaaatacctgaatgcatgaaaaaactccaaataagagaatctcttcaggattataaaagttgtaaaatgcaactgtattgctgagcaaaaaaaaaaaaaaaaaa

SEQ ID NO: 165 - DNA, 872 bp, Homo sapiens
gtactttcgccatcatagtattctccaccactgttccttccagccacgaacgacgcaaacgaagccaagttcccccagctccgaacaggagctctctatcctctctctattacactccgggagaaggaaacgcgggaggaaacccaggcctccacgcgcgaccccttggccctcccctttacctctccacccctcactagacaccctcccctctaggcggggacgaactttcgccctgagagaggcggagcctcagcgtctaccctcgctctcgcgagctttcggaactctcgcgagaccctacgcccgacttgtgcgcccgggaaaccccgtcgttccctttcccctggctggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaacaaaccatgctgggttaataaattgcctcattcgtaaaaaaaaaaaaaaaaaaaaaaaaa

SEQ ID NO: 166 - DNA, 647 bp, Homo sapiens
agaaactgatgtttattttccatcaaccatttttccatgctgcttaagagcctatgcaagaacagcttaagaccagtcagtggttgctcctacccattcagtggcctgagcagtgggagctgcagaccagtcttccgtggcaggctgagcgctccagtcttcagtagggaattgctgaataggcacagagggcacctgtacaccttcagaccagtctgcaacctcaggctgagtagcagtgaactcaggagcgggagcagtccattcaccctgaaattcctccttggtcactgccttctcagcagcagcctgctcttctttttcaatctcttcaggatctctgtagaagtacagatcaggcatgacctcccatgggtgttcacgggaaatggtgccacgcatgcgcagaacttcccgagccagcatccaccacattaaacccactgagtgagctcccttgttgttgcatgggatggcaatgtccacatagcgcagatgagattcttgtgtacacagcgcaatggtagggtaggtaacattagatgtctccgtgagaagcttgtgggcagacatggggttagtaaccctagaaagtcgtggctcccgaaagtttcctggattttgttagttgagggttcaggaatgaa

SEQ ID NO: 167 - DNA, 2363 bp, Homo sapiens
aacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagccagtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatgg

SEQ ID NO: 168 - DNA, 2386 bp, Homo sapiens
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcctgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 169 - DNA, 482 bp, Homo sapiens
  misc_feature 204: n = A,T,C or G
gtcaaataagcaaatgcatttatttgatacacaaattccatgccaccagtcaaactatggtctggcttttttttttaaccaacagtaaagaaaactttttgggtttttttgtttcttttttgagatggagtctcacccttgccacccaggcagtagtagcacgatctcgactcaccgcaacctctgcctcctgggtttaagcangtctcctgcttcagcctcccaagtagctgagattacaggcgcccaccatcacgcctggctaattttggtatttttagtagagacggggtttcaccatgttggccaggagttcaagaaaagttttttaaaaataataaacctctaaagtgttaccctaactgtaccttacagtgatatgtgacttctctagtcactccacattatccagtgatggcacctagataataatgcaccaaagaaaagtaaagaattgcagacttctagaagcaatgatgaaa

SEQ ID NO: 170 - DNA, 993 bp, Homo sapiens
gcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggccgcctaatgatgtctaaagaaaatatgaaactccctcagccgccgaaggacagtgttacagcaattaatcaacaaagaaaaaccacaggcccttccccttccccccaattcgatttaatcagtcttcattttccacagtagtaaattttctagatacgtcttgtagacctcaaagtaccggaaaggaagctcccattcaaaggaaattgatcttaaagatactgtaaatgatactaaatttttgtccatttgaaatatataagttgtgctataacaaatcatcctgtcaaagtgtaagcactgtcccacgtaaggtggaacttcctgcgatcaacaaaaagcctagttaattggttcgcatcatactgtggggcactccactcactgggaaaagccatcaccaatcaccttgcgtgtaacggcggggtcagcggctcccccgaaaccgcgggccaccagccgaaaaagaccaaagaggggagagggaaaacaggcaagcgacggcgcaaccacagcggagcagacacagaggaacaaaacacaacagaaacacaacgcagaagagacggaccggacagacgacgccaagccacacagcacacacagaagcac

SEQ ID NO: 171 - DNA, 2114 bp, Homo sapiens
tccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattaatccccagccctggtacaagtctactgacatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttcgatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttggactctcctaccagcttctcttctgaatgactgaattgtgtgatggcattgttgccttccctttgccctttgggcattccttccccagagagggcctggaaattataaatctctatcacataaggattatatatttgaactttttaagttgcctttagttttggtcctgatttttcttttacaattaccaaaataaaatttattaagaaaaaggaaaaaaaaaaaa

SEQ ID NO: 172 - DNA, 97385 bp, Homo sapiens
gatctaataatatttgccttatgagtgttgtggtattgggtgcatatacaattattttatcttactaaattgattcctttactattatataatgtccttctttgtctacagatttttacttgaagtctgttttatctaagtagagctattccttgcttttgtttcccttggcatggattatctttttccattccttcacttcagtctatgtgtgtctttacagctgaggtgagtttcttgtgggcatcatatagttgggttttgttttttatccattcaactagtctaaaccttttaaatggggaaattaattaatttacactcaaggttattattgataggtgaggacttactcatcttttttttgttgttttctagttctttttttttttttttttcttgagacggagtctcactccatcaccaggctggagtgcagtggcacgatctcagctcactgcaacctccgcttcccaggttcaagcaattctcctgcctcagcctcctgagtagccgggattacaggcacgtgccaccacacccagctaatttttctatttttagtagagactgggtttcaccatgttggtcaggcttgtctcgatctcgtgacctcgtgatccacccgccttggcctcccaaagtgctgggattacaggcatgagccaccgcgcccagcctttctggttcttttatagttcctttgttccttactttctctcttattatttttgcaggtaggtggttttctgtagtggtaagatttgattctctttttcctttgtgtattggctcttctagtgagttttatcattttatgttttcatgatggtggctattgtcttttcacttccagatataagactcccttgagcagttcatgtaagaccagtctagtagtaatgaattcttagtttttgtttgtctgtgtaagatcttatttctttttttttttttttttttttttttttttgagacagagtcttgctctgtcgcccaggctggagtgcagtggggcgatctcagctcattgcaagctctgcctcccaggttcacaccattctcctgcctcagcctcctgagtagctgggactacaggcgcccgccacaatgcccacctaattttttgtatttttagtagagatggggtttcaccgtgttagccaggatggtcttgaagatcttatttcttcttcatttttttttttgacaggctctcattctgttacctagtctggagtgcactggcacaatcatggctcactatagcctcaacctcccagactcaaccaaatctctcaccttcttttggctagctgggactacaggcacacaccatcatgcccagataattttttatattttggtagagacagggtctcactatgttgcctaggctggtcttgaactcctgggctcaagtgatcctcccacctcagcctcccaaattactgggattacaggcatgaaccacgacattcagcctctccttcatttctgaaggataatgttgctgggtatgatattcttaattggcagagttttatttttatttcagtactttaaatatgtcataccattttctcctgacctgtaaggtttatgctgagaaatatgatagtctaatggagattcatagctaatggtaattcccctatatgtgacttaatgcttttctcttgctgcttttaaaattctttctttgtctttgacttttgacaagttaactataatgtgcctcagagaggacctgtttgggctgaatcaatctggggttctttgagcttcctggacctgaatgtccatctctcccaagacttgggaagtcttctgacattattttattaaatatgttttccttaccttttccctttcttctctttctggaacacccataatatgcatattgtgcacttaatggaaaatggaattccacaaatcctgtaggctttcttcattctttttttctcttttcttttttaatctgcctatgttatttcaaaagtcctgtcttcaagttcagaaattcttttcttctgcttgggctagtctgttgttgaagctctcaattgtgttttttatttcattcattgaattcttcagctctaaggtttgtttggctctctttatgatatctatctcttcattgaatttctcattcaaataatgaattctgttcctaattttgttgactcatctatctgcattctcttatatctcactgagtttccttaagattattatttttaattcttttttagcatgtcatatatttccttatgcttagggtctgttatggaagaattattgttttccttttgaggtaacatgtttccttggtttttcatggttgatgtgtccctacattgatttctatatatctggtagaaaagttgcctcttacaattttatagagtaggttttgtaaggaaagacttattcattttcataggtattgactcagtggagttcattggccttggttctaggtggatgcagtagtatagtatccatttagtttcttctaccttagtccacactaatagtgtttgtgaatttctcagcggcctaggctaagagagtttgtgataatagtagtgaactttgccagaaatgggctttctaggcttttctcaggtggggagtgcatgtgtgtttctcaggtgggtcagccaaattggggttggggccacagagctgttattctggctgggagcactggcatgcagttgctcagtcaatctggacgtgtgtctgccaggagcaacccacagggctgtttctcaagcccagcatatgggtgtacagctgcttgtaaaggagtctttactaaaagaacaaatcacctagctgacctatggagtgattcccttcaagcatggtaacaaatcagtgtcttagcaaactagatagtcagaaggtggaagtccctcttgttaaacttatacaaaatttacagcctaaaattccttgaaacaaattttccaatctttcttcttcaaaatactttatgacatgggcagacccttatccactgcccaaaaatctgttgcccccaccacatgaaatgaatgaggacaagttcatttgggcttgtttgggctgttataacaaaattcagtagattggatggcttataggcaatagaaatttctcacagttctgaagactgagaagtctaagatctaagatctaggtctaagtataaaatcaaggtaccagcagatttgagatctggtaagaccagaactatttcttagttcataaatgataacttctccctgtgctctcacatggtagaaggggtaaacaagctcacttaggctcattttagaagggcactaatcccattacttagggctctgacctcatgacataatcacctcccaaaaagtcccatctcctaatactatcaccttggagttaggatttcaacatatgtatttgagggtatatgaacattcagagcatcgaactaagagtataaagtttaaatgttctcaccacaaaaaaactacatgaggtgatagatatgttaattattttgaccatagtaatcactttgcaatgtgtatatgtatgcatgtgtgtatatagtatatatatatatacacacatatatattaaaacattacattgtacacctcaaatatatacaatttttatttgtcaattatacttcaatacagttgggggaattaaaaaataaagtttcaagagaaaaaagaatttatctacttaatacaaaaccatgagtagtatacaaaaggttccaggtaccagtcataaataacaattttaaaatggctcaacaccctttcatgataaaaaaaaactctcaacaaattgggtgtaaaaggaatatatctcaacacaataacggccatatatgacaagtcctcaggaaacattatactaaacagtgaaaaattgaaagcctttcctctgaaatccagaacaagacaaggatgtccattcttcctacttctattcaacatattattgaaagtcccagccagagcaattagtcaagagggaaaaaagggcatcaaataagaaaggaacaagtaaaattgttggtatttgctgattacacaatcttatatatagaaaaccctaaagattccaccaaaaaactgttagaactaataaatgaatatggtaaagttgtaggatacaaaatcaacacaaaaagatcattagcatttctatacactaataatgaactatccaaaagagaaaacaaaagaacaatcccatttataatagctactaaagaataaaataatcagaaataaatataaacaaggagataaaagacctgtacatggaaccctataaaacattaatgaaagaaattaaagaagacacaaataaatggaaagatatcccatgtttatgggatggaagaattaatatcgtggaaatattcatctacccaaagcaatttacatagtcattgccatctctatcaaaatcccaatgtcattcttcacataaataagaaaaaaatcccaaattcatatggaaccacaaaaaaaatagccaaggcaatcatgagggaaaaaaaaaaaaaaaacgtagaggcatcatactactaatttcaaactatactacaaagtgataaaaatggcactgacataaaaatagacacattgaccaatagaataaagagtgcagaaatgaactcatacatatacagtcatttgacattcaacaaaggtgccaaaaatacacaataggaaaaggaaagtctctccaataaatggtgttgggaaaattggatatccaaatgtagaagaatgaaattggacccttatctcacaccatatacaaaaatgaactaaaatgggttaaagacttatacacataatgggaggcagaggttgcagtgagctgagatcatgccactgcactctggcctgggcaacaaaagcaaaactctgtctcaaaaaaaaaaaaagacttacacagaagacctgaaactgtaaaactactacaagaaaacagaggggaaaaaaactacaggacattggtctgggcaatgatttttcagatttggcctcaaaagcacaggcaacaaaagcaaaaatagacaaatgggattacattaaactaagaagcttctgcacaataaaggaaacaactaacagagtgaacagatgctctacagtttcggagaaaatacctgcaagccatgtatttcatagggggctaatattcaaaatacataaggaattcaaacaactctttagcaagaaaacaaccccatttaaaaaatggacaagggacctgaatgtttctcaaaagaagacacacacatggccaacagatatacaaaaaaaaagctcaatgttcctaaccattagaaaaatgcaaattaaaaccacaatgagtatcatcttgagaggtgacaacatgctggtggccctcgctcgctctcagtgctatcttggcctcggtgtctgttctggctgtgcttgagaagcccttcagcctgcagctgcactgtgggagcctctctctgggatggccgaggctggggctggctccctctgcttgcggggtggtgtggagggagaggcacgggcaggaaccagggctgcatgtggcactcgtgggccagcgtgagttccgagtgggtgtgggctcagcaggccctgcacttggagtggccggccggcaccgccggccctgggcaatgaggggcttagcacctgggccagcagctgcagaaggtgtgccgggtcccccagcgctgccgacccacctccgctgcactcaaattctcgctgggcctcggccgcctccccatggggcagggcttgggacctgcagcccaccatgcctaagcccccgacagtgggctcccacatagccggagcctccctgatgggcaccgccccctgctccatggctcccggtcccatcgactgcccaagggctgaggagtgcgggcgcatggcgcgggaccggcaggcagctccacctgcggccccagagcgggacccactgggtgaaaccagctgcactcctgagtctagtggggacttggagatcctttatgtctagctaggggattgtaaacacaccaatcagcactctgtgtctagctcagggtttgtggatgcaccaatcggcactctctatctagctaatctggtggggacttggataacctttatgtctagctaagggattgtgaatacaccaatcagcactctgtatctagctcaaggtttgtaaatgcaccaatcagcactgtgtgtctagctcagagtttgtaaatacaccaatcagcactctgtatctagctaatctagtggggacatggagaacttttgtgtctagctcagggattgtaaatacaccaatcagcaccctgtcaaaatggaccaatcagctctgtttaaaacagaccaatcggctctctgtaaaatggaccaatcagcaggatgtgggtggggccagataagagaataaaagcaggctgctggagccagcagtggcaaccggctcaggtccccttccacactgtggaagctttgttctttcactctttgcaataaatcttgctactgctcactgtttggtccacactgcctttatgagctgtaacactcaccacaaaggtctatagattcactcctgatgccatcgagaccacgaacctaccgggaggaatgaacaactccagacatgccgccttaagagctgtaaccctcaccacaaaggtctgcagcttcactcctaagccagcgagaccacaaacccaccagaaggaagaaactccaaacacatccaaacatcagaaggaacgaactctggacatgccgcctttaagaactgtgacagtcaggccaggcgttgtggctcatgcctgtaatcccagcactttgggaggccaacgtgggtggatcaagaggtcaggagatcaagaacatcctggctaacacagtggaaccccatctctactaaaaatagaaaaaaattagctaggcgtggtggcacacacctgtagtcccagctactcgggaggctgagacaggagaatcgcttgaacccagaaggcagaggtggcagtgagccgagatcgcgccactgtactccatcctgggtgacagagcgagactctgtctcaaaaaaaaagaactgtaacagtcaccgcgagggtctgcggcttcattcttaaagtcagtgagaccaagaacccaccaattccggacacaatctcacacctgtcagaatggccattgtcaaaaaaatgaaaaatatcaagtgttggcaggatgcggagaaaaggaaacccttgtacactgttaacaggaatgtaaattagtacagacattatggacaacattatagaggcacctcaaaaaattagaatagaattaacctatgacccagcaatcccacttctgggtatttactcaaaagattgaaaccagtatgttgaagagatgtctgcactcctatgttcattgcatcgactattcacaatagccaagttgtggaatcagcctaactttccatcaacaaatgaatggataaagaaaatgtgtgtttagttatgtacaatggaatactattcagcccttaaaaagaaattcatcctgctcaacctggtcctaatgctgccctggctgctcagctgacctccttttaccttctgatacctggatatccctctcctgttcagccccacagttcccaacaatttggttcctgctccatgatcagcattttcaataaaccagacactccagagaaaaaaaaaaaaagaaagaaattcagtcagttgtgacaacatgggtgaaactgaagaacattatcctaaattaaaataagtctacacagaaagacaaataccatatgttctcacttacatgtagaatctaaaacaatcaaactcatagaagcagaattagaatggtggttaccagaggctggagtgttgggggaaatggggagatgattgtaaagggtacaaagcctcagactagaaggataagattttttcaagatctattaacacaatgtggtgaatatagttaataatagtatattgtgcacttcaaaatcactaagagtagatttcaaatgttctcaccacaaaaaaataagtatttgagattatgaatatgttaatttggttgatttgattattccaatcaaatcataaattataacatcactttgtaccccataaatatatacaacaagctcgacacagtggctcctgcccataaccccagcactttggaagactgaggcaggaggattgcttgagcccaggagttcaagaccagcctgggcaacatagtgagacattgtctctacaaaaaaaaaaaaaaaaaaaaaacacaaaattagtcgggtgtggtggtgcccacctgtaattccagctactcaggaggctgaggggggaggattgcttgagcccaggagatcgaggctagtgtgagccaagatcatgccactgcactccagcctgggtgacagagcaagaccccaagtcaaaaaaaaacctatatatagttatagtttacaaaactatatatatagttatatatagttatagtttacaaaactatatatagttatatatatagttatagtttacaaaactatatatagttatatatagttatagtttacaaaactatatatagttatatatatagttatagtttacaaaactatatatagttatatatatagtttacaaaactgtatatatagttatatatagtttacaaaactgtatatatagttatatatagtttacaaaattgtatatatagttatatatatggtttacaaaactatatatagttatatatatggtttacaaaactgtatatatagttatatatatggtttacaaaactgtatatatagttatatatatggtttacaaaactatatatgtaacatatacaagttatagttgcatatatatatatagatacacacacaactataacttgtcgaaaatgaattttttttaaaaagcccaaaaaatggctcaatataaacaaatcccagtgtagaaaatgcctcagttccccgagatttacaataatgatcacagcccccaactgtcccatccttaattttctcaagtttatatgtttaggcaacttagggcactatgaatgggaaggacaattctacaaggaaaagttggaatgctattattagatgtgaaatatactgatgagcagacctaaacaactgctgttcactacctcccaacccttgactattccatgcatatactctctcctttctgttcataaatatgtttaatgccttggtctaacatcacaaaaagtacttacctactccttaaagggagacaatcgaaagtcagctccgactccttcaactggctacaagtataaaatctctaaatgagctctatctgtatattaccaataaatactgtgaaaaaagtggttaattatatcataaaccaacataccctatataaaacaataaaagaaataaaaaataaatgcttgaaaaatattaatgctacaacacaatgattaggaaaatacaggtagctttatttgtgctgttcattataagcccgtaatagctgacttgcgttaacaatcctcctctattatgcatttcatacttttgtgtttagccaataccacaaataagctgtgttctttatgtaaaacttcatttctgtgtgatattagcttttgagagaactgcctgggcaggctttacattttcccatcttttggactttaatggctcccattatattttacaactgagatggggtacaattatatgtatatatttttcaaggtagctaaggtgaaaattaaccctattttatcttcacagtttcaaaaattgcaggcaaactgtaatacccatcttttgtcaatttttttattcttatgaagagactgaagtggccagatataaatgtcaactctgaattgaacaggtccattttttaattgcttgatgaaagtattcccccatttagacacaaaaacaatcaaaccagtagagtgcataatcataagaatgggaagcaaaactattacaaagtagaatcttaaatactacctacaccaacttggtccccaaacctatgtgttttgacgatgctacaaagaacataagctcagggcttatactgcatacagcaagggaaatccccagccttgaaacatagttgcatcttcaactttataagacaatatgcctctagagatggtaatacactaggtaagtagatacataagcactaatatattttcttacttcttgtagtgggaagtaagttcctaaaacaggcaggaacaatatagtattatttgctaagatgaccataaggtattggacaagcccatcaaagctgatattaacaagatatggtggatgaaaaaagcaaatctaatgggatgattacaaaattctaggtcaggcacggtggcttatgcctgtaatcccagcactctgggaggctgaggcgagcagattgcttgagtccaggagtttgagaccagcctgagcaacatagtgaaatccatccctactaaaaatacaaaattatccaggcatggtggcacatgcttgtaatcccagctactcagaaggctgaggtgggagaatcacctgagcgggggagatcaaacctgcagtaagctgggatcacaccactacattccagcctgggcaaccagagtgagatcctgtgtttaaaaaaaaaaaaagtataggctgggcatggtggctcacacacataatttcagcactttgggaggctgagacaagaggatcacttgagctcaggtggtcaaaactgcagtgagtcatgactgcaccactgcagtctagcctaggtgacagagcaagaccctgtctcaaaaaaaaaacctgaaaaacatgacattttggaccaggtaatttttttttcaagttctgaagatgaacagtggtaaggaatccacaacaatgtgaatgtacttaatgtcactgaaatgtacactttaaaatggttaaaatggtaaatttggccaggtgtggtggctcacgcctgtaatcctagcactttgggaggctgaggatggcgatcacctgaggtccagagttcaagaccaatctggcctacatggtgaaaccccatctctactaaaaattgggtgggtgtcatggcacacacctgtaatcccagctacttgggacactgaggcaggagaatcacttgagcctgggaggcaaaggttgcagtgagctgagatggcaccactgcactccagcctgggtaacagaatgagacgctgtctaaataaataaataaataggtaaactttatgtgatgtatatttaagtacaataaaaaaccgagtctaagttcattataacagcatagtaatgaggaaaaatgtcccaaatgatctatttggttcttttgtaacatgggactaaattagtatcataccaacaaggacacttaaaagttgaaagtcacttgggttaaatttatgcacagtttctgtgtctaagactatggctatatcaagcccattacttggttaatggactgcctgagcaagaagatagatggaatttacagagtgacatatctggtccatctgattattaaggatatcttctatactgaggacccctgataaacagttacatgaaacatgaataatctcacattatagatccatttattcaacaaattttttttttttagatggagtcttgctctgtcaccaggctggagtacagtggcgcgatctcggctcactgcaacctccgactccctggttcaagtgattctcctgcctcagcctcccaagtagctgggattaccagcacatgccaccatatccagctaatttttgtatttttagtaaagacagggtttcaccctgttggccgggatggtctcgatctcccgacctcgtgatccacccatgtcggcctcccaaagtgctgggattacaggcgtgagtcaccgcgcccggcccaacaaattattctgtgtgtgtgtgtgtgtgtgtgtgtgtgtgtgtgtgtgtgtgtgtagacagggtttcactatgttgcccaggttggtctcctacccctgggcttaagacatcctcctgcttcagcctcccaaagtgctggtattataagcgtgagccattgcacccagctgtcaataaattattcttgacaaattaatatgtcataatagaatttccattcacattgtccttctctaaaacttgttctcaccaactttctagtcttacttattccgctacccttgcaatacaaggtcattccaaccactcccaaatccatgaattaggctatctttgcttgcaggtaaaatagacaagaatgcattttcctcaagttctgcctactgggaaatttttcattccccgctgtccttcagggcaaatgagttaaagcagcttgtttacaattagtcctaaaacacatttcactggagaacttgcgcaaaccaggcaacaatttttccaacattagacatctggtcttcaggaattctcaaagaagccataagtgtggatttcaaattctgtgacaacacaacaaaaacgggatatttcatgggctgggaatataatctacttgctcataaaacttacttgcacctttagggccatagtatacctggtaaaatgtagagtcctttttttttttttttttaatgaactgcttatgggttcaatgggtactccaagattttctcaagcatctttccttcacaggcctttaccaaacaaacaggaagttaatgatcctcactgttttccatctcataacattttcactcaatgtcttaaggcccacactctcgaatggaacatatcatctctccctggggacatgcagctcaaaatattcactcccacactcacacatgatcatacaggcacttcaggaacccaacatttaaataatactgtcattaggaagccctccttctcaacacacacgggcagaacacaaggcatctggcacttgggaacatatttatcccgccattgtagcctagggtctttgccactcaaccctgccaccacccagccttatcttaattggaacaatgaagctggtgatatggaggagcaaaaacattagctttgttggaaacatggaaccagcaccttcagattccttttactcaaagctctggtcctaacctttctccacactgtggggaatgtagtcttgccaacaccagacagttagcctctacccattgactataaaatcagatttcaactcttttatacaacttctttatgaaaaccttgaaaaaaagaatcgtatcttatttggctccctttaacaatatattatacaacagagaaactaaatatctgtatattgattatgctaacatgcaggacaggatcaaaactaacacaatagaattcaaatatgcaaaatcattcagagttattggaaaggtaaaaatgcaagtttaacattttttcaaagataatgtcctggctatatctatattgaggttccctacatttggtgctacatagaatttatgttattaatcttatggagctatagtgtcaggatatataacagaattgatactttatttatactagctggaccttttaaataccttctcatttataatgcccaaatggaaaataataatttatttccttagcaaggcaaatcttcacactaataagagaattgaattaagatttgcccaatatgaaccaaaatccttgaacattaaaaccctggattccctcactcttttttttttttttttttttttttgagacagagtctcactctgtcgcccaggctggagtgcagtggcaccacctcggctcactgcaagctccacctcccgggttcacgtcattctcctacctcagcctcccgagtagctgggactacaggtgcccgccatcacgcctggctaattttttgtgtttttagtagagacggggtttcaccttgttagccaggatggtctcaatctcctgaccttgtgatccgcccaccttggcctcccaaagtactgggattacaggcgtaagccaccgtgcctggcctccctcactcttacccaaatactcacagctcccaatcctcccattcatgagttgtttctgtctacactcatgagaaataatggacactgtgactgagagtccattacatgaaagggcagttctacaaagaaaaattaggatgctggctggccatggtggctcatgcctgtaatcccagcactatgggattacaaagcgggtggatcacctgaggtcaggagttcgaaaccagcctggccaacgtagtgaaacctcatctctactaaaaatacaaaaaattagccaggtgtggttgtgggtgcctgtaatcctagctacttgggaggctgaggcaggagaattgcttgaacacaggcagcagaggttgtagtaagccgagatagcgccattgcactccagccttggcaatagagtgagattccatctctaaaaacatatatatacacacatatatatatacatatacatacatatatgtgtgtacatatacatacatatatgtgtgtacatatacatacatatatgtgtgtatatatacatacatatatatgtgtatatatatacatatatacacatatacatatgtatatgtgtatatatatacatgtatatatgtgtgtgtatatgattgatatttaaattagtagactgagtaaaagagattacccttcatgatgcaggtgggcctcatccaatcagttgaaagccttaagaggaaataggctgaggtcccacagaggaaggaggtattctgactccagactgcctttgaactcaaaactgcaacatcaacacattcctgaacctccagcctgccagcatgccctgcaaatttcagatttgtccatccctacaatcacacaagccaattccctaacattggttttgtttcattgattctgttcctctggagtaccctaatacatagactttaaaacaaaaattataactagaagtacattttacaaaaagaaaagacagatttactcagcatcattatcagactatgacatttagcaatcaacagcatgggtgcaaaaaaaaaatctactttaaaaccctttgttggaatgctttatactttccacagaactgaaactaaaataacatgttattcaattagtcacaaatatagtccttgagttttttgcctatacacatgaatatttgtctaaagcatgtcttctttgtagcagctaggccctgccaccactgtgcttggctgcattcacaaatctgttgtaacctgtagcttccctgtcacttctctggctctcctctcctgctaagctttgtttcccggcagtaattaaaatcttctgccactgccatagctactactgctactggaacctccatggccaccttggttttgtggtttggcaaagtattgtcctccaccaccataggggtcagagcttctgcctccaaagttgcctcccttcatgattccaaaatttgaagactgatttttgtaattgtcaaaatcattgtagcttccactacctccaaaattacttccatcattaccaaatgcattatagccattcccactgccaccatatccaccaccaccatggctgccaccaaagccaccacaaccactgaagtttcctccacgaccaaaattgtcattcccactgaagccacctccaggaccaccaccaaaatttccagaaccacttcgaactctttggctagatgaagtactacccatctcttgcttcgactgggctttcgtaacttctaagctgtggctattcacagtattgtaattttttttttttttaagatggagtctcactctgtcacctaggctggagtgcagtggcatgatctctgctcactgcagcctctgtctcccaggttccagcgattctactgcctcaggctcccaagtagccaggattacaggcacacaccaccatgcccagctaatttttgtatttttagtagagacggggtttcaccatgttggctaggttggtcttgaactcctggcctcaagtgatctgcctgcctccccctcccaaagtgctgggattacaggtgtgagccactgcacccagtcaagcatgtttctaagaaaagggcaaacaattctcaaagaggcccctaatatctaaaaccagtttagaatccctgccctaggtgaatacaggaaacattgtcaaaactaaaaggaaacttgtagggcatcttaatcaatcagccaagatgggtgccaaagcccaaagccaggtagaggcttgtgcaagatcacaagcagaggcgcagtttgaagctagattctcccactcttaaactagtgctggacagactgaggcctagcaagttggctacagagccctagcagattcctgtctccacactgagccaggaggggttgctgcccagggataccgacagccatacttaagctggacaaggcacatgctcttggtggaagcaaacacgtccgctacctcatacagaaataaaaatgattataaaggaatcctgggaatatctgtatgctaaaaaattagataacttagatgaaatgaacgaattcttaaaaagataacaactaccaaaactgacttaaaataaatgggaaatctgaatagatctgtaaagagtagacaccaaatcactaatcaaaaaatattccacaaaggaaatcccaagctcagatgatttcaatggagaactctaccaaacttttacagaattaactctaatcatttacaaactcttccaaaatatagaagaggatggaatactttccaactcattctatgaggccagtactacagacaaagatatcataaaaaagaaaactacagaccaatagtccctatgaatataggcacaaaaattctcaaaaaatattagtaaaaagattcagccacatataaaaaaagattatatgccataatgaaatccaatggaatttgtcccaagaatgccaggttattcaagcatgcaaaaatcaatgtaatataccactttaacagagcaaagggcataaccaacataatcaactcaatagacacagaaaaaaaaattgacaaaaatctgtcaaccttttatgataaaaacactcctcaaattaagaatagaacttcctcaacctaaaaaagcacatttatgaaaaatcccgagataacatcatacttaatgggagaaattaaaaagttttcctttaagatcaggagcaagactatttcctggtaaatttttcctctcctccgtgtttgagttctatccatttcacatttctattaccgaacgtgtttatttcttctatgttttttccagccattattggcagttttgtctattttaatggtatttttaaaatacaaacttttagttttatttggcaattttagtgtttctttttttctaattcactaatttcaactactttcttcaattatcctctactttctctttacttactttgctgttttgttccagtttcttaggttcaagccttagttaatttgctttcaagtattcacatgtatatattaaagcattggtaagaatttatttacaactgttcattatagagatgttgatgtcccgagcaatagtggtcatgatccctagatgtggaggaaagaaggggggaaggctgaggttaatcagtagggttctggtaaagcatggtctttcaagctacatggctgggtacccaagaacttaactgttctgctcacaaggctgattctggatgcaccagaactctgcccaggcttaagccctggaaagataaaaatcagagatatgaattcaactcctcacatgagaaggacagctaacccttcagatatttcagtcaagtccgggattcttctatctgctgtctgcaacatcatgaagcctgaatgggctcacttttctctatggctcctcatcttgtccatgcttctccacacaccttcagggaacatatttcctccacaactcagaaaacagttacgtgaaagtggacatcttggaggtaaagaaaaacagaaagggcagaccaatgtgacactgtgaaggagagggaggtctgggcagcctgggtgatgttgctgccagtaattagaatcaagtctcctttttatctcaaaccgtatggctctaggacatctgattcagagaattacattgagtttcctctatggagtggagaaggaggaagacagaaagcagaatcaacttaagttttaaccatgagatttcagtataagagtgggggttatgaaaatgggattgatttcagaggtgtccaagaaattcctttgttggggtgtgtgtctgtacattagatgagttttgagtctattcaacacatatgtgtagaaccactatgttatattccactgatacagatatgcagaggccatcattcccccatatatgtatagagcactcctatcctacttatttaaattaatttgttcttcattcaaattaacatgagcatctgtgaaacactcaaggcaaaaggggcaagttcccaatcatggataagaattgcagttgggcggccaggcgcagtagctcacccttgtaatcccagcactttgggaggccaaggcaggcggatcacctgaggtcaggagtttgagaacagcctgtccaatgtggcgaaaccccatctgtactaaaaatacaaaaattagccgggtgtggtggcgcatgcctgtagtcccagctacttgggaggctgaggcacaagaatcacttgaacccaggcagcagaggttgcagtgagagccgtgatagcgccactacactccctcctgggcaacagagcgaggctccatctcaattaaaaaaaaaatttaaaaaagaattgtagttgggcttcaagaagactaacattaactctttctctgtctccaactcagtcatcatggcttctgctctaaccacttaatctccatggtctcagtaaaaccaggtgagtctggatgggtaggcaaaagtggggctggataggagaggaaatagactgatggaggaaaggaagatctgccagagtggacattttaaacctgtccttcagagtaggtgtagtgggtgagaggtctttttagcttgtgtatttgcacagactctggcgggcagagaggagagagtgaaagtaagggctctgaactatgtccttgaggaagctgatgagttgttcacttccagtgacatgggaagcatgtggagtcaagaaatgggatatctttactgcgaaagatgaaggaaacctcaggtctttcttgttctcagctctaaaatagtataagaacctcattgtgcttctctatttctgtgtcatggacccagtctgtagtctggaacaatttccccatatgcttagggaactctgtcttgttccccaggggtaaaattagttagatttatgtgggttggaagttttagtagtctgagcctgtgagaacaagaatgccaaaagagtagtaaagaaaacctgactctggaattctcattcacagaatactgcaactatcctctgaagaagggcacctgtaattcatatttgaccagattctactacaacactttgacatttttatgtgagccctttgtcttcagtggctgtggaggcaacagaaacaactttaaacagaaatatttctgtgaaaaaatgtgtattactgaaaagtaagtctctggatatcttacccaaccctcaatgacaccaaacactagggatcaaagctttttaaggaaaaaggaaatgaaaggcaagggcaatgagcagggaggcaagaaattatacctaagttagggatagcctgtcataggtattaatttctcaggtcacttaaatgtcactataatcagtcataggcataagtttttcaggtaacttagtttaataacattcttgaaattgtgaaaattgaagttcagccaagcacagtggtgtgcacctgtagtcccagctacttgggaagctgaggcaagaagattacttgagcccagcattcaagaccagcctgggcaatacagcaagacttccatttagatagatagatagatagatagatagatagatagatagatagacagacagacagacagacagacagacagacagacagatagatatagatagccaggcgcggtggcttatgcctgtaatcccagcactttgggaggctgaggcgggcggatcatgaggtcagtagatcaagaccatcctggctaacatggtgaaaccccttccctactaaaaatacaaaaagttagctgggcacggtggcacacacctgtaattccagctactcaggaggctgaggcaggagaatcgcttgaacccaggaggcagaggttgcagtgagccaagatcatgccactgcactccatcctgggcaacaagaacgagactctgtctcaaaaaaataaaaataaaaataaaaataaagctcagagaggctactgatttgcccaaattcactcagaagaaggacatggatccagagctcctagctccccaccagcatctcagtactaccaggatggcatcagctttttgagattgtgttcaacatcttattgtttcacagttaaatggaaagctatgagaatgtcagaagagtaggagaagacaaggatcatggtttagtatccactataaagaatagctaaacaatggtcttacacgcaagagcagagatatcactttattcatctgtatattctcaaagtctagtactatgtttgcccattaatattttatggatagatgcatgggtcaggaggaatattagtattaaagagagctgtgaagttctgctgagatgttaaggacccattgtttgggtccttattgataccaatggccataataatctctaaatttatttattcattaacagggaccaaagtcaatagggccttaatatgacagaaggaggaaacaaggaaaaaggagtatgctctatgaaaaatcatgccaaagttattctgagaaaataaattggattatttctaaaagatttttgaattctgaattctttctaatttccttgcccaggtttacctttcatactaattagatatataaaactttaactgaaaattttctgtatgtcagctctggtctgaatttattcatctctcccattctagattcttccaacatatactgcaaatgacctctctgcagggaccaacctatccatgtaatgcatcagtgtatgtaaaggcaatcattattgatatctcctcggcatgacatgccaaaactgagtttctttctgtattttgtcactgacttcagtgggatttgcatgtaggtggcaccaagataatcattattaaattctttcacctgctccaaatcaaagggcattcaacccacaaaagtgatcatattctagggaaatatcttcagtgccctagctacaagccatatggaaattgtgactttacagctgagagctatgagtcttgaaccaaagtgaacctctactctcagagcatgaagggccactcccttcttctctgtcttattcatattcttgtcaaggactaagcctcacaaatgaatctattgatataaatagcttatgccagtgttctaagggccataaacagtagaataaactgaagctcagagtgaagccacttgtgggtattctagctcgatctcaacactggcaacccctaatcctgaattatgggcatatcctaggagaaatcatgggaattagcaaaaagtatgtgttaaagatgtcacctagttctgcttccaggaattactcctgtgcaaaaaagggacaaaggaaacaagaatgttctggtagcttctaggtattgaggcaaagtctagaatctcagaccatgctgtgtcttgggcctgaatgtcatggtgcctattcatggattctgaagattttccttcctctgattactgtaaaaaacagtgttacataaacaagattcaagtgcaattttttaagtctttcaaaactatagtctagtccaaagaattaatataagtaaaatattctctggagacaaagaattaccgacaatgatgacccaaagttcattctagcctcaagttttcagatttcttctgggcacttgagtaattgcccaagtttctttctcaatcaatcctatatttgcatctaagaaaaaggtatgtgtgtactgtctgtagtgctgaaggaatattttataattacccacaaagattagtaaaaaggcccaaagatatatgtgcattgcagaccttcatagaaaaccacatacccaaggactaatacaggacacaaatccacaagaaacccaagtggatttcacattaaattcaagtgagatattttgaggagaaagtcacagatagaagagtaacaaagataaaaatataaaccaaaacctcagagtacaaaccaaagacagaatgaaaagattttggttctgactctagcctcttcccctgagtcatatcttaccactggagaaactgaaaggaaaagatcccattacatatgagatggaaattaaaagtggtttaagaagattctgatttctcatttaaaaagccccaaagagtaggcgtagtgactcacgcctataatcccagaactttagggggtcaaggcaggaggatcacttgaggccaggagtttgagaccagcctgggcaacacagcaaaacttgtctattaaaaaaatacaaaagatggccaggcccgatggctcacacctgtaatcccagcactttgggaggccaaggtgggtggatcacctgaagtcaggaattcgagaccagcctggccaacgtggtgaaaccccatctctactaaaaatacaaaattagccaggtgtggtggcgcatgcctgtagtcccagctacttgggaggctgaggcaggagaatcacttgaacccaagagggagaagttgcagtgagccaagatcatgccattgcactccagcctgggcaacaagagcgaaactccacctcaaaaaataataataataataataatacaaaaggccaggtccagtggctcatgcctgtaatcccagcactttgggaggccaaaacaggcggattgcttgagttcacaagttcaagaccagcctggacaacacggcaaaactccatctctacttaaaatacaaaattggcaaggcatggtggtacatgcctgtagtcccagctgcttgggaggctaaggtaggatgccggcctcagccaggagacagaggttgcatgagccgagatggcaccactgcactccagcctgggcgatagagccagatcttgtctcaaaaaaaaaaaaaaaaaggtggtggggagaagaaaaaaaattgtaatacaaaagataaacaaaacaaaaagttgtttttttggaaagataacaaaactggcaaacctttagctagactaaccaagaaaaaaatgaagaccaaataaataaaatcagggatgaaaaaggacacattacaactgataccgcagaaatacaaagaatcactagagactttttttttcccctgagatggagttttgctcttgttgcccaggctggagtgcaatggcacgatctcagctcactgcaacctccacctcccgggttcaagcgattctcctgccttagcctcctgagtagctgggattacaggcatgtgccaccacacccagctaattttatatttttagtagagacagggtttctccatgttggtcaggctggtcttgaactcccgacctcaggtgatccactcgcctcaggcttccaaagtgctaggattacaggcgtgagccaccgcatccggcctggatcattagaggctattatggaaaactacacaccaacaaattggaaaactaaaaagataaattatttgacacatacaacttaccaaaattgaatcataaagaaacagaaaacttaaacaggccaactatgagtaatgagatgaaagcagaaattaaacgtatctctttaaagaaaagcataggacctgatggttttactgctgaattctaccaaatatttgaagaagaattaatacaaattctactcaaattattctaaaaaattgaagagggaatacttccaaactcattctacaaggcaagaagtaccctgtggccaggcatggtggctcacgcctgtaatcccagcactttgggagactaagagaccaaggcaggtggatgacttgaggcgaggagttcaagaccagcctggccaacatggcgaaaccctgtctgtactaaaaatacaaaaattagccagggaggtggcgcatgcctgtaatcctagctactcaggaggccaaggcataaggatcgcttgaacccaggaggtggaggctgcaatgagccaagatcgtgccactacactccagcctgggcaacagggcgagactctgtctcaaaaaaaagatcattcaccatgatcaaatgggattcatccccagatgcaaggatagttcaacatatacaaatcaataagcgtaatacaccccatcgacagaatcaaaagagccatatgatcatttcagtagattgtgaaagagcatttgataaaattcaacatcccttcatgataaaattctcaagaaattggatatagaaagaacatacctcaatgcaataaaggccataagtgacaagcacatagctaataccatacggaatggggaaaaacggaaagccctttccactaaggtctgaaacaagataatgatgccactttcaccactgttattcaacatagtactagaaatcctagccagagcaattaggcaagagaaagaaataaagggcatccaaattggaaaggaagaagtcaaattagccttggaaacacatgacatgatcttatttttagaaaaacctaccccaccaaaaaattcttagaactaatcaacaaatttagtttaattgcaggatacaaaatctacatacaaaaatcagtagtgtttctatatgctaacaataatcaatctgaaaaagaaaccaataaagcaatctcctttacaatagctacaaaaaaaaaaaacctaggacaaaattaattagaagatctccacaaggaaaactataaaatactaatgaaagaaactgaagagtacaccaaaaaatggaaagatatcccatgctcataggtcagaagaattaatattgttaaaatgcccataatatccaaagtgaccttcagattcaatacaatctctattaaaatatcaatggcattcttcacataaacaggaaaaaaaaattctaaaatttgtatggaacgacaaaagaccccgaatagctaaagcaatcctgggcaaaaacaacaaagctggaggtatcacactacctgaattcaaattatacaacaaagctatagtaaccaaaacaaagctatagtaaccaaaacagcatggtattggcacaaaaacagacacatagaccaatggaacagaatagaaaacccagaaatcaatgcatgcacatatagacaactctttttttttttttttttttttttttgtgagacggagtcttgctcggtcaccctggctggagtgcagtggcgtgaactcagctcactgcaagctctgcctcccgggttcacgccattttcctgcctcagcctcctcagcagctgggactacaggcgcacgccgctatgcccggctaatttttttgagacaactcatttttgacaaaggtgccaagaacatatattggggaaaggacagtcttgttaataattggtgccgagaaagcgggatatctatatgcagaagaatgaaactagattgcaatcttttaccatatgcaaaaatcaaataaaaattgattaaatactgaaatctaatgcctgaaactacaaaactagaagaaaacattagtcaggacattggtcttgggaaagattttctgggtaagacctcaaaagcaaaagcaacagaagaaaaaacaaacaaatgggattacatcattaaaaagtttctacagccaggcgcggtgggtcacgcctgtaatctcagcactttgggaggctgaggcaggtggatcacctgaggtcaggagttcaagaccagcctggccaacatggtgaaaccccatctctacttaaaatacaaaaaattagctgggtgtggtggtacacaactataatcccagctacttgggaggctgaggcaggacagtcgcttgaacctgggaggtggaggttgcagtgagccgagatcatgacattgcactccagactgggggaaaaaagcaagacttcatctcaaaaaaaaaaaaaaaaaaatttctgcatggcaaaggccagttgcctttaatcccctataatccccacactttggaggccaaggcaggcagatcacctgaacctgaggtggagagtttgagaccaatctgggcaacatggtgaaaccctgtctccactaaaaatataaaaatcagccagatgtggtggtgcacacctgtaatcccagctactcgggaggctgaggcacaagaatcacttgaacccaggaagtggaggtttcagtgagccatgattgcagcactgcattccagcatgggcgacagcgtgagaccctgtctcaaaaaagaaaagacaagctacaggatggaagaaaatatttccaaactacctcatcaacaagggactaggctatgcacagtggctcacacctataatcccagcactttgggagacagaggcagcaagatcacttgaggccaagaatttgagaccagtccgggcatcatagcaagactctgtctctacaaaaaaaaggcaacaacaggaattaaaaatatataagaaactcaaacaactcaataccaaaaaaaaaaaaaaaaaaaaatctggctggcacagtagttctcgcctgtagtcccagcacaaggccaaggcaggtggatcacttgaggccaggagtttgagaccagcctggccaacatggcgaaaccctgtctgtactaaaaatacaaaaattagccagatgtggtggtgcatgtctgtaatccctgctacttgggaggctgaggcaggagaatcatttgaacccaggaggcagagggcagagtttgcagtgagacgagactgggccactgcactccagtctgggcaacagagcaagactctgtgtcaaaaacatatatatatatatgcgtatatatacgcatatatatacatataagtatgcatatatatatgtgtatatatatgcatatgtatgtatatatatctgtatatatatgcatatgtatgtatatatatctgtatatatatgcatatatacatgtatatatatatctgtatatatatgcatatatacatgcatatatatgtgtatatacatacagatatatatatacacacacatatatacatatatctcaaataaagagacattcttgggcaaaggggatttgtcccagtggtcttgacagtgccacaaatcattttaacacttttgggtatagccagaaccatcctagtggtctgaaacacaaaagtgaggcccagactacttagggagatcaggctgggtgccagaaattaaaaggataggagccagagacaggtaagcagaaagtttacaagaaaaaaaaatggaagatgaacaaagaccctaggcctctgccaggtgggctgtgagagaagaggtttcaaaagaggaagaacttaagatgacattcttacagacagacccctggccattgcagaagcatttctgggctccttggcgccccccagtccaggaggcactgcaggacacaggaggccttggagctcatgggcaccagagcccaggcttccatgtagctgagatacgatctggcactgcagtcctcaaggtcttgcaggggccctctgacccccggttccagccctgggacacaattgccctgctacatgcttcctttctataattaaagaaggaaaccctcagggcaccccactccaccactcacctctcgccagggaccaggtaccagggtgggtgtcctcttcctgaaaaagaaaggcttagatgaagcagtcccttgtgaaacaggcagccattagcaccagggcccagcctaggtgagaactctcaggccctgcctggcagcccacagccaggcatggttgagataccaagttactctacagatgtctttgttttttgttttttttgagtcagagtctcactctgttgcccaggctggagtgcagtagcgtgatctcggctcaccgcaacctctgcctcccaggttcaagcaattctcctgcctcagcctccagagtagctggaattacaggcgcccaccaccaagcccagctaatttttgtgggggttttttggggtttttttgtttgtttgtttttgagacagagtctggctctgtcacccaggctggagtgcagtggcgcaatctcggctcactgcaagctccgcctcccggcttcacgccactctcctgcctcagcctcctgagtagctaagactacaggcacccaccaccacacctggctaattttttttttgtaatttttgtagagacagggtttcaccttgttagccaggatagtctcaatctcctgacctcgtgatccacccacctcagcctcccaaagtgctgggattacaggcttgagccaccgcacccggccaatttttgtatttttagtagagacggggtttcaccatgttggccaggctagtctcaaactcctgacctcaggtgatccacccgcctcagcctcccaaagtgctgggattacagacatgagccaccgtacccagcctgcatttttttttaagcattaggttggtgaaaaaatattttgattttttttaaaacaagcaagcattacttttgtgatcttttaaaactgattggatgaaaaaatggaaaatgtaacataagaagtgtcagacctctgagcccaagctaagccatcatatcccctgtgacctgcacatacacatccagatggccggttcctgccttaactgatgacattccaccacaaaagaagtgaaaatggcctgttcctgccttaactgatgacattgtcttgtgaaattccttttcctggctcatcctgtctcaaaaagctcccctactgagcaccttgtgacccaccccccaactctgccctccagagaacaactcccctttgactgtaattttcctttatctacccaaatcccataaaacggccccacccttatctcccttcactgactctcttttcagactcagcccgcctgcacccaggtgaaataaacagccacgttgctcacacaaagcctgtttggtggtctcttcacacggacgcgcatgaaatttggtgccgtgactcggattgggggacctcccttgggagatcaatcccctgtcctcctgctctttgctccgtgagaaagatccacctatgacctcaggtcctcagaccgaccagcccaagaaacatctcaccaattttaaattgggtaagcagcctctttttactctctcctccaacctccctcactatccctcaacctctttctcctttcaatcttggtgccacacttcaatctctcccttctcttaatttcaattcctttcattttctggtagagacaaaggagacacgttttatctgtggacccaaaactccggcgccggtcgcagactagggaaggcagccttcgcttggtgtttaatcattgcagggatgcctctctgattattcacccaggtttcagaggtgtcagaccacgcagggacacctgccttggtccttcacccttagtggcaagtcccgcttttctggggaagggtaagtaccccaacccattctctctgtgtctctacctcttctttgcctttctggggggcaagaaacccccaaccccttctccttcacccttagcggcaagtcctgcttttctaggggaggggcaagtaccccaaccccttatatctctgcaccccgatcccttatttccacgccccaaccccttatatctctgtgccccaatcccttatttccacgccccaaccccttatatctctgctccccgatcccttatttccgtaccccaacctcttatatctctgcacccgatcccttatttccacaccccaacctcttatatctctgtgccccgatcccttatttccacaccctgacctcgtatctctgtgccccaacccctttcccacttttctggagggtaagaacccccgaaccccttccctccgtgtctctactctctcttttctctgggcttgcctccttcactatgggcaacattccaccctccattcctcctcctccttctcccttcctgtgttcttaagaacttaaaacctctttaactttcacctgacctaaaatctaagcaccttattttcttctgcaacaccacttgaccccaatacaaacttgacaatggctctaaatggccagaaaacagcactttcgatttctccatcctacaagacctaaataatttttgtggaaaaatgggcatttttcacacttcgttccctccctagtctctgttcccaatacgattcctcccaaatcctccttctttccctcccgcctgtcccctcagtcccaaccccaagcgttgctgagtctttccagtcttccttttttctacagacccatctgacctttctcctcctccccaggctgctcgtcgccaggccaagctaagtcccaattcttcctcagcctccgctcctccacactataatccttctaccacctcccctcctcacacccggtccagcttacagtttagttctgcaactaattcttccccacctgcccagcaatttcctcttagagaggtggctggagctgaaggcatagtcagggtacatgtacctttttctctatcagacctctctcagatcagtcagcatttaggctctttctcatcagaccccactaaacatatacaggaattccaatatctaactctgtcctacaatttaacctgaagtgacttaaatgtcatcctgacttctaccctctccccagatgaacaggaaagagttttttctctagcccaatttcacactgataaccgccggcttcgtgaacctgacctccaggaaggcagtagagcagttccccgagaggacccccaatggaactataaggcagattccccaggtacagctaggcgagattacatggtttcctgcctagttgaagggcttaaaaaggcagcttacaaagctgttaattatgacaagcttaaagaaactacccgaggtaaagatgaaaacccagcccaggtcgtggcccgcttagcagcaacccttacacactttaccgccctagacccagaggggccagaaggccgccttattcttaatatgcattttatcacccaatccactcctgacattaggaaaaaacttcgaaaattagaatcgggccctcaaaccccacaacaggaattaatcaacctcgccttcaaggtgtacagtaatagagaggaagcagccagacggcaacgcatttctgagttacaattacttgcctctgctgtgagacaaaacccagccacacctccagcacacaagaacttcaaaatgcctaagccgcagcagacaagcattcctacaagacttcctccatcaggatcttgcttcaagtgccagaaatctggccactgggccaaggaatgcccgcagcccaggattcctcccaagctatgtcctatctgtgcagggacccactagaaggcagactgcccagctcgcccggcagccactcctagagcccctaaagctctagcccaaggctctctgaccgactccttctcagatctgctcggcttagcgactgaagattgacgctgcccgatcacctcggaagccccccggaccatcatggacgccaagcttcaggtaactctcacagtggagggtaagtccatcccctgtttaatcgatacgggggctacccactccacgttaccttcttttcaagggcctgtttccctcaccccgataactgttgtgggtattgacggccaagcttcaaaaccccttaaaactcccccactctggtcccaacttggacaacactcttttattcactcttttttagtcatccccacctgcccagttcccttattaggctgagatattttaaccaaattatctgcttccctgactattcctggactacagccacatctcattgccacccttctccccaacccaaagcctccttcgcgtcttcctcttgtatcccaccttaatccacaagtatgggacatctctactccttacctggcaaccaatcacatgcccattaccatcccattaaaacctaatcacccttaccctgctcaatgccaatatcccatcccacagcacactttaaaaggattaaagcctgttatcactcgcctgctacagcatgggcttctaaaacctataaactctccttacaattccccattttacctgtccaaaaaccggacaagtcttacagattagttcactattcccctgcacccctcgtcccagcctctctttgctttcacttagactgaccctgacacccattaggctcagcaaattacctgggctatactgctgcaaggcttcacagacagcccccattacttcagtcaagcccaaatctcatcctcatctgttacctatctcggcataattctcataaaaacacatgtgctttccctgctgatcatgtccgattaatctcccaaacctcaatcccttacaaaacaactcctttccttcctaggcatggttagtgcagtcagaattcttacacaagagccaggaccgcaccctgtagcctttctgtgcaaacaacttgaccttactgttttagcctggccctcatgtctgcgtgcagcggctgccgctgctttaatacttttagaggccctaaaaatcacaaactatgctcagctcactctctacacctctcataacttccagaattattttctttctcacacctgacacatatactttctgctccccggctccttcagctgtactcactctttgttaagtctcccacaattaccattgttcctggcccggactccaatccggcctcccacattattcctgataccacacatgacccccatgactgtatctctctgatccacctgacattcaccccatttccccatatttccttctttcctgttcctcacccaatcatgcttgatttattgactggcggttccaccaggcctaatcgccacacaccagcaaagacaggctatgctatagtacaagccactagcccacctcttagtacctctcatttcctttccatcgtggaaatctatcctcaaggaaataacttctcagtgttccatctgctattctactactcctcagggattattcaggccccctcccttccctacacatcaagctcaaggatttgcccccacccaggactggcaaattggctttactcaacattccccgagtcagataactaaaatacctcttagtctaggtagacactttcactggataggtacaggcctttcctacagggtctgagaaggccaccgcagtcatttcttcccttctgtcagacataattcctcagtttagctttcccacctctatgcagtctgataacagacgagcctttattagtcaaatcagccaagcagtttttcaggctcttagtagtcagtgacagactaatggtctattaaaaacacacctcaccaagctcagccactaacttaaaaaggactggacaatacttttaccactttcgcttctcagaattcaggcctgtcctcggaatgctacaaggtacagcccatttaagctcctgtatagacgctcctttttattaggccccagtctcattccagataccagaccaactcagactgtgccccaaaacacttgtcatccctactatcttctgtctagtcatactcctattcactgctctcaactactcatacatgccctgctcttgtttacactgccagtttacactgtttctccaaaccatcacagctgatatctcctggtactatccccaattagatgtcctaggtcctcccaattcttagtcctttaatacctgtttttgtccttctctaattccgtttattttttaattcatacaaaactgtatccaggccatcactaataattctaaatgacaaatgtttcttctaacaaccccacaatatcaccccttaccacaaaatcttccttcagcttaatctctcctactctaggttcccacgccgcccctaatcctgctcgaagcagccctgagaaacatcgcccattctctctccataccacccccaaaacttttcgccgtcccaacactttaccactatttcattttatttttcttattaatataagaagacaggaatgtcaggcctctgagcccaagctaagccatcataccccctgtgaccttcacatacacatccagatggccggttcctgccttaactgatgacattccaccacgaaagaagtgaaaatggcctgttcctgccttaattgatgacattgtcttgtgaaattccttttcctggctcatcctgtctcaaaaagctcccctactgagcaccttgtgacccccactctgccctccagagaacaactcccctttgactgtaattttcctttatctacccaaatcctataaaatggccccaccctgatctcccttcgctgactctcttttcagactcagcccgcctgcacccaggtgaaataaacagccacgttgctcacacaaagcctgtttggtggtctcttcacatggacgcgcatgaaaagaagaatactttaaaaaaaaaaaaaaaagcagcatcagcaccacctggaagcttgttatttatacagaatctcagacccacctgaaacctactgcattggaatttgcattttaacaactctggtgatttgttttctcatttcacaagttgtagtctgtgaaaaatcaggagctatcaggaaaggagatctactcccctggctactgcgaatcaaggtttcttctgcatctacgactgctacccataaaatgtgaaatacccttcaggaatctatacggctctaaagactcatagtgagatgttaagtatccctttctccttcctaatagcagcctatttcctttcaaggaattctcttcccctgttctatgtcttgttgtgagggttaatttcaggtgcctgctaacccaaacaagccagagaagcaattcttttctctaggttctcaaccaggggtgattttgccccccaggggacattttggcaacatctggaaacatatttgtttgtgacaaatgacagggagagattctggcatctagtgaaaagcagccggagctgctgctaaacatcatatagtacccaggatggcccctcacagcaaataattatccagcccaaaatattaataggaccaaggctgcgaaaccctgaatgagtaattacatatattctccctctttcaggaagtctcaatcttgagagaagggggaaagagaaatagaacatcgctgtcacagcagcgtcactgtgacccaactcttcctgcctagatgacctgcttcctccctcttgaccctccagagtgctgtcaattccctaccatggagccctagctttgcataaatcatacgagccccaatttccttccagttcactgtcatttgcccaagtcagccagtatctttctgttgatggtaaccaagaacccttacgcccaaccatccaattagaggagggctccattccagggcagggcaggcttacccagctgctaggctaagcacacacttcaagcatcagcaagtaactgacaagttcagcttgaatgaacttaaccagaatttgcagtcaagaaaactagaaagaaactgttttaatttcagtataagtgtttcattttgcatcaagtgatttaaacagttcattatttgggaccctgatgttctgggccatcaggtggggcaggtttgctctggttttgagtttcagtgctaagaaggaagaggaaaacgagagagaagagattgagttgtttatattatctggcctcaggtgagagagtactggaatgagaagcctatgtttaaaggaaaaaaatattaaaactgggaaagtattgaacatggaaagatgtaacctatacaatgaagtacagcacaatggaagaacctaaaaattaaaaccaagaatacatatatatatttcttgatatatatatcaagaaatagcaatctatctgcaagccgaaaagtgttgcagaaggaatggaggctttgtcatcgaatacacctgctggtttaaccaaactaagattgaaagtaaaaaccttagcctgggaaacatagcgagaccccatctctacaaaaactgaaaaaaatagccaggtgtggtggtgcatgcctgtggtcccagctacttcggaggctgaggtagaaggattgcttgagcccaggaagtcgaggcagcagtgggccgtgtttgagccactgcactccagcctgggtgacagagtaagaccctgtctcagaaaaaaaaaaagaaagaatgtaaaagcgtttgaagccatttggcaaagatcatggaaaacagggcaagcaatagctacagagttccagagccatgttaaattaataaataagtaaatatttaaacattgaataccttaacaattaaaaatcatatctatctattatattgttgaatgacaaaagcctattacaggatgattctacctatatcgacatttgcatatatgcataaagcaagtctggaaggaccttcacaagcatgttaacaatggtcacctatgggtagggagatcttctttgaatttttttttttttttttttggtgcattagcgatcttgatggtttcaaatgtcatcaccagggaatgataaacgctggggcctacttagggtggagggcaataggagagtgaagattgaaaaactacctatctgatattatgctgattacctgggtgacaaaattttctgtacaccaaatccccaagacacacaattagtgcgtgtaacaaacctgcatatgaatccctttaaagtaaaatacaagttgaaaggaaaaaaataaaacctcttcaatcatctttcagatagcaatttttttcattgcttcttcagtgtacataaatattcttttacatcattcacacttctttgaacttttctgtactgtttaaatatcgcaataatgtttatgcatcctattttaaaaacaacaacaacaaattaaaaaataaaaaggagaaggaggaaggtgaggaggagaaaaagaataacaaaaaagacttgtgatcctaagcatatagacagctcagaaattgcaggaaagctgaaaaagaaaaacaagagaaaggtaaaggaagaatgatcattaataatattactaaattgggccaggcacagtggctcacgcctgtaatcccagcactttgggaggccgaggctggtggatcatttaaggtcaggcgttcgagaccagcctggccaacatggtgaaaccctgtctctactaaaaatacaaaaattagctgggcgtggtggctaatggtgggtgtaatcccagctacttgtgaggccaaggctggagaattgcttgaacccagggagcagaggttgcaatgagccaagagcacaccattgcactccagcctgggcgacaagtctctgtctcaaaaaaaaaaaaaaaaattactgaattgggctacagattcttagagctgctgatgggactttcatgaacttctaattcagagatccccaaaccagaccacacattagaattccctgagggctttttttaaatattgctctgaataaacacataaacaagcagttcccttggcccaacccatctttgacctactgaatcaaaatatctggaatgggattggggaatctgcacattgaccagcccgtgcaaggatctaaaaccagcccctggcaaccactaatgtacttctgtctctacgaatttgcctattctagatgttccatataaatggaattatatggccttttgtgactggcttctgtcacttagcatgttttcaaggtccattcatgttatagaatgtattggtacttcattcctttttatggctgaattaatatttcattgtattgatataccacattttgtctctccattcaccagttgatagatatttgagttgcttccacctgttggctattgtccacctgtttctatttctatgaacatttgttcacaagtttttgcttgaacatctaggggttttgtttgtttggttttggtttgggttttttgttttttgttttttgttttttcagagatagggtctgtcacctaggcaggagtgcagtggcaccttcttagctcactgcagccttgtattcctgggctcaactaatcctcccacctcagcctcttgagtagctagaactacagttatgatgccaccacaccctggttatttttttaatttttctgtagagacaagggtctcactatgttgcccaggctggtgttaaactcatgttctcaagcgatccttccaccccagcttcccaaagtactggggttacaggtgtgagccatcacacttggccattggatacctgtttttagttcttttgggtatatacctaagagtgaaattgctgggtcatatggtaattccacatttaacttattgagaaaccatcaaactttttagggtttttttttttttgagacggggtcttgctctgttgcccaggccagagtgcagtggcacaatcatagccccctgcagcctcaatctcctgagctccagtgatcctcccacctcagcctcccaagtagctgggactataagcacatgtcactacacctgactgactttttttttttttttttaagtagagacaagattttgctatgttgctcaggctggtcttgaactcctgagctcaagcagtcctcccacctcagtctcccaaagtgctgagattacaggcatgagccactgtgcccagaccactgtttagttttttaatgtggctactaaaaaacttgaaattacatacatggcttgcattatgtttctgtgaaagagtgctgctctggatgcttctttctgcccaagtattctactggaacttacctctcatttacctttgccctcacctgcttccaaacaagactcaaggaggaacttaatactataaaacagccaggtgcagtggctcacgcctgtaaccccagcactttgagaggccaaggcaggtggatcatttgaggccaggagttcgagaccagcctggccaacttggtgaaaccctgtctctacaaaaaatacaaaaattagctgggcatggtggtgcgcatctgtagtcccagctacttagggagctgaagcaggaggatcacttgaacctgggaggtcgaggctgcagtgagcatgattgcaccactgcactccagcttgggagacagagtgagaccctgtcacaaaaaacaacaacagaaaataaaatactacaaaacaagttacatgaaaatgaaagtctttaaaccaagagtgaaaaaaggtaggggatccaggcgcagtggctcacacctgtaatcccaacactttgggaggccaaggcatgcagatcatgagatcaagagatcaagaccatcctggccaacatggtgaaaccccatttctactaaaactacaaaagttagctgggtgtggtggtgggcgcctgtagtctcacctactcaggaggctgaggcaggagaatcgcttgaacctggaaggtggaggttgcagtgagccaagattgcaccactgcactccagcctggtgacagagccagactctgtctcaaaaaaaaaaaaaaaaaaggtgggggaggacaagtaataaaagagggtggcaagaaggatcgattttgtcagagaaactgaataacaacagctaacatttattgagtgtgtgctttgtgccaggctctgctaagtgctttctttataatctttttttttttagacggagtctccctctgtggcctaggctggagtgcagtggcacgatctcagctcactgcagcctccaaatcctgggttcaagcaagtctcctgcttcagcctcccgagtagctgggactacaggcgtccaccaccatgcccagctaatttttgtatttttagtagagacgaggtttcaccatgttggccagggtggtctcaaactcctggcctcaggtggtcgacccacctcggcctcccaaagtgctgggattacaggtgtgagccactgcacctggccagtgctttctttataatggactcttcacaccaattctatgaggtaggcagtgtggtaatgttattatacacacaaagctgataagcagcacaagattatagattcagacccaggccttactccgaaacctgagctcttggcaccctggtagccaatgcgaagatggaaacatcagctctagaaagcccctaccacagagtctggaaagacagacgatgcccagtaagttatttccctgcccattctcacactaactcagagggagaaactttttcttgatcttgagctccacagggaatttgaccctgtggctttgtacaagaaacactaatacgacatagtgggtaatgtcccccatatcaatgttaccagaaatgaagcagcatgccacatcatatgaaaacagagggcataatgttaggtcttaatttattaagtgcagttcagtcgggatccaggagcttagacagctgatagcaagctttcactttatcttttagaatgcccttttgcccttttgagtctcttgcctggaaatggtctatgacagacctctgctgccctctggtgggcagagcatgaagcacccagcaaagaattctttccagtcacatggcctcttctttgtttatattgctgaatctgtgggaagctgggcttctccacacaatcccttgaggagaaggcttaacttgtatatgaaaggaaagacacctctcccaactcaagagcaacccactgccaggatacgctctgggcctcctgccttcctcaccccacttacacgccttaccaataacatcatgcccccacgggagcagtggaggctgcaggggcccatggtattgctggggccaagggcacatatggagtctgagatttctacaaccagatggtcaagaagcagggtggagaagggaggagctgcgtggttctggtcaaagaacaagtctttctcagcctacactggagccccagacattcctgcccacgatgaggaagctgaggagcagggcgggggagaagggtggcttttcaacctggtcagaggctaatttcggggtgcaaggtgagagagtaggatcacggtccactgagacctgctcctgggtcatttccaccccaggaccaaggctgaaatggacttaaaccctgaggaaggaaaggttctaatggcttctttagttcagggtccaacagtagagaaagctgcccagaaagacctgggggtgggaatttggccccagctcagcctttaaccgccagctttcaaatttaacccttcagcactctctctcatctctatctctctctcatctccatctctatctctctatacatctatctatctctctatctctctcgacgttgctacctgtaagcaggtcagcagctccctctggaaagggtgagcctccagacgaggaggaaaggtctgcaaggagcagctctcccattgctcagcctgagctgtgcctggggctcacacctgtctctccagtcccactctccaccctgacagaacatcattctgcaatatgagaggattcccagactgttgtttttcattgaaagttctaccatactgatgatttttttttttttttttttttttgagatggagtttcgctcttgtcgcccgggctggagtgcaatggcaggatctcggctcacttggaacttccacctcccaggttcaagcaattctcctgcctcagcctcctgagtagctgggattacaggcgtgcaccaccaagcctggctaatttttgtatttttagtagagacggggtttcaccatgttggtcaggctggtcttgaactcctgacctcaagtgatctgcctgccttggcctccgaaaatgttgggattacaggcgtgagccactgcacccgaccactgctgagtgtctgtgccttctcccccttgttttcatcctggcatgtgaaattctggtttctacctggttcagaacatttatctcttttcagtacagtagacatgtcaatgttgcctgatctgaaaaagagtggctggcatgaacctcgcagtggccaacccagaaacatccatgactccaggatcatgttgcagggaactgggaagggccagtgtctgtgtgatgggctgctgaacattttggcagatccctcttccactgttttatcattttgttgtttatttaaaaactcgaatacatgcacatagtttttttaaaaatcattatatcatcacaccaccacacccggctaatttttgtatttttagtagagacagggtttctactaaaacagtcaaaggcacagctactcagaaggctgaggtaagagaattgcttgagcccaggaggcggaggttgcagtgagcggagatcgtgccactgcactccagcctaggcgacagagcaagatttcgtctcaaaaaaaaaaaaagataactagttaaataaattacccatttcatagagttctattaaaagaatatacgtgatgacatgaaagatctccaagatacacaatataatccatttcatataaataaaaaacataactttaaaaaattatcttggtcccaagaacctagggatatcccctccctaaaataaagctacctggaggggacaaactgcctgtcttggagccaagggctggccctcaaggaaggaggtccaaggtgggaacattccaacatctataagaaactagccactcggctgggcacagtggctgacgcctgtaatcccagcactttgggaggccaaggcaggcagatcacctgaggtcaggagttcaagataagcctggccatcatggtgaaaccccgtctctactaaaaatacaaaaattagtcaggcatggtagcgcgcctgtagtcccagctactcgggagactgaggcaggagaatcacttgaacctgagaggcagaggttgcagtgagccaagattgcgccactgcactccagcctgggcaacagagtgagactacatctcaaaaaaaaaaaaaaactagccactcacccttgttccaccctcaacccacattctccaataaaagaaagaaggtcagcaggtctaaaagagactgacctccacccccaccagggcttgagaaagacatctatggcaagtcactctcagtttagtttccaccctcaacccacattctccaataaaagaaagaaggtcagcaggtctaaaagagactgacctccacccccaccagggcttgagaaagacatctatggcaagtcactctcagtttagtttccacccatctcttccctagccacacccaaccaaaacccattttcagtgtcctcacaaagaatggattacccatctgtcctaaatatgtaaatcgtacaatcccacaggcacacacataccctctagctctcccatatcatctgagccctcaaatagcacaaacaagaggtcagcaccagcctttatcgggaaagagaagcaccacacacccactacccaatccagggctatttcccatgctctggtcagcggcaggaggagaagcagagcagagagggccatgagtgcccctggaaatgtcacaagccccaggatgtcaccctctcttgactgccaggaaaagcttccagaattaccaaagaagctccagacaaatcagcacagctagggcaccgggatctctgcaagtagaagaaacatcaagtcacagctgtgccctcctggcttcagctacctgaaatgttttccctccaccctaggaaagcttggcctatattgctctcaaaagtcttaaatagctccttgcttcccagacaatccaatccaaactggcactgaaggctcttattattcagatgtcaaccttgtatctcctgttataaaaaactggaattatggtcgggcacagtggctcatgcctgtaatcccagcactttgggaggccaaggtgggtggataacctgagatcaggagctcgagaccagacctggccaacatggtgaaacactgtctctactaaaaatacaaaaatcagctaggtatgatggcaggcgcctgtaaatcccagccttgggaggctgaggcaggagaattgcttgaatccaggaggcagaggttgcagtgagtcgagattgtgccattgcactccagcctgggtgacaagagtgaaactccatctcaaaaaaaaaaaaaaaaaaactggagatacgtctgttcctttacccaccctgcccccactcctcacctcccaaacatatcccacacattcccaccctgtgttcctttgccagcaatcaccagattgcctatctggcatgtccctgtgctatcctccctttgtcgcatctgcctagccttaagcacctcaatcaaatcccacctctcccacagagaccttcccagggagccacacctgggaacaggtgtaagcctgtactgtttatatgagggttctcatctgggacacaggtttgccacacctgagaacaggtgtaagcctgtactgtttgtatgagggttttcatctgggacataggttctttctctccaactagacttttcctgaccttctgaagtccccttcccagcacctaagccagtgctttgcacatagcagttgtctgttattgttgatgacaatggactgtactcacctaattcggaatcagacctcacagtccagttggggttcatggtcagttttgggggcaggactggtgggacacagaagcggccacagcctgacttgcaacatttttctccagcttgacaattctcatccatcacacagccaacaatgcacaggcccaccagaacttttggacaatcaccgccccgccctgtgggaacaacaggcacaggaaaagggacagggcatcagctctgccatctccatgttcccatcgtgaacttacacacagaggctctaggtcaatcaacccctgaccctcactagacccaactaaactggctgggaaaccatggcgctggaggatctcagaatctttaggaacccaagagacctctgagcccagagttttcaaatggtgccccaaagggagttcccaagaggtaactcagggattgacacctctgcaggtttggggtgggggtgggtgaagtgtggcaggggcaagcctcccagaccactccccctccccctatgctctggattcatagtgtcacttcttcacggtggcctcctctgccaccctagacaaggtttgatgtccctgctttgtgctcctgtagcaccctgtatgcttcctctcatcaaactttatcataatcccttatttaaaaggaatatgtctatcttgcctgatgggctataagctacatacggacaagagtctgtcctcagccttgagcactgcctgggaatctaaagggactaagatagcacaagggtcaatgattctttaatggagatccacagtgcctggcactcaaaaatatttgtttttttaaaatgttgaagaaaaaaaggcattggaacaggaatgcttttatctctgtgtgtgtgtgtgtgtgtgtgtgtgtgtgtgtgtgtgtgtgtttccagctgggcgtggtggctcacgcctgtaattccagcactttgggaggccgagacaggcagatcacgaggtcaggagttcaagaccagcctggtcaacatgatgaaaacccatctctactaaaaatacaaaaattagctgggcatggtggcgtgtgcctgtaatcccagctactcaggaggctgaggcagaagaaaccccagaggcagaggtttcagtgagccaagatcacgccactacactctagcctggggtacagaccaagactctgtctcaaaaaaaaaaaaaaagaaaaaaaagaaaaaaaaaaaaaatatatatatatatatatatatatatgtgtgtgtgtgtttccaactaagatttcatttggggcaggggagaagctttttgttaaaaattagatctgaaaatcaggatcttgggcaactccttcattttacagataaagaaatttgggctcaaaaagacgggtttgcttacctaaggtcacaaagcaaaacctcagcagaatcaagaccaaaagccacactgtctgtcttccagcccaagtagttcctactgccccacagtgccttcccccagttcttttaatgtcgacagggcccctcggccctagaagaatgggttgctttgggttgggggaccagagggacaggaaggatgagaatcctagctcctcccaggaagggaaagagaagcactcttctcaggaaacactcaaggatttcttcccaaaagagccaacatacctccctcaatgtctccgaggcaggtgcggccacagccggtgctgcagcatttatgcccctggggacaggatgcatccccatcacacagctcctcacacggaagggggtcagcgggacattcaccaccaaactctgctacataatcaaagcattggagcccagagacgctcacaatatgaaacacatttttcattgtgtcccatgtgtatgtttatatatagttatatatttatatacatatataatgtaaatatttatgtgtatcatgtatctgcaatacatctgattttttttaagacagggtctcactgtgttgcccaggccaaagtgcagtggcataatcatagctcactgcagcctcaaactcctgcattcaagggatcctcccacctcagcctcctgagtggctagaactacaggcacatgccatcatgcctggcttatttatttatttattttgtagagacagggtctcactgtatcacccaggctaaagtacagtggcacaatcatagctcattgcagcctgaaactcctgtgctcaagggatcctcccaccacagcctcctgagtacctgggactagaggcacaagccaccaggcctgggtaattttatttatttattttgtagagacagagtctcactatgttccctaggctgatatcaaactcctggctcaagtgatcctcccgcctgagcctcccaaagtgccaggattacaggcgtgagcccccccacccagcccaccctgatattttatattctagttcttatttttcctaattactaaattgctttcaggactcacagtttgaaaaacactgttcaggtctaacccactgtggccaacattctccctgaattctccctgtggcagacatttacaatggtggcctccagtgaactttacctcctgggattcaggcccttttgtagtccccttccatacctactctgggtttgaccatctgacttgctttgaccaatgggacattagcaaatgtaatgtaagcagagccttgataagcactagcatactggggcttgtccactcagaatacttcctcttggaaaccagccgccatgctataaagcagcttgaactacgctatgggatgatgagatgccccatggagacagaacctagaagagaggtcatcctggacgttgtggctccagttgagctccctgctaagctcccagatgaatgcagctaaatgaatgaccacagctacatcatgtgggtatatgaactgcccagccaagctcaggcaacctacacaactgtgagaaagagtaactatattgctttaagtcatgaagtttggagatggtttcttatgcagcaatagatactggataccaagtttattctgagaggcaacaggtccagctaaaatgatttgtttccccatactctcttgcaacaaggggtgaccacaaactaggacataaactgggaaacttttgtattcctgacacagggaatacccctttcaaactgctccctcacttctttcttcttccagtccaaagatagacattacacagagaggcagagtagccttctttcaatgaggaggcaactcagcataacgaaatggtcaagaattgcaaagaggtgttgtatgaaaggagagaaggttagcactcccctcgacaaggatggaagaggcctttgggcctgacaacatgcatatggttcaagcattgccacctactttgtggcatctaaccatcgtcttttaaaataaataaataataaaatgtaaatgtaaaaaaaaaaaaagaattgcaaaggagaaagagggaaatagtttcatccttgttagcatcatggagccaccatcccagcctcaggaattcttgttatatgagaaaaacaaacccctatatgattaattttctgttgtgtgcagccaaacacatttcctatgaaaataaactcagagaagaatcttgcccagaactacagagtgagtcagcagcaaggcaggacaacactcagcctcttgatttgcggtaaagtactttttctactacactatccttaaaacatgcaggcaactggccagggccccaggcgcaggcacacccaaagaaggccacatccaaaccaaaccaattcaccatgactcattcatcttagtgtttatttcaagcttcttaagtaaagagaaaggtgacaggcaattaaagatttcgcagaaaaccaaagcaagactggcccagtgcctctgagtaggaacaggtaagtatgattgcatacagctggctctgggaagtctgccatgatggaaaaagcaagtattggaatccaaggagaatacatgcagctaaacaacccaggcgtagtaaccctgtatcctgagattttcctgaacagcccctatttcaaatatcctgtgctactgtgagatcacatcaaaactatgtgtcctgatttttgactcagaaaatgtggtcactgtaaccaccaaatgcatctccctgcacctccccacctgcttgacaaacactgaaatccatttaacaaggaacaaaagccttctatctcacagctgagaaggctgggagtaaaaatctccctggtggaaaaacccggtgacataaacatctcataaaattatgccatgtgccctagaaactgggagtgccatacgtcccagatttcaccattttgctgagcttgaccttgagatgaccaatgccaggagctctctgctactctctgccctcgtcctcaagaccaggcatggagcacttacctctacccttttccaggccaggcttcctggaggcccagagggtcacagcacctcgcttttgaccagtgcccagcaatgccacccagtctgacaccctgccttatatgaatccctgccacgtgatccctttctctcagctctaacacctggaattaatggggcctcactacctccaagccagattatgctatcctacttaagctagacagcctttatacctttttttttttttttttttttttgagacagggtctcgctttgtcacccaggctggggtgcagtgccgcaatggtggcttactgcagcctcaaactcttgaactcctgggctcaagcaatcctccaacctcagcctcctgagtagctgaactataggcacacactaccaggcccagctaattatttttattttttatagagacagggtctcactatgttgactaggcttgttttgaccttctggcctcaagcaatcctcccgcctcagcctcccaaagtgctgacgtcacaggcatgagttaccatgcctggccctttgtacctctttatactgacctgaaatctggctgggccttttcctatccccagagaccttacaaaaacctggcggatgccattctttcaggcaggatcctctgtctttcacgatcctggctttgccatgctaggtaaggtcagttcctcataagacatgctccctaatcacctcacaattagcttaccaggaatcaggaagagaaataggaacagtagccagaatggggatgacggttccccaccctctatcagcacccatcccaagactctaagctatcaccaaaaaaggagtgaagctgaagcccaggaaatactcactcacagtctgtcctgctgcctcagctccaacctgccactatgtctgagagaaagatgccagttgttgttggaaaagtaaaatttcagcacttcttaacccaagaagggccctctgagctaacaaacttactccccttctcttgtaaatagagagacagacaactagagagagggattggcctgaggtcaatggtagcagaactgagtcacaaatccccagctctgatataaggtctcatgccctttaaaccacatcatgggcctggctcagtggctcatgcctgtaatcccagcactttgggaggccaaggtgggtgaaacacttgaggtcaggagttcaaaaccaatctggccaacatgttgaaaccctgtctctactaaaaatacaaaaaaaaaaaaaaaaagccgggtgtggtgatgggtgcctgtaatcccagctactggggaggctgaggcaggagaattgcttgaacctgggaggcagaggttgcagtgagccgagatcacaccactgcactccatcctgggtgacagagcgagactccatctcaaacacacacatagacacacacacacacacatcatcatgatcccctacactgcagcaaggatcacacaaaaaccaagaagcactgggactcactctgcccagttccaccaaaagagaagatccagtggtagatagttttagaggttaggaaaagttatccaccagtgtgtaggcagtcctcaagaccacttacttccaggttcagtgattcattagcaggactcagcgtatagtcatacccatggctatgatttattacagcaaaaggatacaaagaaaaatcatcaaagggaaaagtccagaggaaatcaggtgctgattttcaagagtcctcccggtagagtcacaggatgcacttaattcttccagcatggaattatgacatgtgtgaagtgttttctaccagggaaactcattagacactcactgtgaaagttctctactgggggctggtcacttaggcaccctctgcctagcacgtaccaagattccagactctcagaaggaaagcagatgttcagcctaaaccacaatgtttacacaaacagtttaggcacagtgaaccactcttatcagttagagtagtacaaatacccacaaaatccaagttcccagaagccagccaaggcccagccttgccagcaagcctttttaagaagagcggtctcaggcttgttatgttaactcttttctgtacaacctgcagtgaggttttagaaaagggtcagccagacacccagggaggccatgccatcagcccacgtaaaagataatacatatatgttaataagcaaaacagagggtcacaggggatctggagtggtcaggtttcatacagtggggaggtgagccatgaggaggcccaagaagacaactgtcaggccagaatcagaatcttcactccaaaacctcttcccccaggttgtccctgtctcagtaaagaacaccaccatcacccaactgctcaagctgaatatctaccacccttcttgataccccgtctccctcaatgcctgcagccacttacttgttcacccagtcccattaattctaccttcacaaacatgtaagccttccatttttctttttcattgttattggttttttgggggcttttttgttttggattttttttttcttttttttgagatggagtttcgctcttgttgcccaggctggagtgcagtggtgcgatctcggctctctgcaacctccacctcctaggttcaagcgattctcctgcctcagcctcccgagtagctgggattacagacgcccaccatcatgcccggctaatttttgtatttttagtagagatggggtttcaccatgttggccaggctggtctcaaactcctgacctcgtgatctgcccgcattggcctcccaaagtgctgggattacaggcatcagccactgcgttcggccgccttccatttttctatgtctgcagtatctccaacccagtctaagccccgatcatctctcccagcctgccacaatagcctcctaactggtcttccatcttctacacttgcccccatccattcttcatatactggcagagtggtctttttaaaatgaaaactggacaaggcctctcctgcttttaaaccccctcaaaggcttcctattgcacttagaataaagcctaagagagaagccctgaagacccccgaaagtctgggccctgcctacctctccaacctcaaatgaaagcagcctccttctctcttcttcctttaccttcaaagcactcatgactcatcatcatcttggggttattatgtatttgttttcttgattatttcctgtctgtcacactatatgagcaagccccagggtggcaaggaccacggctgccttcctcaccactgcagacccacatgccaggtagggtagccacactcaatatacagtgaatacatgaataagtgggtgagtaaacggataggtcaggcatcagataggtggggaggcagagaaggggcggaccagaacacagaggtacttggcatgaccatatgagctctcttgagcattatctggcaggtttactgcagacttttttaaatgcatttctggccggacacagtggtttgtgcctgtagtcccagtttctcagggaactaaggcagaaggatcacctgagcccaggaggttgaggctgcagtgggctgagatcacaccactgcactccagcctgggtgatagagtgagaccttgtcccagataaataaataaataaaatgcatttcttctcaactgcattatcactctgggagctaaacatccttatccccattttacagataataaaagtgagattcagagaaatgaagggacttgcccaaggccacacagcaagcaagcagaagagccaggattcagacccatgttcagactagaacagtgtcatgagagcaggacccaatgtctgcccttgccctcaggcaacctgactgaacctccactttgccaaacagaccagcgctggctatggtaaacctctggcaatgtcagagcttaaggaaagcgaaatttttcatagccctggaaggagagcttcctgtagagttgggtatagcaaccagtcctgttgggtgagtagcctagccctcccctagggctggagctatacaaaagtagttaactaccaatgcagtagccagtatcacctcccaccaggctaggaaccccgctcagcccagcaggctctgggacatctgcgggagatcactattctagcctgcctgccaagctccagtggaaaaggaagccctatctgggctggccaggggccagagcagctcacaaaggtactgtgcctgggtgccagcctcgcccttagcccctacaattcagccctcagcttcaaacactgggaagattgtaccaagccctacatgccagcagtcagtgacctgcctgagacagattcccaggctggttccagagctgggcctcaagagtcctggcaaggagaacaaccttccattctctctaatgggcaggctgcccaagatagctgcctaagccgggcacagacagacccaatgggtaccagcaaggggcctcctacctggagaggtttgactggaaggaaaaaggttgtcacatgttacagggcttcaggttctgagaggaagtgatcagggaagaagaaaaccatcctggttttgaataaaggggctggtgagaaattgtactcctgctgggcatggtggctcacacctgtaatcccagcactttgggaggccaaggccggtggatcacctgaagtcaggagtttgagaccagcctgaccaacatgctgaaaagccgtctctactaaatacaaaaaattagctgagcatagtggcacatgcctataatcccagctacttgggaggctgaggcaggagaatcgcttgaacctgggaggtggagattgcagtgagccgagactgcaccactgcactccagcctgggcaacaatagcgaaactcagtctcaaaaaaaagaaattgtacttctgacccaggccacttaggaggcaagaggaaggaagttaatatatactgagggcaaaacactttacataatttgaataattacaacaagccttcgaggtttattcttcccaccttacagagaagggaactaaggctcaaaattacttgcccagggacctgctggccagtaactggcaaacctcaggcttgaacccaggactccgacaacccaaacctaggattttccactctaacatccaccacatgcactcagataagagaatgattccagttcctttagaaaacataatgagaaatattcaaaacagcagagaagaaaataaaatacctaggcataaatttatggagaaatattttaacactataaaacaccctgaaatatgcaaaatacacttgatcaacagggaaggcataggattcaacataggccaggcacagtggctcatgcctgtaatcccagcattttgggagccaaggtgggcagatcacctgaggtcaggagttcgagatcagcctgaccaacatggcaaaaccccatctcttctaaaaatacaaaaattagctgagcatggtggcacacgcctgcaatcccagctactcaggaggctgacgcacaagaatgacttgaatgtgggagcagaggttgcagtgagccaagatcacgccactgtactcctgcctgggcgacagcctgtctcaaaaaaaaaaaaaaaaaagaacatttcagtaccataaaacagggtaagaaaaaaaaaagattcaacattataataacagcagttctccttaagctaatttaatttatatatctaacatcactccagtgaacgtagtcttggtatttgggaatgatggaagaaaaatagataatattataataaaatatatttggaagcacaaataagcaaaagtagccatgaaaatcgtgaaacaagaggaaaataggaaggggttagacatagaagacatgccatcaatttctaatatgttttaggggcctctcaagggaatggagaaggaatagagcagagagccctgtcacttctacctccaaattttctcaactatgtcacctttctccatccccgctgctacctccctagtctcacgggtctacatcctcatctgccttcattctctccctcccatttctactctaaccgtactagctttctttccatttctcaaatgtggcaagctcctagtcatcttaaggcctctgtgtgtgcttctctctctccctggaatgtccatcgcacccttcacctggctaacttcaaatcgctctccaggttgcagcttaaatgtcactccacacatgccatcctcaaccacccaaaccaatgtgagttctcagccgggcacggtggctcacgccagcccttgggaggccaaggcaggtggatcacttgaggccaggagtgtgagaccaacccagccaacatggtgagaccccatctctcctaaaaatacaaaaattagccaggtggggtggcatgtgcctgtaatcccagctactcgggaggctgaggcaggagaattgcttgagcccagaaggtaggtggaggttgtagtgaaacaagatcgtgccactgcactccagcctgagcaacagagcaagactgtcaaaaaaataaaaacaaaaataaaagtgagttctccgctttactctgtctctcagcaccctttaattttccttccctgtccttatcagagtttgaaattatatatttatttacatgcttatttgttaaacctctttctctgccatgagactatgagctccatgaaagcgggcatgggatctaccgtattttccacaatataccaggagcccgtcactggatctcgcaaacagtacacattcaataaatacttgttgaagaaatgaatgcataaatggataattaggtcactgggactctgcaaaagggagaatgaatctctttcaaatacctctctaccaggaccagaatgaaaaagaatctgtttcccacaggagacagccccgccgtgtgtgtacatagggaacataagaatctcaggagcaggccaggcatggtggctcacgcctgtaatcccagtactttgggaggctgaggtgggtggatcacgaggtcaggagattgagaccatcctggctaacatgacgaaaacccgtctctactaaaaatacaaaaaattagccgggtgtggtggcacatgcctgtagtcccagataatagggaggctgaggcaggagaattgcttgaacctgggaggcagaggttgcagtgagccaagatcacaccactgcactctagcctgggagacagagcaagactctctctcaaaaaaaaaaaaaaaaaaaaaaaaagaatctcgggagcaaatgagtggggaaatgtgtgccaccttccataggcatcaagattcttttttttttttctgtctctgcagattctcaggataagattttttaacagagaatattgcaactgattatgggaactgggaattacccagtggttttcttttttcttttttttttttttttttttttttttgagacagagtctcgctctgtcacccaggctggagtgcagtggcataatctcggcccactgcaagctccgccttctgggttcacgccattctcctgcttcagcctcctaagtagctgggactacaggcacccgccaccacgcccggctactttttttgtatttttagtagagacggagtttcgccgtgttagccaggatggtctcgatctcctgacctcgtgatccgcccgccttggcctcccaaagtgctgggattccaggcatgagccaccacacctggctactcaaccgttttcaaagcagtctgcaaatgagggtaagttgaggctgcccttctggcaccctccctctgcctgcccaggctacataccacaaatgattatggcttgtgcaccctttgtatatcttttttttttaaggtcttagaatatagcagcaaagtaaaaccaacaagctgatatgtgcatatttgagaaataaacaagcagaccaaacagaccatgaggtgtggggacagcgtttcttacccagcttctgtttagagattgggactacacagctcttgttgcagccaagcgtgcagcatttctttacacctggacatgtctcatcagtgatgcaccttttcaaacaggattgtttccgaataaccctagggcaatctcttttcctccctgtagcaaaaagggagacagcaaagaaaagagaaaataggccgagcgccatggctcacacctgtaatcccagcactttgggaggccaaggcgggtggatcacctgaggtagggagttcgagaacagcctggccaacatggagaaaccccatctctactaaaaatacaaaattagtcgggggtggtggcacatgcctgtaaatcccagctacttgggaggctgaggcaggagaatcacttgaacccgggaggcagaggttgcggtgagccgagatcacgccactgcattctagtctgagcaacaagagcgaaactccgtctcaaaaaaaaaagagagagagagagagaaaatagtgcctggcaacacccacgggcacagcagaagggaaaaacagaaaaaggaagtcctgagatttatttaagcctctcaaccctggtgctaagacaaagagacaataataacaacaatagtaatagcaaatatttactgtaacatttactgacgtttaccttgtgccatgaacatcttatttgatcctcacaattatccccattttatagatgaggaaactgaggctaaaagcttaagatttataaagagctaaggcttaaggcttaaaaaggtctgcttggctctagggtctactctcttaatcattatcttacacagccttccctttacaactcttccctccagccttcacaggaactttgagtccaaagtaaaagacatagataatcaatggtgcgctctttcctgatggaaggcaaacaactgggggcactgaataattaaaggaggagggaccctaaaagagtaaagaagaagtactctaggcaagggagacttccagaggcaacctagaaggtgggaagctctctacttccatctatcccagaggcaatgtcagagagtatgcccagattttgcccctcatgccaacatacccttaggaatgtctcggcagatccgaccacagcctgtggtgcagcacttctgttcagccggacacaattcatcaccctggcacagctctttgcatgggttcttatggggagggcattctccctcttttgctgcaaaagatactatttgagtttggggtaactagccaggcctcagaaatggggaatggaccttcagcccctccaggcatctctatccaaaatatttctgcaccactgcactctagcctgggtgacagaatgagaccctgtctcttaaaaaaaaaaaaaaattctggctgggcacgatagctcatgcctgtaatcccagcactttgggaggccgaggcgggcggatcatgaggtcaggagatcgagatcatcctggctaacacagtgaaaccccatctctactaaaaatacaaaaaattagctgggcgtggcggcgggcacctgtagtcccagctactcgggaggctgaggcaggagaatggcgtgaacctgggaggtggagtttgcagtgagctgagatcacgccactgcactccagcctgggtgacagagtgagactccatctcaaaaaaaaaaaaaaaattctgcaaccaccttcccctcctcatacacaaatactaacatatatccaccactgctaaaggagcagccatcctgcagataacgagagagaaagggtgggatgatcctgttctcatttaatgagttctagggaaaagctagaacctctagtaagcccaactggaagtcctatctccttgtccagagagggtaaagaaagccaggaagaatgacccaggccatcctgagaatctattcatccagtcctgtcctatagagatgatcatctccacttacaagcaaccttgctctgggagaaggcaggggatgagttctcctctcctctagtcactttctgttactgttggccagggatcccaaatgatagctcaccatgttctcctgcagttatccaggattccagagacccaagagcaagaagtgccttcagaagaaagaggcagcttaacatcatgatgatgctgagagttgggacaagagctcagttcaggctagaggtgtacaccttgcccagagtatcagctgaggtatgagcaggactagggatggccccaaacccagtcccaaaaccttccctttcacaatactccccaagaatatcttctcctgacaagaagaagagggattggctgctggagtgtgggaaaattcctggcactaccaaaggggacctgtgatgggaggatcaaattctgtaagcaatatacacaatattcctggatgatgagaaacctagtgggtggctggaaaaatggaggggtggccattggaaaaagaatcaaagagagccctaaagggcattggaaggacatggctttagcccaaataacagagggagggattcacgacactacttaatggccaaagctaataacataaccaagcataataaaattgtggctcctgttcatcctagcaaccaagaaaatacagaatggaacagaccactcagaaactatcaaataggccaaggcgggcagatcacctgaggtcaggagtttgagaccagcctggccaacatggcgaaaccctgtctctactaaaaatacaaaaatcagctgggcatgctggtgcatgcctgtaatcccagctacgtgggaggctgaggcaggagaatagcttgaacccaggaggcagaggttgcagtgagtggagatcatgccactgcactccagcttgggtaacagagtgagactctgtctcaaaaaaaaaaaaaagagagaaaagaaactatcaaaaacctacagaaaagcagtagttgagtttgttaagaactaatgaaaagcaccaaacacctacatctttgtccctctaacccacacaggccattcttggactgtatgaagtctagctggcagaacccaagagaagttgctatgtatgactcaaatagtctgcccacatatacctcctttatttcttttttctccatttctttttttctttatctgtcctggtcatgcctttggttagctgtgatacctaatggtgtccactggcactgcttagtcctatgggcaggtacaaggtaaaacctccttaataggatcaaaaagtttggagccaggaagtcgcccttatggttagaaggctgatgttggctcatggagataattaacatttgatgatgacctcatatgtgcctaatatgcttttttttttttttttttttttttttttgagacagagtctccctctgtcccccaggctggaatgcagtggcgcgatctcggcataattaacatttgatgatgacctaacatgtgcctaatgtgctttttttttttttttttttgagacagtctccctctgtcgcccaggctggagtgcagtggcgtgatctcggctcactgcaacctccgcctcctgggttcaagagactctcctgcctcagcctcccgagtagctgggattacaggtgcccaccaccacgcccggctaatttttatatttttagtagagacggggtttcgccatgttggccaggctggtctcgaactcctgatggcaagtgatcctcccgcctcggcctcccaaagtgctgggattacaggcgtgagccaccgcccctggccgagcatattaaaatctagttttcaaaaactgaactgcaggcgccgctgtaccaaacgcttccctctgctccccaaccccagcctacagaaaactggtcccttcctcctaccccgcagtcatccccaggccttggcccagcgggaaacatcccttgactgaaccgccactgaacacccacactgcacaatcgaggcgcagccctcccgagaggaagccccaacgacctccacctacaaggcctctaagtgtaactgtcctgggcgaggcgcggcggttcggttcccatggtaaccccgcagctccagcgtcgcgcttccgggcggacgagcagcgcgctccagtgacgtcacggcgccactttccggccggtgacagagtccagcggagttgtgggggccgggggcgccatgggagccactggcgacgccgagcagccgcggggacctagcggggccgagaggggcggcttggagctgggggatgcgggcgcagcggggcagctggttcttacggtgagggcgcccccggtgaggtctgggctcaggccgggcacggcctcggggctcctgggaccctggcccgcgggcgagagaacgcggaggctggagctgcagagggggttggcgttttcgcagcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcggtaaatactgcttcccttcctcctgccgtgccagaaggcagggtcgggacttttaaggcaggaaacttcctcagttcctcttttgtggaggaggccttacaactatcgtcccaccccaaggcgggagagatggtgacggatctgagaagcagggatgtccaggtttaacttcatacccaccctccacctccaccccaccccagtgtcacaggccgcagtgacatttgttccgttggtccccacagaacccttggaacataatgataaagcaccggcaggtgcagcggaggggccgccgctcacagatgacaacaaggtaaggctggccctgcatggggcttatatcccagccactggcttgcatggcagatttgggatccccagtgcacaaggctatggagatctacagccggtagaaagagcacaggactgaggaagaggagactccgattctgtaactctgtgtgatcttgaactagtcaagtcacttccttctctgaactcacgtacaaaatggggaagggcacaggagatgggttgtggaataaacaatacctaagatccctcacattcactggctctgtggttgagggctctaaagaggtcagttagcatggagtttaagagaacaggctctggagtcagacaactgtgttctcatcaacagactctgatgagcccgttttctcaactataaagagggattaatagtatgcatgtcagggaagggagagagcacaaggtgggcctttgggatgctgatagtggtgaaatggatgttcactataattactcattaaagtgtatagacttttctgtataagtattatatttcataaaaacactttgggccgggcgcggtggctcacgcctgtaatcccagcactttgggaggctgaggtgggtggatcacctgaggtcgggacttccagaacagcctgaccaacatggagaaaccccgtctctactaaaaataacaaaaaattggccgggcgcggtggctcacgcctgtaatcccagcactttgggagtctgaggcgggcagatcacctgaggttgggagttcgagaccagcctgaccaaaatggagaaacccggtctctactaaaaatacaaaaattagccgggcgtggtggtgcacacctgtaatcccagctactaaggaggctgaggcaggagaattgcttgaacccaggaggcagaggttgcagtgagccaaaaccacgccactgcactccagcctgggcaacagagtgagactccgtctcaaaaaaaaaaactttgaaaataatatgcacttcatagagttattatgagaaagaaataaagtcatgcctctgtgatttgcacaaaatctgagcatgtagctagttttcaataaaagctgtctagtattgttaaggaattctatgtccataattaactggggaggctgggaaagaatatgtttgggacatgccccctcaccctgtctccctcctgaatgcagtttcacagatcctgccatctccatggatctcctccgagctgtcctgcagcccagcatcaacgaggagatccagactgtcttcaacaagtacatgaaggtgagagggacacaggataaaaaataacaggagaaagactcatgaggagcccagtccttgcctgcatcaccagtctgtctctttcctacatacagatatctaaagttttcctttcttgttgtttttgttttgttttgttttgtgtttttgagacagattctcactctgtcacccaggctggagtgcagtggcacaatatcgattcaccgcaacctccacttcccaggttccagcgattctcatgcctcagcctccctagtggctgggattacaggtgcccaccaccttgcagggctaatttttgtatttttagtagagacggggtttcactgttggccaggctggtctcgaactcctgacctcaaatgatttgcctgccttggcctcccaaagtgctgggattataggtgtgagccagggcacctggtcagttttcaaatttttaatcccccaagaattttattccctccttgagggtaattcagataccttttttttttaaaatctgcccttgtcacgcacgtggttttttttgctgacctcttataaggatgaagtgacttaaatgtactgtgctgagcactgtgctccagacataacaagtgtccaataagtattcttattagttgtttaataatataaccattattggggccatgcacagtggctcacacctgcaaccccagcactttgggaggccgaggcaggatcacttgaggccaggagtttgagaacagcctgggcaacacagtgggacctcatctctactaaaaaaaaaaaaaaatttttttttttttttttgagacagagtctcactctgtcgccaggctggagtgcagtggcacggtcttggctcactgcaacctccgcctcctgggttcaagcagttctctgccccagcctcccaagtagctgggattacaggcatccgccaccacgcccagctaattttttgtatttttagtagagacggggtttcaccgtgttagccaggatggtctcgatctcctgacctcgtgatccgcccacctcggcctcgcaaagtgctgggattacaggtgtgagccaccgcgcccgtcctgattttttgcactatttacacctcaatctgttgggcacccccacgattatatccgtaagagggggaataaagggaggaggtcaagcctgaaatgtgaatctaaatctggctgatcccaaagccctgctcataatcacttttcccttctgtatgaagctaggataaagacttattttatattcagtttccttcaggttgatgcacattaacaggactctgaccttgtcctctgttgtgctcccctagttcttccagaaggcagcactgaacgtgcgagacaatgttggggaggaggtggacgcagagcagctgatccaggaagcctgtcggagctgcctggagcaggtgagaccaaaggggacaagagatgcaggcacaaggtttagctctcgagcctctgataagaaatgcgatcttaagccggacgtggtggctcacacatgtaatcccagcactgtgggaggccaaggtgggcagatcactcaaggccaggagtttgagaccagcttgggcaacgtggctaaaccccatctctacaaacaatacgaaaattagctgggcatggtggtgcacgcctataatcctagctgcttgggagccataggcacgagaatcgcttgaacctgggagacagaggttgcggtgagccgagatggcaccactacactccagcctgggtgaaagagcaagattctgtctcaaaaacaaacaaaaaaagaaatgtgatcttgtcatcagtggtattttggggaatgcccagcaagccacatattgagataggcttgaggctgttgctgacagggaaaggaagggaagtagctactatatgtcaggtaccaggataaatgcattatttttttttatgtctcagaagaaactatgtacagaagatatcttttaattactattttatagatgaagaaattgtgacttagcaaactcatagaagcagagagtagaatggcagtagctggaggggagaagtggggggatgttaatcaaagggtacaaacttttagttataagatgaacaagttctgggcaatctgatgtacagcatgatgactatagtttatctctattgtttacttgaaatttgctaagaccatagatcttaagtgtccacacacaaaatggtagtggtggatgtgttgattgatttcattgtggtaatcatttcactatgtatatctatgtcaattcatcacattgtacaccttgaatatataccatttctgtttatcaattatacatcaatagagctagaaaaaaatttttaaaagcaaagcaaaaaaaaaaaaagaaatggcttaagacacataataattagaatagctaagatctgtctcacccctgcaggtgcgtggtggatcaagttatcatggccccatttggtatcatggggatgagcaccctgctgcctccctgcctctctggtgtggtcaggaagcatgacatcaggtctataaatgactgttcccaagatagtagagaacctgtttacatgtgtcagctgctgttattaggaggaattgttgccatcaccattttatagggagacatcaggaaaggtcgccaatagtcgctggctcactttctcacctcctattcattctcttcactttgttttcgcttcagtccccactacttcactggaacccctcttgtcggggtcgctagtaacttccgtgttgtcaaaccctctggtccctaactgtcctcaacttactcagcttctcagtgacatctgtcacaatggatcatttcgcgtttcttggaatgctcctctgttggctagagtgccttgactttgctccaacctcattgcctactcttctctctcaccccccgcctctaactgttggtgccttcccaagttcagtcctcaaaccccttctctttcatggctcactgttttcataggtgttttcatctagtcctgtggcttggaagccaattcagccgctcataattcacacatttatatctcagtccagagttacattcaccgttacccagttccaatccactcttctcacagcagccagactgatctccgtaaagatgaattagatcatgtcactccccattttaaaaacccttcagtgactttcctgttgcagggagaataaagtcttaatgccttaccatgatcctgctgggaaaactggctagccatatgtagaaagccgaaactggatcccttccttacaccttatacaaaaattaattcaagatggattaaagacttaaatgttagacctaaaaccataaaaaccctagaagaaaacctaggcaataccattcaggacataggcatgggcaaggacttcatgactaaaacaccaaaaggaatggcaacaaaagccaaaattgacaaatgggatctaattaaactaaagagcttctgcacagcaaaagaaatgaccatcagagtgaacaggcaacctacagaatgggagaaaatttttgcaatctactcatctgacaaagggctaatacccagaatctacaatgaactctaacaaatttacaagaaaaaaacaagcaaccccatcaacaagtggccaaaggacatgaacagacactcctcaaaagaagacatttatgcagccaaaagacacatgaaaaaatgctcatcatcactggccatcagagaaatgcaaatcaaaaccacaatgagataccatcttacaccagttagaatggtgatcattaaaaagtcaggaaacaacaggtgctggagaggatgtggagaaataggaacacttttacactgttggtgggaccgtaaactagttcaaccattgtggaagtcagtgtggcgattcctcagggatctagaactagaaataccatttgacccagccatcccattactgggtatatacccaaaggaatataaatcatgctgctataaagacacatgcacacatatgtttattgtggcactattcacaatagcaaagacttggaaccaacccaaatgtccaacaatgatagactggattaagaaaatgtggcacatatataccatggaatactatgcagccataaaaagtgatgagttcatgtcctttttagggacatggatgaagctggaaaccatcattctcagcaaactatcacaaggacaaaaaaccaaacaccgcatgttctcactcatgggtgggaattgaacaatgagaacacatggacacaggaaagggaacatcagacaccggggcctgtcgtggggttgggggaggggggagggatagcattaggagatatacctaatgttaaatgacgagttactgggtgcagcacaccaacaaggcacatgtatacatatgtaacaaacctgcatgttgtgcacatgtaccctaaaacttaaagtataatttaaaaaaaaatgccttaccatgacccacagagcctaccctcgactggcttctgcctgcttctttaacttcatttcatctcacctcttttttattgactatactctggctgttctgaactcctttctgctcctccagcacaagcttaggccatttcacttgctgttcttagtacctggggtactctacccttaactctataaagccggctccttcttttcttcagatcttagtttaaatatcagagaggtcttcccctcgcactcctacctctgctaaaatcttgagctttacaagagttgaggcctaatcttgttcaccactgtattcccagccctggaatatgactcttagtatgtgtacagagtttgctgaattattgagtaaatgaaggaacaaacaaatgataaatgaacaaacaagcttcctgctctaatagaacttaacagcctacttaagcagacaggtgtgaattagattaccaacaaatgtgtgcataattacacattgagacttgatcacccttcactggaaagggacaaagtttggaggagaagagcatgaatccaattatggattagcagctttgagccatccaagcatagacatggggcagactatttggtatataagtctagagctcagaggataaccttttgtctacagttgaattatggaatcgtggtttatagatgttaattgaagctgtgagaataggtgagagcagatagaatatgtaatgagagaggatagggaaaagaaccagattgagaaggaaaagccagcaaagaaggctaagaaagaacggccagagaagtagaaggaacacaggaagtgtggccacaggagcctgtagaaaagagtgtttccagaagggggagccctcagcactgtcaaatgccactggcagaggtcgggtgaacccaattctccacctgctgcaccatctcccctctgcccattccatccttttctttgtcaaatgagccaggtgttcccacctttgagcttctgcactcctccctgctgctgaaacacttctgcccagctttttttacagcctccttcacatctcaactcagaggccaccttctgagcaaggccttccctggccattcccgcaaagtagcccttcccctctggtggttctctgtcacatctgcctgggtttttttctttttttctcacagcatctatcatgatccacagttaccttgtttgtttctgtgcttattatccagatcacccacaaactataagctccacaagagcttgtcctagttactgctgtgtccacagcacttaggtcccaggtactcagtatttattaaaagaaaaacagcaggccaggcgcactggctcacgcctgtaatcccaacactttgggaggctgaggcgggcagatcacgaggtcagaagtgtgagactagcctagccaacgtgataaaaccccatctctactaaaaataccaaaaaaaaaaaaaaaaaaaattagctgggtgtggttgcacgcctgtaatcccagctactcaggaggcagaggcaggagaattgcttgaacctgggaggcggagattgcagacagccgagatcgcaccactgtactccagtctgggcaacagagcaagattccatgtcaaaaaaaaaaagaaaaaagaaaaacagcagcttactgaggagtatgtgttatactaatgtatttagtttgaaaaaacatacagtatgtatttacatgggaaaagcaaggaagaatttacattgaaacattaatagtagtttatgtaatgagattccaggtttttcttattttgcttttttacattttttaatttttccagccatgatcattaattcaagtttttttaaaaatagatatctatttctatgcatataaatatatatatgtgtgtggctgggcgtggtggctcatgcctgtaatcgcagcactttgggaggccaaggcaggtggatcacctgaggttaagagttcgagaccagcctggccaacatggtgaaaccccgtttctaataaaaatacaaaaattagctgggcatggtggtgggcacctgtaatctcagctgcctgggaggctgaggcaggagaatcgcttgaacccaggaggcggaggttgcagtgagctgagatagcaccactgcactccagcctgggcgacaagagtgaaactccatctcaatttaaaaaaaaaaaaaaaatatatatatatatatatatatatatatatatatatatatatatatatatatatatatatatttggaagtgggccgatcacttgaggtcaggagttcaagaccagcctgtccaacatggtgaaatcccgtctcttccaaaaatacaaaaattagctgggtatggtggcgcacccctgtagtcccagctactttggaggctgaggcatgagaatcacttgaacccaggagatggaggttgcagagagccaagatggtgctgctgcactccagcctgagcaacagagcaagactctgtctccaaaaaaaaaaaaggaagtaggtagggtgtgcttacccaccaaaatagtgactggtaacacttggtctttttcccttcaggctaaactgctcttttcagatggagaaaaagtaatacccagattgacccatgagcttccaggaataaaggtcagagtcactgtgttctcgggtattggagcgggaggtccttcaggctgggaggcaagtgaaatatgtgggcccagggaggttccatgtacttccatttgtaggaccaggcccacacagcatcatgctggatgggcttctttggcctgggtcagagcggggctggagagctgtagtccagggctgtcttctgcaactccagaagacctgcagctcccaggcactggccttccactgactcccttcccttttcttttagcgtggccgtcaggcagaagaagaatgtgcccatcgaggaagcccccttcctaaaaaggtaaaccatttccttgttttgttttctggctgaaaaaaggcttgtcaggccgggtgtggtggctcacacctgtaatcccaacactttgggaggccaagcggggaggatcacttgagctcaggagttttgagaccagtctgggtaacatagtgagaccctgtctctaaaataaaaaaaaaattagccaggcatgctggcacatttctgtcgtcctagctacatgagaggctgcagtgggaggatcacctgagcccaggagttcaaggctgtagtgagctatgatcatgccactgcactccaggctgagtaacagagtaagaccctgtctctcaaaaaaggctcttcactccgcaaggtactgggcttcctcaaagcccttttgagccttcctagacatgagaggcagtttttctccctgtccctgtcaaacatcatttgatctctttggaaaaccatctctgccaagtgaccctggacctgccaatggggtatggggagtaaccacagggtcagacctctgacagctgttttttgtggcagaggaaaggacggcctcctggacacatcctgtcaagcgaccgggcagccgccggcatggtgtgagtagggaccaacagtgtggtgagagcataggggagcagacggagagaggggccctgaaggaaaagagtccagggttctgtgcctgtcaaaatcagatccatcagcttaagtcatcgtggaggggggttatcctggttggaggggtgaggaaggagggtagtgaggaggaaattgttttaccccctgaacggtttggcccagcttgatgaaagattaaactccagaggtttgtcattgttagtatatattggatgcttatgactggtctaaatacgttacatactttaccttttaatctttatagccaccctgtaaagaagatatcattaatttttcagataacagactcagagaattacttgcctaatgtcatatcgttaacattgcctccaagacggtcattttcaaatatatatttttttaagacttaatttttttagagcagttttaggttcacagcaaaattgagaggaaggtacagacatatcccgtatactccctgaccctacacatgcacagcctcccccattatcgacatcaggcaccagagtggtacatttgttacatttgatgagcctactttgactcgtcttgatcctcagagtgcatagtttccatgagggttcactcttggtattgtacatgaacttagacaaatgcatagtgacaggcatccaccattctagtatcacactgagtgctttcagtgccctaaaaatcctctgtgttctgcctgttcatccttccttccccctcaaccaacccccaaccccactttttaaaaaaaattctgaagcagcagaatctttttcaaacaaaactttacatgggagcccagtatttaaatcaaataaagccacactggtctggttcaggggcgtggggttagtttggaacagctggcttagtagatgggctagtattaactgtcataccttagatgtgtctcctacacgaagcagttttattcctcacaaacacaagataggtagggcagttgctgtttttgtctcttttgacagatgagaaaactgccactcagaggttcttggagttgctcatgccactatgtaagagcagagctagtgctagaatggcttctagtccagtgctttttttccctttgttcctcctcttatgtgtcaccacgaaggaggatgtccagggctaaagtgagagtgtgtgaggaactcctaccaccaccagcaagctggcatttagtcctaggtctcaccttggagaattcacctttattctttccttccaagcagatggaaaccaaaatcctgtgaaccaattcgccgggaaggccccaaggtatgattatgtgagcatggcagagatcacgatcccaggagatagtcccactatctctaggacccaccatgagggaaaggggcagggggcgaagggtgcatgcacaccattccagagccatctgcccctctccacctccagccacactggcctcagagaggatcctgtgtaggaattggagttagaggcaaaacaaagagagggcttgagtctttgctgaagccttctccttataggagttagtggtcactaatactgattcaatacttagtatgtaacgggcagtgtcctaaatcttttgtgtagaccatctcatttaatctttataacaaacttatgagatcaattctgtgaaccattctataaatgaggcgtttccttttctgccagcttccctgtgggcataaattattttattcagttgtcttatacacttaatgcacttaagacttgcccaaagtcacataactcgtaagtgatcgagctgagtctcaaacccaagacccgctgacaccagagtctgtgctctcaaccattagcctctgttgcctccctctctctcctgagttcttcctcagcagtgacttatataaatggttgttccccagaattctctccttggcccacttctccatctaaagtaactctctggataatctaaaacatatactcttatggtttcagggaccaccatgttctaaaactcccatacctctttgtccatcccatgcctctttctactttaaaacttgtttatcctactatctgcttgaccactctgctggaagtttcataggcatttcagactcagcatatccaaacatgaaattagaatctttcctcacagcccttctttacattcgttatcttaatcatctttgcctcctcctcctcttccttacctccctacacccagtcgagtcctggacaattcttcctcttaaatatattgcagttcctatttccttctgttcatccttactgctgccctagctcaggcccttagcagctttccaactgctttatcacagcggcctctaaactgctctccctgcctgtagtcttgccccttcaaatccattatccacattgctagaagactaagctatctttaaaggaaatctgactctcactccctgtttagaggccttcagcgattccccattgcctacagaagaaataaaatgcagtcccctgaacataacctcctaagacctccaactcctctgtgtttctctctccagccccatcagctgccactccctaatttgtactctctctgttagcagcacagaattactagtagtttctccagcaggccaagctgcctctcacctgtctttgctcatgctgccccctgtctggaatgcccttgttcctgaccccctttaccccaacttgtgctcaccctttcagaattaacttgggaaatgcctctctaaggaagccttcctggctggaccctcccctcggcagccctcagaccctgcactcacttgtgtccttgcctcatcgcacaatggtgtaattatctgtacatatgttggtggcatcctagaaaacagagactgtatcttattcatctctttatccccagtatctagcacagacagggcctagcatattgtgagtactcagtgtcttgggtcaactgttgattaaataatagacaaggggaagggttagaaaagggtagggggaggagtgtttctgtcctacccatcagattaaacttcaccctcacgagcttctctattttttgcacagtgggacccagctcgcctgaatgaatctaccacctttgtgttgggatctcgagccaacaagtaagtttaagagctttggcactgattgaggaaacagctcaggagttcactagtaggactacactttctggaatcttgaccacttggcttttacttttcagagccctggggatggggggcaccagaggaagaatctacatcaagcacccacacctctttaaggtaggtgactgctgggaggaaagcaggccattgcattgggagtagactgggaactccactcagcacagagaagcttagaacaaacactgatcttggagtcaggacatctgggttctagttgtgcctctgccattcacctttccctttcatgatttactcaacacctctgtgcctcagtaataacagctactttgcttgcatgcttactgggtgccaaacacagttttaaatcccacacttatattatcttaaaaaataagtattgccatccttatttcacaaatttgaaacaatcagaggttgagaaaggctgagtgacttgcccacagttattcagctagaaatggtgagtcaggattcaaatccaggtctgtcctcaccaaagcctgagctcttaaccactaccatatttggttgtctgtaaattagagtttgggccaggtgcgtgagctcacacctgtaatcccagcactttgggaggccaaggcgggtggatcacctgaagttgggagttcgagaccagcctgaccaacatggagaaaccctgtctctactaaaaatacaaaattagctggcatggtggctcatgcctataattccagctactcaggaggctgaggcaggagaatcgcttgaacccaggaggcggaggttgtggtgagccgagatcacactgccctcatatttgcattttaaaataactctggggtctggcacagtggctcacgcctgtaatcccagcactttgggaggctgaggctggcggatcacctgaagtcgggagttcgagaccagcctgaccaacatggagaaaccccgtctctactaaaaatacaaaaattagctgggcatgatggcgcatgcctgttatcccagctattcaggaggctgaggcaggagaatcgcttaaacccaggaggcagaggttgcagtgagccaagatctcaccattgcactccagcctgggcaacagagcaaaactccatctcaaaaaaaaaaaaatagagtttggagcaaggcagggtcctgtgccttttcaaagagggtactcctcttctgagagcagctatgttttggtccccactgtttgagggaataatggaggaaatcataaactcactcaccctcttagatgattttgtattttatcagtcacgagagcatcgaagtagattagaagaatagcagtgcatgtgtgttccacacatggttttttgcacttatacgtaaggcttggcacctcttgccagaactgcacagccctgtgggatcccagaatcacgggctttctctaccacattctgtgcaagttttcaagttctttgaaaggcatacctgctcacgcttcttctccagtctgatatcctcgagtcccaacacttaaacagtttgcccagtggctcctttgttttcctctcttaatgtcgtcactcttgctattcccattgcctgggtggcctttctctcccacccttatctgcctgactattctttaagatccacctcctccaagagctttgtttgtatcatccccaaaatcaatatgcttttggacctactttgaattcccacttcagcgtggtttaaagtatggcttcaggcctggttccattattttactagctgcatgaacttgaacaaatggctccacatttgtttttcttttttctttttttttaactagctcaagtctgggaattgatccacatttctgagtctgtttttgtcctgtataaaatgagaatagtgatagaccaaccatttttttttttctgagacggagtcttgctctgtcacccaggctggagtgcagtggcgcgatctcagctcaccgcatcctccacctcctgggttcaagcaattgtctgcctcagcctcccgagtagctgggattacaggtgcccaccaccatgcccggctaatttttgtatttttagtagagatggggtttcaccatcttggccaggctgctctcaaactcctgagctcagatgatccacagcctcagcctcccaaagtgctggaattatagacttgagccactgcacctggcccaactttacaaattctctattagtgattataagtatcttttcagtcatttagaatctatttgtatttcttctgtaagctgcctgttatatcttttgcccatttttctctccttcagaaggcattattcaaattcttttccttttttaaatgttttgattatagaaataatatataaacccattcccgtggtaaaaagattcagacgatacacaggaggtagtagagagcaaaacacagtttctcagccaggtgcagtgactcacgcctgtaatcccagcactttgggagcccgaggcaggcgggtcacctgaggtcaggagttcaaggccagcctggccaacatggtgaaaccccatctctactaaaagtacaaaaattagccgggcatggtggtgcactcctgtagtcctagctactctactcgggaggctgaggcaggagaattgcctaaacccaggaggcagaggtttcagtgagccgagatcacgccactgcactccaacctgggcgacagagcaatactctgtctcaaaaaatatatatatcagtttctcttcactcctcgattttttttttaaggtgcttaaattctggtttctaggtgcccaacctagaatagaaaccagaatttaagccttatttgggttgagcacagtagctcatacctgtaatcccaacactttgggagactgagtgggtggatcagttgaggccaggagttcaaaaccagcctggccaacatggcaaaaccccatctctactaaaaatacaaaaatcagctgggtgtgttggcacgtgcctgtaatcccagctattcaaggctgaagcagaagaatagcttgaacccaggaggtggaggttgcggtgagccaagatcatgccactgcactctagtctgaacaacagagcgagacgtcatctcaataaataaataaacagccaggcacggtggctcacacctgtaatcccagcactttgggagcccgaggtgggcagatcacctgaggtcgggagttcaagaccagcctgaccaacatggagaaatcccatctctactaaaaatacaaaattagccgggcgtggtggcgcatgcctgtagtgccagctacttgggaggctgaggcaggagaatcgcttgaacccaggaggcggaggttgtgatgaagcaagatcatgccattgcactccagcctgggcaacaagagtgaaactccgtctcaatcgatcaatcaatcaatcaatcaataaaccaaccaaccttatttgtaactccaaaaccgaattcttaaccatgatgctattatgcgtccgagagtacatgaggtgtcccgatttttgttttattatggtcaccataataattacagacgttataagccacctccgatcattttttaaaaagaggaagctctaaaataatagttatcagtcccaccagttgcccggggtgctttgttgtgagaagggggtggggattgggagtatactaagtctctgggaattgggtcccatggtctgccctcggggttggcttagctttctctgaagagattagtgagccctctaagtccaccacgcttggagacaaggacttttggtaagaactgctcaagggccaagagtatgctctgggaccaaatgagaaaagccccttacccgaggctaattttcttacaacttcattccttacagtatgcagctgacccccaggataagcactggctggctgagcagcatcacatgcgggcaacagggggcaagatggtaagcattattcatttgtgccactgccagtgacccaccccacctgggaaccaggattttggctgtgggtgacagcctacctccaaatctgacttccaaagcctcaccaatgtgtgagaagagagacttataaggcctatttcttcatgctgaagagcaaattgtaatcttcaggttcccttccctatccctaggtctcccttccgccccctcacacttttacctcatgcctccaagatcacatatttggatactattagctgtccataggaatagcaggtataagacacacagtactactttttcccactactgcacccactgacagatttcactcattgatcactcttccaccagacacagctatagaatcttttctcaacacagtacttgaggcagcaacccttgtcagtaggagttagcaatgaaatgtgtttgcacacttggcagccccttccagatttacctctacttgaagagttctcagatcatatgaaacagcaaccttaggaaaatcatcattgcatgtgttcaaaaactattgttgagggctttgtccatcacacacaatgtcccccacctgaggactcactcactcccaccacaggtactgctccttttagaatctaagtgccttacaaactgatatgccatctcctttctggcagtgagagctaccttttattttattttactactctatttatgcctatgctttacttcaaaaaagatttcaggtaagcttcatgcacataaaatgcaacattacataaataagaaatagatggtagggggtgggggcaggacctaaaattaagccaccagtaaaagtagttctttaaaaaaaaaaagtgttttttatattgctgacctgggagacctgtgcacttctacagatgttggcaaattcagctgtaggccccactcatggacacctgatctgttatggttcatagtgcccataagatgtagacaaattactcaaggaatacacaattattcctgaccctaacattagaaagtctcccacagaagactttctaatatgatgaatatctcttcctatatgttaagttcacaaaagggccctcacccactgtagaccgaggcattgtgacaaagcatttctacaggccccagtacaatacaggccaattactagacagcagagcagtttatcatgttttccattttgccacaaagttcaaaaccaagttatctttgtcctcagagggagcacatggtttcctcttcctgatttcctgtttccatatatattttgctggctttcttgccattttgttataacccaccttgggtcctttcgtatacttgatcttaaccaaaaggtgtaggagcaatggtggatccctttttttttctttttttcttttttttttttttttcttaattttcaccacaccattcaagagagaaatgggtccttttttaaaagagaaggctataaataagtcaccagtccctactctcccatccatgaagcatctactgtagtaaaagattgtctcaaggaaccattcccatccctccccacttactcttccgtactaaattgtaaaccgcatcccccgcttccacctagtagcaggccttacattaaacagatgtttaatgaagtgttactgagttggagtgaaatgaatcaggcaatgaccactctcccttgctcctgcctcaggcctacctcctcatcgaggaggacatccgggaccttgcggccagtgatgattacaggtaaaaccagtgggtctcctgccccttctcctctccctgcctccaaatagcccctagaatgaggcagggcctacatcctcacttcccccaacttctctcttcaatgtctgttccagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacagatggtgaacctgctgtgccctctaccttgtgggaattgacagaacatcaagggctctagaagtgggtgtaggaaaaaaggacgagataaccctcacccataacagtatagagccaggcttgataagaccaacctgggagcaccatgtaccctgcccgtcttccctttgcccatttgtagtttccttacccagctaatgtaaggacatggcagaatgcgatggagtttgatgacagatcatatgaaaaatagagttggcttttattgctcccattttacaggttaagatactaaaggacccgccccaaggttacacactacccactggggaggtaggatatacaggatatgaacctgtgttgttggggtttttgtttgtttgaagacagtcttgctctgttgcccaggctagagtgcagcctctggctcaagcgattctcccgcctcagcctcgccagtagctgggactacaggctcgtgccacctcaccagccttttttttttttcttttctttttttttttttttcttttaagtagagacaggtctccctatcctgttgctcaggctggtctcgaactcctgggttcaagtgatcctcctgcctgggccttccaaagtgttcgggattacggacgtgagccactgcgaccagcctgaaccaatgttgcctttttttatttctgtcatctctgcggagatgtatggacctatgttttctaatagggagcctgctgctctggccatcagcctttagtttttcccctcgctgggattttcagatacttaggacgcagcaaaggtgcccaggcgattataatggtgggagggtaccagtgctgcaggattggaggcactccctgcccgagggaaattggatcaaggctgggcgtgccgagtgttcccacgcggagtaagacgtgtagccagaaggaggggttcatcccacgtggacgttttcttggccctttaatggttagcgttttccaacggccaccaattcgctacggattcgttagttaatggcagcatcatctaccaatcggttgtcagaagcgggattctgccgcccaatagcggtgcgccagtgggtaggtctagcagtggcgcagcaatagagcgctccggagcgtctcattggctggatcaaacccaagcgagccattgattggtcgacgcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggcccatccagactcccaggtaaccccgaatactcttttttcaggctacagcaggagctgatgaccctcatggtgagtgattaagtgcccagaaccccagccttccatccaattttcagtagcctccttttttccgtcagcttttttgctagacataggggtaatgtaatttgctccctcctgggaaagaagttcatacaccccacctacaccatttcttccagcagtccctcctcccaattccatccccccacacgaagttatctcgaacacttccctgaagtcatacaagaccctccctatccagtgtgtccctacttcctagccccaaccaagctttacccacacccaactccccgcccttcttggtatttctagcctatgaatttggttgctttattttggatcagagtgatgagattaaggggaggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcggtgagccgagcgcaccactgcactctagcctgggcgacagagtgtgtgtgtgtgtctgtctctgtctatctctctctctcaatctctctctctctctctctatatatatatatatgtaaatatatattttttagtagagatggcataaccccatctatatctcatatatatacacatatatatgtgtgtgtgtatacatatatatgtgtgtgtgtgtatgtgagcatatatatatatatatatatatatatataaaattaaggggaaagctcacccactgacctttgctatgcccaaaagtgtactccacattccaacaaatgtgttttctccccagatgtctggcgataaagggatttctgccttccctgaatcagacaaccttttcaaatgggtagggaccatccatggagcagctggaacagtaagtgtagggctgggatgggtgagtgagtctggggaaaggtgggaagtgagatccaagtgcgagctctgcttcaagcctttggcggagcaagacactcctcctgtgactgtttacattctctgagccatgtggccttgttctttccctctgtgcaataaagggtgggtttaaagcagggctgcctatcttagatgtttacatggggggacagacagcaaggaaatggatgaagtgaggactttggccaatagggccagatctcaagaaggcagcttcccattgctgcagatcaggtttaagatgagtcagaagtccaaatctgtgccaaatctaatttttacgtattagcaactaatattcttttttttttttttttgagacggagtctcgctctgtcgcccaggccagactgcggactgcagtggcgcaatctcggctcactgcaagctccgcttcccgggttcacgccattctcctgcctcagcctccgagtagctgggactacaggcgcccgccaccacgcccggctaattttttgtatttttagtagagacggggtttcaccttgttagccaggatggtctcgatctcctgacctcaagatccacccgcctcggcctcccaaagtgctgggattacaggcgtgagccaccacgcccggccagcaactaatattctaattgaactaaagcacaggatgccaatttacaatccttagaccaaagagtcactgatgtctccaccagataagaggaaagcatcaggctaggcatagtggctcacacctgtaatctcagcactttgggaggctgaggcaggcagatcacatgagcccaggagtttgagactggcctgggcaacatggtgaaaccctgtctctaaaataaaaactaaactaaaaaaactttttaaaaaggcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccaggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggaggtgactttagagaccacccctcccctccatgcaacttgggaacctgtcaggactccctggggtcagcctcttctaccgccttgaccttctctttctctccacccacagaacccaacattgatagtcccttgaacacacatgctgccgagctctggaaaaaccccacaggtgagtcctcagtccttgagcccagggtgatccctcccccaaccttcaaaggctccctcaaacaaaaggagcccagtgacttgggaccgggttggttggggcagggtggagtgtcggcagcaacccacttctgtttctgccccagtgctcctatttgctataaaatagcaattgttttatagcagaataaaaatgtttggcgataaataattttgggaaattattggtgagaccaaggcaggaggatagcttgaggccaggaattcagtagagtgccttgcctgtgccctccagtctcactggaagcaagcccttccaggagagctgcctagatgggcagtgcagggagaatgccgggctgggaaaccagcccctcctccacctcctccgacctttgcatccctggtccagctgcctcttgcccaccttaattcatcctgggccaggcacagtggctcatgcctgtaatcctagcacttggggaggccgaggtgggtggatcacatgaggtcaggagtttgagaccagcctggccaacatggtgaaaccccgtctctactaaatacaaaaaaaattaaccgggtatggtggtaggcacctgtagtcccagctactcaggaggctgaggcaagagaatcacttgaatctaggaagcagaggttgcagtgagcagacatcatgctattgcactccagcttggtcaacagagtgagactccatctcaaaaataataaatagtaaagattaactcatcctgtctccatcactcactgagacctgcctgttctcttccagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaagttgttgcgttgtaatttcactagggttggaggtactcagggtaggcagaggtggaacttaaggatgtggggccaagcaatggggtgacaaagatttattcccttgtaccttattttatgactctgcatctgtttcttcatctataaaatgagtgtcacaataatgcctcctgtctatggagtcggtgatgtgtaccagcaatgttagtgaatgttggagctccctcagctgtgttgcagatgaggctgagccagaccttaggctgaaacctactcctatagctgtagaaggaacaagcgtgtgtgttgggggggggatcccaacacacagccacccatgttctgtcctgaagaagaatgcttaggtcaccctaagcaggtccagggcctggggagacagccaggaaaaaagccccttccctggcaggactcaggtctgagctctggtctccaggctctagcccaggtccccggtggagctccacctccaagggggcacagtcgcctcctgctgcatatcccccagggagcccccagccccttgggctgcctctttcccctggcctgatgaaggctccagtctttgagcccctaggaggaaacacccctgctgaccagctgggtccccacaagggtcggcaggtggaagagtaggttgaagtgatagggcccccacaaagcccttcaggaagatctccaaggtagataagcagcatccagatgtgctccaaccttgcacccaactccttcaggtctgttagcagctggttggttgtgcaagcctgaagcgggaggggtttgggattggaagttgggtcccttcatgtctataattgtgctcttaggtctctcctcttgggttttttcttaatctaacattcatacaaatacacttgggatcttgttaaattcttttctgtaggtgtgaagtggagcctaagatccagtctgtttatttattttggtttctaaatagtttccaagtgatgtcattgctgcggtctgcttaagaacaaaatttagagcaatgttcttagaatgtggtccttccagcagcagcagcatcacccggaacttgttaggcaaattcttgaccccaaactgccctccaggttctgaaggtctcccacggttgaaaatcactaggttagcggatactggagaaaaccagagctcagaacctggcactaaattagtcaatatatgctggccagggccgggtgtggtggctcactccctgtaatcctagcactctgggaggcggaggcaggaggattgattgcttgaacttaagaattcaagaccagtctgggcaacacagtgagacccccatctcaaataataaattttaaaagaaaaataaataaatcttggccgggcctggtggttcacatcagcaatctcaacatcttgggaggccaaggtgggaggatcacttggggccagaaattcaaggttatagtaagcttatcactccagcctaggcagcagagtaagaccttatctctaaaagaaatgtttcgaatactaactgtggtggatgtgttttcatctgccatgtggtccttggtcacggtgtttggtaccttagatggccacatggcctgccttgggccagtcacaggtctaaactgtagttcagattcaactggtgttgtctggaattaatcactgggagagagtaaagttattttactaatggggttgctaaaagagaagggagtcagtctcagctgctgggggagcccgctgcagacggaagaaagccaagtagagacaaacagctgggagtcggagagatgacattaactgagactctggcctccagttcatgctttgccatcccagttcgataaactaacaaatccctttttggtttaagtccgtttgatttagatttctggcacttgcaacagaaagaagcctggtcaggaagtatttgaatttctggttattatgattcccattttattgaattcctacaagacaaaggccctctgcttggggctggggacaaaacagggaaaatacagctctgcccttaaagaggctggaatttgggggacagacaggcccatcaacagcggggactgcggaataagtgccatacagcccagttattaagctcagaccagtctgggcacggtggctcatgcctgtaatcccagcactttgggaagccaaagcgggtggatcacctgaggtcaggagtttgagaccagcctgaccaacatagtgaaaccccgtttctactaaaaatacaaaaaattggccaggcatggtggcgagtgcctgtaatcccagctactcgggaggctacggcagaagaatcgcttgaacctgggaggcggagattgcagtgagccgagatcgtccattgcactccagtctaggcaacaagagcaagactccatctcaaaaaaaaaaaaaaagaaaaagaaaagctcagaccaggtaagcagaactgtttcaggatcctggctccacctccatgttgcccgtaaacatgtaggcagttacatttaacctctccgtaaaatgaaaatactggtacctacctcataagacagtggaaggaccttagaacaatgcctggcacatagtaagcactgaataaatgttggtgctgaactcacatattgctatgtaagttcacaggtggagcacccaatagaataggagggtcagggaaaggtttttggagaaggaaattgagccctgagggagatgcacattccttggatagcaagaagttcaggagtatgtaaggagaggaatacagagctaggcgtggtggctcacgcttataatcccagcactttgcaaggctaaggcgggcagatcacctgagctcaggaattcaagaccaccctgaccaacatgatgaaaccccatctctactaaaaatataaaaattagccgggcatggtggcaggcacctgtagtctcaactactcaggaggctgaggtaggagaatcgcttgaactcgggaggcgggggttgcagtgagccgagatcacgccactgctctccagcctggctgacaagcacaaaactctgtctcaaaaaaaaaaaataatacaggatggggaagtcgcatagatgtcaggtcatgataggctggaaggccatattaaggtacttgggctagccttggtaacaaagtgagactccatctctacaaaaaataaaataactaggggctgagaagggaggatcacttgcacctaggagttcgaggctgcagtgagctataattgtgccactgcacttcagcctgtgtgatagggagattcagtccttaaaaaaaaaaaaaaaaaaaacttggactttatcttgaggcaacagccagctaatgaagccttgagcagggcagtgacgtgatcagattttttttttttaaatttattttttgagacggagtttcactcttgttgcccaggctagagtgcaatgctacgatctctgctcactgcaacctctggctcccgcattcaagcgattctcctgcctcagcctcccaagtagctggaattacagacatgtgccaccacacctggctaattttgtatttttggtagagacggggtttctccatgttggtcaggctggtctcaaactcccgacctcaggtgatccacccgctttggcctcccaaagtgctaagtttacaggcatgagccaccacgcctggcttatgttattttttaagacagagtctcactctgtcacccaagctggagtgcagtggcgcaatcttggctcactgcaacttccacctcttgggttccagcgattctcctgcctcagcctcccaagtagctaagattacaggcatgtgtctggctaatttttacattcttagtacagaggaggtttttccatgttggccaggctggtctcaaactcctggcctcaagtgatccgcctgcctcggcttccaaagtgctgggattacaggcatgagccacagcacccagcctccatctctattttaaaatatgtatatatttcaaaaaaaaaaaaaaaaagacatccaggtagaaccaataacaggtagatggcatcagaattaagagccttgttcccgtgcacaccacatagcacatggcgatactacctaggttattatctgggtgcctgtgtacttcacctccctaggccttagttttccaactgtaaaatggagataacaacatctgcctctagggatgttatgtgagtgaatgagacaatgtctgtaagacatagtatacagtaggcactcagtaaatagtaatgattaccaaaccccagcactgatcctggctggaaataaaaacagaaaaacatgaataggacaaaagaggaagagaaaaagacagatggagaggaagaactaaagcaatgagtaaggtgacaatagaggctgggcacgatggctcatgcctataatcccaacactttgggaggccaaggtgagaggattctttgagctcaagagtttgagaccagcctgggcaacatagtgagaccccatctctgctaaaaataacaaaaactagtggggaggggtcacccatttatagtcccagctactcgggaggctgagacaggaggattgcttgagcccgggaggtcaaggctacagtgagctgtgatcacctactgcactccagcctgggcaacagagcgagaccctgtctcatttaaaaaacaaaacagaaggccagatgtggtggctcatgcctgtaatcccagcactttgggaggctgaggcaggcggatcacctgagatcaggagttcaagaccagcctggccaacatggcgaaacctggtctctactaaaaatacaaaaattagccaggcatggtggtggacaccggtaatcccagctactcaggaggctgaggcagaagaattgctcgaacccaggaggcggaggttgcagtgagctgagatcgcgccactgcactccagcctggatgacaagagcgaaactctgttaaaaaaaaaaatgcttgctatgtgccaggcactgctgtaagcactttgcacacactaacttcttctcacaaccccgtgtttactatcactatccccattttacagatgaggaaactgtggcacagagtggtttagcttgtcacaggcagtgagcactcacacacaggcattctgtctctaaagctaaactacccctacacttaattagctgccatctgatacctgttgtatacgaattgctatggcagcaaatagccagtgagggcaaggttcaagggaggagatggtagttgagctgggtcttgtaggttgaagaatctgccagcttataagaaggacaagggcattccagggagggcaaacagcatgtgcaaagtaccaagggcttgaaaatgcaccccaggtccatatcaggaatacattgcccagtgtggctgcagccctgtgaggactatgggaagaaagagagggagggagggagggagggaaggaatttggatctcattgtagaagcagtgaggagccttgaactactttcaacagggcagtggccaagtcagatattttagctcgctgctgctgatggccctctgtagagcgcactggcagagaccaggtggaggcagggatctggggtcaaatgatgagatcagaatctccttagtgggtgcctccaccctcccctacaaccaccagtacaatttgaggagtaagcacttggaagaacagaagaagtaaaaggtcgagcagaaacaatgctgcctggcatggatgggcacctacttcccctctccccagctagggagcctgcagaaggtggcagctacgacaacatctaagacgcaaacgttccagaaaaggatggtggggaagtgagggagcttcccggctccccagggttctagcctctcccaccccctcaccctacctgccgtctcaggacccctccgcagtccgccggctcaccctgactcaactccaagcccctgcagcctcctggagccaccactgcctgtccgccaagctgtgcacgcccagcgccagctgtcaggagccggctgcaaacctgcagagcgagtcagcgccatcgagcactcgcagccgccgcctcgggctccagggcccagctcccttccacatcccgccgctcagacagcctctcccggggatccccaagggtgctccgggtggtgccagccgggatggcgccctggaccacagcccttgcgacctgctgtcctcggctctcccctcattcaggccacgagttttggaacatttgcttttattccttccagacaaagacccacaaggggtcgcgcctccctggtggggacccggcagggcggagtctcccacaccctagggacacgcgatcttggtagaggcgactgtccactccttactgcacgccctccatcatcttcaggaactctgagggaaaggagagggagagggtcaggggtcccactggggacgcagaggccaggccagggctccagccacacagaggggatgactttttgtttttgtttttgttgagacagagtctcactctgttgccaaggtcgccaaggtctgtcacccaggctagagtgcagtggcacaatcataactcattgcagccttgatctcctaggctcaagcgatcctcttacctcagcccccggagcaactgggaccacaggtgtgccaccacacctgcctttttattttattttattttttgtaaagacagggtctcactatgttgcccaggctggtctcgaactcttggcctcaagcaatcctcccacctcatcctcccaaagttctaggattttacagtcctgagccaccacgcccccctgcctggtcattaattgataaactgcacagagtcgtggagcgcttctatacctgcccccaggagactatggggaacttggtgaagttacgcccagcccagcccacaaggccaaggacactgcaccggagccaggcaccagtgcccgccgtcctctggggctcccacccgctcttcccaagctcccgttggccctcaccgtcgaagtcaatgcggccgtcgttgttcttgtcgccgtctttcatcagagattcgatctcctcgtccgtcacgtgctccccggaggccctgaaaatctcagccagctcctccgggtcgatgtagccgtctgcattccttcaggtccgagggacagggcagggctcagggccggggcgagctgccctggccaccacactcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgaccaagaactcctcgaagtcgatggtgccgctgcctgcgggcagcaggtggcagactgagcctgagcccagccgctgccgcctctccccaccatcccctgcctccgagggacacccgctcaccgtcctcatccacctcctcgatgatggcgtccagctcctccttggtgggtgtctggcccagcatcctcatcaccgtgcccaactccttgacgctgatgtccccaccaccatcagcatcaaacatgtcaaaggcagccttgaactctgcgagggagggcagagggcagaggtgaggcctgctggactgtcagcctcacacctacccccccccaacccccaccctgcctagaggccaacatgtccccagcatacatccacccagcccccagcctgccgcgcctcactcaccagcgatcatctcttcgctgaggtaggacctggcctcagcctgctggtccgtctgcaggagacacagagaaagtctgagctgaagaggcagccccagagcagttcctcacctcaaagccattcttcccaacccccactctgtcagcgcccttggttctccagaagaacaacttcaaacttgtcacataattgtgtgcccgcacagcacccaatcacagttttgttttgtctcgttctgtcacacatgctggagtgcagtagtgtgatcatagctcactgcagcctcaacctcctgggctcaagcaatcgtcccacttcagcctcctgagtagctgggactatagcatacaccacgcctaatttttaaaattttttgtagagatggggtcccactatattacccaggctggttttgaactcctgggttcaagtgatcctgccacctcggcctcccaaagtgctaggattacaggcttgagccactgtgcccagcttctgaccccagtttttgtttttgctttttgtttttgtgacagtctcgccctgtcgcccaggctggagtgcaatggcgtgatctcggctcactgcaacctccacctcctgggttcaagcgattctcctccctcagcctctcgagtagctgggattacaggcatgcgccaacacgcccagctaatttttgtatttttagtagagacgaggttttaccatgttggccaggctggtcttgaactcctcacatcaggtgatccgcccacctcggcttcccaaagtgctgggattacaggcgtgagccaccatgcccggcctgaccccagttttttttgtttgtttgttttgttttgttttgagacggagttttgctcttgttgcctaggctgcagtgtaatggcacgatctcagctcgccacaaccgcaacccccacctccggggttcaagcgattcttctccctcagcctcccgagtagctgggattacaggcatgcaccacaacgcccggctaattttgtatttttagtagagatgaggtttctccatgttggtcaggctggtctcgaaccccctaccttaggcgatctgcctgcctcagcttcccaaagtgatgggattacaggcgtgagccaccgcgcgcagcctgtgaccccagttttgagcaaaagagaggagacaacaagttaagcccaaggccttctcacttgtcaattgaaggccaagtcgggaaccccccccaccccccagtgaccttaggcacgtcaattagcgtgccttcatcttttctctgtagcttttcagggatgagatatcaggggtgtgaaagggctttgtaaagggctagcaccattccagcactattttccagttttctgcagctcctaatggtgcccggtactttaatagttgctcaataaaatgtttgttctcaaataaataataatgcaacacaaagttattgagtacttgctgcatgtcaggccacagatcaggcactggaaccacaaagaagagataaaagacacatcatcccgcccctcagagaactggcagagtcggaggctgtcagcttccttcttaggattcagtcattggagaaaaggcccctcatggggggccgaatgtgatggaggccttgacatgaaagtgagatttctgcaggggtttccacgtcatatccaagccaggccatctgggtcagaggctttggattgaggctggcagtgaggacagggtgaggcttccaaggagctcttcagccagctggccaccagtgctcctccttctccccctccttcctctcctcctctttccctatgccaggagggcaggctatttttagtcaggcatgggcaacagcagctggcctctgggatctagttactccttgaagtgaagtggggagggggatctcagaccaaaacaacagctccaaatcagaagccctctctaggagagcggagtctctctaactctggtctgtcatcttctgccccttcccatcatcctcagggctcccagagccctgcatctgagcaggccccacgccctgccggcctcccgtcttctggaggaggctttcttctctccatgatgataggagggtttggccaggcttctggctcacccctgccactggcctgctgggtgactcactctgacccctcagagtccccactgtgtgaaggaaacaagctaagagctcttcacaggtctatgaatgacactgctggaagtttccagaagtgagtaggcagtcagcaagccttaaggatcaatctctggaatatcccagccctcccctttcaagaaaagtcaaaggccttcctccaagacacctgggttccaggaacctccatgctccaacctcaaacatccaagttactgccccacagagcacccaggcctggcctgaaaggggtccagagtgctcccgtgagtaaaggcacaaagtcccctcttgtccttaccatggttgctggtgaccgggactcctctgttgcaggtcgcctcctttgcactccaccacccaaagatgacctggcctgctctagcccccgggatttgtaggggcaccctcccctcccacctccctgctccccagcactggagaccctgcccaatcagatcctggggtcagcgagtcccacccctcccacagtctgaacccattacctaatttagccaagggcccttgcagagaaatttaagcctccaagcaggtggcaggccttgacgtcctagattcttgtgaggaaggcctgccctgttccactgccttggagtccccccgaccgaggaagcacactggctccaagatggtaaggatgatcagagtagtaaagggtgaggcagcatggtaaaatggggagagtacaagccttgaagtccaaaacccaagatccaaggccagcctctgcgagttgtgt

SEQ ID NO: 173 - DNA, 1253 bp, Homo sapiens
  misc_feature 945: n = A,T,C or G
ggaaagaaataactagtaggggaggcccagagtgttatgcaccttcatgagtgcctccccaggcagtagcctctgcaacttgctgggggttcagggaagcaggagttcatggggctcctccagcaaagatgagctccagggctgcttggatgtccccaccggtggcctgcagggcccgcaggctcagctcatcgtcctggatgcccatgtcacgtagctgctgcagctggggctgccactggctctgaaggctgggctgcccagaggcctgaagggcatgctgtagggcttggctgaagagatcattggtgatgggcgtccctgactggacaccagaggacattggtgaggtccctgaggaatgaccctggatgccaggagtcggtgtgtgagagctgctctccggagtgctggccagggccaaggcggtggccagctcactctgggtgatgggccggggcccagcagctccactgtaccccagggaggctgggcgggagctgggagtactgctagagggtgtggacctggtgtaagggtgaaagtcatcctcatcatctgagagccttcaaacaggaagccacctggacatatcccggtatgagctggagggcatgctccgggaagaggagtcagtccaagcattgggggcactgcctgctacggagtgcagaaccaggaccaatggccattgacgagggctgggtgaagcaggcacaacgtaatcaagccatattgggatcagcggagacagagaaagaggtcattgtctgggagaactcagaagcatagggtcactgctgaagcctggggtgggcacaatgatctgatccaggaaactcacttatggctgagccatcttacagaaccggctcatttaggaggagccgctgttgcaggaattttcaagaaccggaaatctttaatgaaagcacattgtcaacngggtacggctctaaaaggataagcggccaggaactacgcagacaatggctaatgtggccccagggtgtaagtcgcgtcagaactcagcgttgtgacagtcttcggtacaacggcgaaacgacgcaagcatggttgggaacaccgagggtgcgacaagcgagcaagcaagatagccgagaatacccatgtaggtgcaccaaacaagtgaggtgccactcgaggcgggaaacatactagtccggagcgccccctgctctcgctttgtcttctcacgcggctgcacgtaacagaagagaaagaaaacgcaa

SEQ ID NO: 174 - DNA, 3067 bp, Homo sapiens
cctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcactgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcacatatcactgtaaggtacagttagggtaacactttagaggtttattatttttaaaaaacttttcttgaactcctggccaacatggtgaaaccccgtctctactaaaaataccaaaattagccaggcgtgatggtgggcgcctgtaatctcagctacttgggaggctgaagcaggagaactgcctgaacccaggaggcagaggttgcggtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttgatgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaaaaa

SEQ ID NO: 175 - DNA, 1103 bp, Homo sapiens
agcggcttttccaagcggctgccgaagatggcggaggtgcaggtcctggtgcttgatggtcgaggccatctcctgggccgcctggcggccatcgtggctaaacaggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagttggcctatctggggcgcctggctcacgaggttggctggaagtaccaggcagtgacagccaccctggaggagacgaggcaagagaaagccaagatccactaccggaagaagaaacagctcatgaggctacggaaacaggccgagaagaacgtggcgaagaaaattgacaatacccagaggtcctcaagacccacgggactcccggtctgagccaataagaccgttaattcctcatgcgtggctggcctttctccattggtggcccgggaatgtccggacccacggggcagaagcagtccagggccccagggggccttgggacataggaagactgggagccaggaaaggggcttatacagtggtgccccagattgtttgtaagcactcgcggaaatatgggaggggcaaacactactgtgagccaccggcaggacagacacagtcttaacacgaaggggggccccaacagactggggggaggcacccactattaagggggacgatgagagacacacagggaagactcacaacagcaatcgagaaacaagacgcaacgagcgtaggcgacagtactaacacacaggcgcagcacaacgagagtaaccgcccaccctatgaacgactataaacaacaaagggcacgagcagccgaccgtgacgttggcatactgatacgatagacag

SEQ ID NO: 176 - DNA, 679 bp, Homo sapiens
gagtcaacacatctttattaaacacctgaagttactgggaggaggccatgatgctggacacactgtcaaagtcaatcttctccacaatgttcttgggtttaatgctctcttcttggctacagatgaagatctgccccgactcgtcggcactccagccgtatttgctcatccacacctttagctggctgtccgacagatccccgagcatctcggccagcagccagcggtcaatgtgctggtaagtgatacccacaacatggcagataaactttcggacagagtcttcaaagccagttataccttccaagaggtccatgttttcatccagggcttgccagaaggcctggaaatggcaggtctccagcaggtccccgaggtacaaaatctgtcggattggccgttcttcttgatgtgcctggtcgatcatgcacttgcacagggtgaagtctgtgtgcggcaagttggtgagggccttcagcaggatctgggcggtgaccgtggtctgaaagaaggctgggttgaactggtacagcttcaggacagccaggttggcttccagatcataggcattttccttggcctgcgtctctacatagcgctccagggtggccaggttctcaggattgtacctgtcgatacccttgagcaacttgcccacgtttgctctcatctgctcaaa

SEQ ID NO: 177 - DNA, 2989 bp, Homo sapiens
ggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttaaaaaaaaaaaaaaaaaaaaaaaaaaaaaa

SEQ ID NO: 178 - DNA, 373 bp, Homo sapiens
ttggtaggcaatcgaaataacataataatacaggcatctctgaatgagaaaggctgggcatctaatataatttctgaaagccaggacagttacatgatccagtgaaatgacataagacaaggaataaatgtagctaaagaatcacaccagaaaccagtataccttcctatatcaactttccactattctctactcatcagatcctaacccaacacccagatttgaaccagtgttcaaaagactgatatgagctaatgtagacaatcagagcaaacacaatttttttcaaaggtaacaggaacttccttggcctagtgcacagagaacatttaatctaccagagaactctgcggagatatggaactaatgcaat

SEQ ID NO: 179 - DNA, 2432 bp, Homo sapiens
ggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggat

SEQ ID NO: 180 - DNA, 554 bp, Homo sapiens
acgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccatgtttccaaaaaaaaaaaaaaaaaaa

SEQ ID NO: 181 - DNA, 899 bp, Homo sapiens
  misc_feature 28, 512, 547, 576, 579, 610, 615, 617, 618, 619, 635, 672,673, 686, 687, 691, 703, 711, 730: n = A,T,C or G
tcgtttattgattacacatgataatggntacacaagcttcattcccatctataattttatctggtaccattattcaatttagatatattgcataggatgtgccaacaatcacttttataaccattccatgattttscttgggtaatcccttttaatggtgaacttcaggtcacaacagtaactatcagttcaactacaccaaggtttccgaagacaatggcttctccacccaagcaggttgtatataaattccaaatagaacctggcatcaccctgaaggaattctaacttcacactgttggggaaatttaccaagatggcttaagagtagactaactttacacagcacattaaaaaaaagacatttattcagcgtcacgatcagactgttacatttagcaatcaacagcatggggtgcaaaaaaaaaaatctacattaaawccctttgttggaatgctttacactttccacagaacagaaactaaaataacctgttatacaattagtcacnaatacagtcctcgggttttttgcccatacccatgngtctttgtctaamacatgtcttctttgtngcngctaggccctgccaccactgtgcttggctgngttcncnnntctgttgtcacctgtngcttccctgtcactwctctggctctcctctcctgcynngctttgtttcctnntttnkttcttctgccnctgccatngctactgctgctgctgganccgccawagccaccttggtttcgtggwwttgcaaagtattggcctcmaccgccaaaggggccagagcttctgcctccaagatttcctcccttcctgggtccmaaatttgaagactgmttkttgtaattcccaaaatmattgtagcttcmacmacctccaaaatwgmttc

SEQ ID NO: 182 - DNA, 2263 bp, Homo sapiens
aggaagtagggagcggggtggcaggggggggacccgccgcggctgctgccaccgccgccaccaccgcctctgctcgtggcgtgggaaaggaggtgtgagtcccgggcgcgagccgcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaat

SEQ ID NO: 183 - DNA, 1016 bp, Homo sapiens
cggatatcatcgcaagactcckggaggacgggatccaaaaacgtgtgatacaggaaggccgaggagagctcccggactttcaagatgggaccaaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaagcatgtggtcctgtacccgctggtggccaagagtctccgcaacatcgcggtgggcaaggwccccctggagggccagcggcactgctgcggtgttgcacagatgcgtgaacacagctccctgggccatgctgacctggacgccctgcagcagaacccccagcccctcatcttccacatggagatgctgaaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggaacagcctgggtcccctgaatggatccagctggacaagcagatcacgccgctgctgctcaactactgccagtgcaagctggtggtcgaggagtactacgaggtgctggaccactgctcttccatcctcaacaagtacgacgacaacgtcaaggcctacttcaagcggggcaaggcccacgcggccgtgtggaatgcccaggaggcccaggctgactttgccaaagtgctggagctggacccagccctggcgcctgtggtgagccgagarctgcgggccctggaggmacggatccggsagaaggasragaagaaaaagscccgktycsggggatcttctccattgaaagagmmttggcctgcytwactgcaarcc

SEQ ID NO: 184 - DNA, 721 bp, Homo sapiens
caatctgtatcaaaggtttatttggaagcttctgagtatgagggttcttgcattaaatgaggattcaaggggggaggaaaaaagtgtgcttgtcagtttggaaagtcacagggagtttaccattctataattagattaggaggaaaatgagaacccactggtagaagaagaagcaacagtcttctagggtctggcatttgatgagataggtattcagttactgtgcatttccattgtttttccatggcagaacatacggcagagatttgggaactcgcatgcctgaagccaggttattcttatgttctgtaactatgttgctcgcagggctgttgttgtcagagtagtgagttgtgccccagacaaatggggtgctggtctgctcccacaaatctttatcccagtcttcatcgcaaggagggcactgccaagtgctctcagccagagtctcttgtctaaggctcctggtttggttgacaacatcttgctcaatacaacttctgtcatcacagcttgagatatgatgactaatttcagctcgaggaacctggtggcgagcattgaagggacaagtagccaattttctttgaacatcagggtgattctttctgcacttgattagatgattaaggaaccttgcagccctgatttgatggtttttgtcttgggggcatttccatgctttctcagggtccagggagtcggtggtattttcttccat

SEQ ID NO: 185 - DNA, 2135 bp, Homo sapiens
ttcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccctttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggttcctttaagtcttaagtgatgccccttccaaaccatcatcctgtccccacgctcctccactcccgcccttggccgaagcatagattgtaacccctccactcccctctgagattggcttcggtgaggaattcagggctttccccatatcttctctccccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtact

SEQ ID NO: 186 - DNA, 766 bp, Homo sapiens
acgcgatacaagtacgtaatgacgacagacgttctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaccttcttcttaaaaaaaaaaaaaaaaaaa

SEQ ID NO: 187 - DNA, 514 bp, Homo sapiens
  misc_feature 96: n = A,T,C or G
tttttttgctcttagaatagactttattgactttagccaagggcaggccctgagatgggggtccagagagaggggcttggtggggctacgtcctgngggccaggttggttctgaggggtagaaggccatccacccactcgcacggctgctccaggagggcttgccacagctgcttctcctcaggtgtggaatccatccagggcacctgcagcccatagctgctgccggtgcccaggctgaggcgtgtgccccccagctggcggttggccagggccccatggtcccagagggagagctcggcacaagcctggcgcaggtcagcaggcccaaagccatcgtacaccatggtgtgattgaacacagggctgaggctgcgtcgcacaacccttgtacgctggcggctggcctggctgtcatcaggcagcacgaagcattgtacgtaagtgtccagggatcctgcccgcagcggcaggaggtccagagcctccttcacccagaagtgcagctccccgtt

SEQ ID NO: 188 - DNA, 798 bp, Homo sapiens
gattaacgatgaagtattttattattttgctgcaaagctgttgcttcactgtataaaaatagcaccagcaaatgcagtgtatcgcaaaattaagatagtggtgttcctcatctgacactgtacaagcaacaaaacctcttcacttccagttatttccaatggaaagatcattaagtatttcatcccaaatccaggtatggatacatgcaagttacaatattatataaggcttaagaataacaatgttatctttgaattatggaatttttatacctagtttttaccatggataatttcatgaattctgaacactagagcctagtctaaaaatcataggatattgcgaaaaagacgcatattatatttatctataatcattagaaagttaaagggcattttctttcattagcagtgttaacagtagtttttttttccccatcggtaatactaaaagtttctattctaagtcttctatccaccactaatttaagacaactctgctgtcttgcgttatttcatactagtttatttaggagttccattttcactcctcaatagatgttatgtatttctcatatgcttcttcactcataagtccatctagttctgaaggggtactcagtgtcatcttgatcagccaaccatcttcataacaagatttgtttacaagtcctgcattctctgcacgagcttcattaatttcagctacttctcctgataaaagatgatagagttcactagcagctttcacactttccaagcaccaaaactatcctggttggtcaatttgtcccactt

SEQ ID NO: 189 - DNA, 535 bp, Homo sapiens
gcattgtatgttttacagaagttagaaacaaacacctggatcaattgtaaacataatcctgaattacagtattttccataggacaaaacacagcaagacattttctatttagacaggcaactttttgatatagagcttatttatactgaagaatctggaacaaaacacaggacacagtactaatctgtcaaatatactatgaaatgcatagtctccacttaaaatgctgaatgacacacacgttttgcaagcattactgctttccacaaaaactgctgaataggagttccgtccctgccaagatcagtgtttaagagatactttatgatgctgataagtattattggtggtggtggtgttcagaaagtttgtcactcatgcagatgtctgaaatcttgttccgaatccatggaacacagggtggaggccagctcccccttttttagatgatcacatagttctgagcagagatgtggtcctcaccctgcagttcctgcaggagctgctgctgctgggatggctgctggacagaggc

SEQ ID NO: 190 - DNA, 729 bp, Homo sapiens
ctccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataaaaaaaaaaaaaaa

SEQ ID NO: 191 - DNA, 648 bp, Homo sapiens
ctttccggacctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgacaaaaaaaa

SEQ ID NO: 192 - DNA, 178361 bp, Homo sapiens
gaattctcattaccatggaatggattaaactggggcaagagtaggagcaaatagatcaatgaggaggctgttccattagtgcaagcagaaatgatgatagaatggactaaagcagtgttggtaaatatgaagagaaatggacagattaaagtggatagattaaagagatatgtagaaagcaaaagtaataggatttgggggtttgatagaattggatgttgggggtaaaggtaatatggttgtcaaagatgacaccatggattttaggaaggaggcagcactctttaacacggacttattaaccctgcatagtcagcttctcccagctccatcccccaacctctcagcctttccagcttcatcttataccaagaccctctcaggatccggtggcgtttactttcttttatccctcttatttcctgtgcttgttcctgagcaggacctttgcacctatagttcctactacctgtaatgcccttacccagctacctgactccttttcatcattcatagttcaatcaccgtttccccagggaagcttcccctgatttccttagttagtcctaattttcctattagagctctcatatattgtgtaccttctctttgtaggatctgtccactggcagctcacacttatttgggtggcttttcagtttaatgtttgccttaccctcggtccccccactaggatataaactaggatataagacagggactgtatcttttttggctcgcttgtgtattatagcctggaaccctgtggttgctacgcacagacacacacacacacacacacctattagtgaatgaataacagtaaaagcaatggaatatatcacaaagaaaaatactggtatatttaattacattaagactatattcttctctgaattaaataagactacatagcaaataatgaacaagtgataaacttggagacatagtcataataaatagacaacaagattacaccctcaatagagttcttaccacatcaacaataaaaacactgataatgcctaataggaattggcaaaaaccaaataaaaaactccaaaaatcccataaagagaaagggttctgacagcttctcactgtaaaaattggaagcccaaatcaaactaacctaaacactaaggaaataatatatttttgcatgtaaccagaaagtcaggttgacttctctgaggttcacaagataacacccagcagcacgtggggacaatacgctttcctgttcacattcatcagaggagaagtggaacctctctctctctctttttttttttttttttcttggctcactgcaacctctacctcctgggttcaagcgattctcctgcctcagcctcccgagtagctggaactacaggcacccgcgaccacactcggctaatttttgtgtttttggtagaggcaggctggtctcaaactcctgacctcaaatgatccacccacctcggcctcccaaagtgctgggattacaggtgtgaaccaccacaccaggccgtagaatctcttttctagcaacaaaatacaagtgcttcttctcagccttattgactcagattaggaccaacctggattaaatctcttgtcacaggaatgctatgttttgattttgaacctttcactagccaaagagattggattactatgcttggttcaatagtaatcaggactcattccgagagctggggtcaattccagaaactacattgttgttgaggagtgaaacacgatgtccactgtaattggccataaccataggaaagaaatggtcaactttaggattgagggagatagaagaaaataaagacagctgtgaggcatcatttttcaactcaaatttaaagctggcttttaaaattacaccattcactgaaaatggattataaattgatttaacttttctggagggcaatttggcaatatatgaagcacctttaaaacatttatgacaaattttggaaagtatacatatgtgtagaaataaggaaacacaaaaatgttcatgtggctgccactaagtggtaagtttatagatgattttaattttctttttaatattttccatagtttttaaaaacaggcctaattacatttatttaaacacaaagaacgtgaagtaacctgttatttaagaacatggacaaattccagtcaagaatatcctctagaagcttgagaggtgggaaaagtagtttgggggatttatttgctctctcaaggtgatgaaaagaaaaatatctgaatcaaagagtctgagttatggaattctctgcttctggggttctagtgcagccccgttggtctggaattcaggaaaaaagatacaaggcataaaatcccacagaaagttacacagttgcaacagaacatttagcatttattgcttgttcttctaattaaacctctaattcaactcactaggcccttgcctgctagctttagtgagtaaagttgagaccatgtgactggacttagcttgatttaatgtcatgttcattgaggagaatggttggacttttttttaaaaaacatgagcataggaaatatctgaagtcacttttaacactagtctgaacatgtaggataaaggaatgtgtgttactgaattgggatttccaatagatatttaacccaatgtgatttggtgatgatgttctttcttcagatttaatttcataatttcctcacttatctcagaccactccctcagttcgctttctgccttaactatcacctctaagtaacatgggataagtcacttaacctttgctgtatcctttcaaaaataggcctctgtcacggaatttcctctctctaaacatctctaaagttctgttggtgtgaagaattagtacgtctcttctggttatatgaatttaagaaagcatttaggttaatgagggaaaattgaattttaatggtcctcccttaaaaggctttacaaaagattttttagctagatgaggtgggaatatatatgctagcaccagattccacttatcagtcatccagcagttacagcaagccagcagctctgcctgcgcctgagttggccatgtatagacaagtgaggactgcagaggcaggaaatatggggttacgttgatttccctctattagcagcagcttaaaccggcatgctgggcagcactgtctcctattggctacagctgctgagagcagcaggatgagggttgacctatatctgtcaggtgtaggtcaaaccctgaatttttgttgcaaacttcagtcttctagaacgccaagtttcacttgtgctcaaccacatacaatatttttatcaggatctgtgatatactccacctgcaaagagcttgcatctgtgggtttccctctctggattcttttgctttctttcttgctgcctctccctcctgtcaccctcttaccatttttgtcccctgcttccgtgtcatcctctggctgagaagggttgagatggtcacagctgtgctccttctagtaatcacagtaacaccagcccttctctgcctgccccagtttccatctgaccaagctgtgcccgttcctttcagttgcagttattgccccaggttggcacagcctgtgcacatatgtgctcctctgggccaccatggtttcggaatgtgtcagttgctaattacaactgcagctgtgcacagaaatacagcacacattcaaaatgtgggtcctaaagttcctacacagtaaatatttcttgatagttttaaggccattttttttcttattttttttttgtaaagatagacttttaagtatttagacatgtatttttctagatgagagaataaactacttgaattttcatttattcagccaccatctaactgtgacaaaggtcctttccctctgcctttggtctcagtcaatatatgtatgttgttttgggacttaattggtattgtgtttttatttatttacactgacatcacaatgtgaaacttaccatagtcagtcctgccttcatactaaagcatcagtacactgtgggcttccacttacaatgcagaaactgcattccatgacccgttatcatttcttcactgaggccttgtagtaatagtaaagaagcccaaatgctggaaaaattattctagaacctcaggtccccatgcgtacaaactacatcacagtaatttgagatggaaaagacctattaagtcatcccactgattctctgaggacctgcggtgttttttccctctccaacaggctgatctactttttaatggcttttccaactgtaaatggcacaagtgatggggtttccacccttcccaaggctgtacagcctataatagatctctccattagggcctgtgactcgttcagctgcctaaatcatctttgttttgactttcatttaccatcactcctcctgctgtccccttgcacactaaataatttctctctgtccccactatttacacccttcaagtacttgttgcccatgagccagtcccgttagagccacatggtcatgctgagagacttgtctctttcatcttctctctgaaggctgtcccttcagacttatgaatcatatttgttgctcttcaatgaatgcccatcagtttcttaataatttgcttcatttctttgttactgacactgctcaggaaaatcttctttgtctccgtcgctgcaaaacaagaagataatggtagtagaatctctgctaacagaaaatagagcggagcttttcagctaccaggtatcttcctacccaggacaatggaatcatctaatcagttatctttaactctcttacttggggtgcacaattgctatgttaacaggtgttaggtgtgcatgtggagacagggatagttcatctatattttatctgggaaggctttgttgtggtgtatttagttaatgcccattagctgtttaagtcatatttccccaccaacctcacttcccagttggaaaagcttccttgaactccctcaagagaatgctaacctcctcctttccattactatgcctatgtttactgatactaaattgtgtgacatcagtgacatcagcatctttgccagaggaggaattcctttgctatgagagaggcagagtgtgccctttaccttgaatgaacatgaatggtacggcaaaccgggaaattctggcagtgggttttgtaattccagggttaatagtgttcagcctgtcccgtctgtacccctctccagagcctactccctggctactgtgtgtgcttatacaccatctaaagtactgaatttaataaggtctggcctactgtgctcattgttcgtatttatgcaataataataataccaacatagtgcttcacaaactgtttttgtctaattgcatcatcccatttagtagttccaaccatcccgtgaggaaggaattaccatctttctttcaccagggagcaaactgagacttagagatgctctattgccacaaatttcacaaacatcccataaattctcctttggagtccctcttgtcctccctctgaaatcactggagaacatgctttctgagcagtatgtgaagaggcactaactgcatataagttcctaaagtcactgaaatgctggccatggcataatgtttatctgtgttctccttttggcaaaaatagagtagctagacatcatccacagttttatatgaatcctattatcagtaggataattcagttgttacacgatgacagaaagagtatatacaaattttaagaaatagcttgctatctcttcctaaacaataaggtaatattattaggcatggactaaaagtgagcttatctattcaaacaccaattcagaccctaagggtatctgtttttcctgcaaagttgatgagattatacacctaagataaaagaagaaagagctatatttcattaaatgttaataacatgatttgaagaagcaaagaaccgaaaaatactgacttttatttatgaataatataaaaagcagaaatataattttctaccaaatacatggtggtaaaggaggcacagcagcctaaaattatgttaatagctaagcaaaagaggacattttatttattctacaactgattttcaaataggcttaccaatattttaaacttggcataaatgtggttatggtaggagaaaagcctgtactaaaagggttttatcctttaacaaactgaagtgacatcaaataaataaaagactcttcagctccagcaatctgaagaaaacccaggtcaagaaaattatgcattttgttgctacctgtacaagtagtccattcctttttattgctgagtagtattttattatatggatagtacacaatttgtttatacattcacatattgatggacatttggcttctttccagttcaggggtattataaataaaactgttatgtatatttgtatgcaaaacaaagaagaaaaataaaattatgcacttaagtgaattgccctcttctgtggcctggccagagaaggcaaattgcaagtgtatgcatatattgtccacacacagaaatgtttagaagttaccatgtctatcaatagggagggaagaattatttcttatatattagcttgcgggcccccactgtctcatgtacggctaactctaaattcagctttgtggctggactggatggtgcctgtgactttctaggaaaaaaacgaagccaatgcatctttgaagatacatccttaactatgccagctgtaccttacagtacccactgtttaaccgtaaaaatgggggggaggggtaaatgctatcatacttactgctttttaaaattactgcaaatgcaatacatgcttactacggcaaaatttagaaacacagaagaggaaaaaacaaactcagatacttttcattccaaagtaacaacttttgacacacccttccaagccttatctacatacctatatatgatatgtgtgtgtatatatattcatctttttaaaacagtaagttttgggtttaaatcttccatagtactaactaattgactactctgtcctttaacttaagatctctgaagcccttattgaagaactgatgctgttttgggctgatataaatagggtgacaaaaatgctttagttaggttttaaaaaatgcatttactttagatgaatcttatgaggctataggttttttaaaagtacaagaccttttacagtcaaaccttggataaatataatgcctagaaaatgtattatatctgttattatggacattattaaggtaaatgaatcttttccaggggttgcagtgtgtcattgaattctacaataccaagggactgaaactgactagacccagctttatgaggtttgggagtgaggcaggaaagacatagctgagttagatgccagcctaagtcactatggatgtcattaaactcactgtctttacccaagaacttcctcctgacaatgcttttcctttttgctctcaagaccagacgttctaatgaatgtttctttagcattttccagtttatcctaagataattcacaaatattaaaacatctatgatgtccctattgaagacagttcatcaaatacctcatgatttgattaaatacttcatcaaatctaagacaccatcataaattgtgccattattttaagtgatgccaagaaaaaagatgctgccaattaaacaacaacaagccattcatttaaaattttatccacgtttcagggccgggcgcagtggctcacacttgtaattccagcactttgggaggctgaggcaggtggatcacctgaggtcaggagttcgagaccagcctggccaacatggtaaaaaccccatctctactaaaaatacaaaaattagccaggcgtggtggcaggggcctgtaatcccagctactggagaggctgaggcaggagaatcgcttgaatcggggaggcggaggttgcagtgagccaagatcttgccgttgcactccagcctgggcaacaagagcgaaactccatctcgaaaataaataaagtaaaataaaataaagtgttatccacatttcagagatgttaaaatgtaaaaaagtttcttataataaataaaccgtggcatttgtttaacacctacacatttcatagacaatattcagtcatataccatgaacagatttttagcgcccactgcataataggttatgaacagagaagttccaaattagaatggatatctttgacatttaattcatttatttatttttggattgaaataagaacaaaaatgttcatattttaatatgtatgtttctatagagaatattctgtttccataccttacattgcagtctctaagtgggagcagaagccttccatgtgatcttgagtgtctttatctccttgtaatttgtcctcagagataacaaaattctcagttagactgcccttttaccttaagaagcatgactgagttctttcctttcatcttcaggctgccagttagtgacttaattcagttttaataaagtcatcaggcttggaaaatgcagattcattccaatttatgtgtattatatcttttgcccattatatcttttgctgggccagtctaatcaccagattttacagatgaagaatgtgaaactcaagcaagttaactgattcatccctaatcattcagaaggggttttttccctgtcacagacagcctgtccaacacaaagtccagttctcttgaagtctcctttcatcttaacagatccaaatatgttctttcagttgcctgagaaatccattttcttctaaattttctgaaatcaaaattcatcctctttttaacattctgccccgtattagcagatcctgtctggtttccaaatttagagtcatacatttttccctagggaagagaaagagatatcccctatttatccacaagagtaatctgctacctggaatatatacatggaaccgctacttggtcaaatataaattagctctaagtgggagaaggtaaggcaacaacttttcatagactcccatcctttcccctttgaatttttaccttgaattatcttgttttcttgctttaaagtggattatctgtaaagcatgtgatagaaacagaaagaaacataaaataaatgtttaaaatgtgaaattttgattaagttaaagaatcacactgagcttacgcaagaaagtatgggaccctatcatcatcggtggaatcagtttacccagctatgtactaaatgattatggtttattgagccacctctgagctcctccccctcttccccagtgtcctgcttccttgggccaaaaataaacctgttagctggaaaacaagctagatgagtgtattagtccattcttgcattgctataaagaactgaagatcgggtaatttataaagaaaagaggtttaattggctcacagtttcacaggctgtacaggaagcatgatgctggcatctgctcagcttctggagaggcctcaggaaacttacaatcatggcagaaagcaaagggcaagcaagcacttcacatggccagagcagaaggaaaagagagatagcggggaggtgccacacacttttttttttttttttttgagatggagttttgctcttgttgcccaggctggagtgcaatgggacgatcttggctcactgcaacctctgcctcccagatttaagagattctcctgtctcagccttctgagtagctgggattacaggcactcgccactacgcccagctaatttttagtagagatggggcttcaccatgttggccaggctggtctcgatttcctgacctcaggtgatccgcccaccttggtctcccaaagtcctgggattacaggcgtgagccactgtgcccagctgccacacacttctaaacaaccaaatattatgagacttcgctatcacaatgacagcaccaaggggaatggtgttaaaccatgagaaattgcccccttatccaatcacctcccaccaggcctcacctctgacatttacagtttgacatgagatttggtggggacacagatccaaaccatatcaatgaggctgggcaaggcttgacataacccagaacaaactttttcctgaaaaagcagaaaaagcttgactagccttaaaggaggtggaatacagaaggcattaattaggaatggtcctagagggaaacatacaagggcttctgagaagatggtctaagaatgagatacaaaggagcagagttgatatgtgaggtatagtccctaacagcatttctgaaatgactacttttggcagaagacacccttattctgcagtttaggaaaacatttgccattaagtcatctgggtttttttgctccccccataaaaacagttcttttcttagagtgggagacaagtccaagtttaaatgtttaaaatcctactcatatttctgaaccactttcttatcagttataattgtagatcttacacttactaggtaactgaggtttgtatttttgatcttgaaatgtgatgccagacccaaaccatattctttgaaatcatcaggttaatgtgtcctcagcaagcaatgtgaccccctactaagatgatttcccttaaaaaacgtgggacatttagccattccaatttcaccaaacgtagatttagtatgttgaggtcaggtgctgtggctcatgcctgtaatcctaacactttggaaggccaaggcagacagatcacttgagctaaggagtttgagatcagcctgggcgacatagtaaaaccccatctctacccaaaatacaaaaaattagccaagtatggtggtgtgcatctgtggtcccagctactagggaggctgagatgggaggatcacctgagcctgggaggcggaaatggcaatgagcaaagatcatgccaacgcatttcagcctaggtgacagagtgagactctgtctcaaaaaaatagaaaataaaatatattgagacaagtctgtgtgtgtgtgtgtgtgtgtgtgtgtgtgtgtgtgtgtgcgcgcgcgcgcatgtccaaatggacaatgatatttgcaaagaacgtagatgtgctttttctttgcattatagtaaaggacatagctaaattcaaagctgcttttaatcacaaataaaaataaaaaattatcttcagagagacaaatccaataaataattacataaaaataaaaattcaaataacattgtaattacaaagttctaacattttattgatattgcaaacatttttggtaatataaacataggaaaaatgattttaaaaaattgaattatattatggcttcatttgctgttttcattactcattaaaaccttgaaaataaataaataaataaagaaaaccttgataagtatggagaatgaaatgagctatataattacaatgtgtcaaagattcctttagatgccatctacattaactacaagactattttaaaatgaagtatgtgtgccaggtggctgataggaaattcttagatcaacaaccattttttttgcagaatttttctgttctttagctaacaataagaacataactaccaagataacatttattgagtgcttactatgttccaggcactgagctaggcctagctttaaaagtattattttatttacatcttaagatttaagaaccccatgagccaggtatgattattatcttcattttatacacatagtatcatgtgcttagctgtgtgtcttctgtgtgccttctgagtagagggttttaggcaagagctaaaagaattctggtagttgtatatgatagtttagcataataagaaattatggccagatgtggtggctcacacctgtaatcccagcactttgggaggctgagtcaggaggattgcctgaggtcgggagttcaaggccagcttgggcaacatggcaaaattccagctctacaaaaaatacaaaagttagccaggtgtgtggtggtgcatgcctgttgtcccagctactcaggtggctggggtgggagggtcacctgagcctgagagagagaggttgaaatgagccatgattgtgacactgcactccagcatgggcaacagagtgagaccctatctcaaaaaaagaaagaaattataagaaaagctaattttatttctagtgttggacagagtgacagtttgctgctaacaatgggctctatgctatttaataaatttttcctcactctatacaaaattccattcctaatacaatgttattctattctcaattttaaaacctttgcagaaaattattttacatgtgtggtatgtgcaaagcattctttctagtaatatatgtagacatgttcagtttagaaaaatgtaaagaagcccagagatgaaaataagtcaccctttatcccagtaaccacagggaaccactattaatgttttggcatgtgttctcttggttgtttttatatatgcatatgtaaatatatatttatattcaattagaaacatactttacagttgagtttggtttttctggtttttcaaattcacttgataatatatcattggcattttgttatgtcattaaaatttcttccacataattctaacaataacacaaaattccattatatggatatactctattagactaatttcttaatgttggatatttaagtaggtggaggaaactttaaatataaatagctaaagtcttactcatgctataggcctcagatctttaatgattaaaaaaatgtgcccagtaaaagccttggactaaagctctattgatctcaattttaatctaaaattgcagggctgaaggtggcctcagaggaatatagtccatttttctatttttcagataggactatatcactatcctagatatatgtctctagaaactattcttgaatttaatgagagcagaagatttcataacactgcccaatgtagcattacagtgacttggtcctgtagcacagactctggaagtaaacagaccctaagaccaaataccaggtaaaggactttgacctttgactttgaccttgacttttctacctcctcattcttggtttctatcagtcttgcagggtatctgggaagattccatgagataaaatacatagagtgcatagcagtgtgaatgctgaacatatgcttttatttaccctgttcctcttaaatctttaactaatttccttacattctttctatgacgaaaaatccccaaacaccaatatctatggcactaaatatacctgaaggccatgactaaccccttcttgaacttcttctgcaaactaaataaagctaaatcatttgactttttctagcgtctacattcataattctttattaaattgtgggaccccaaattaggcaggatttattataattgctctgggtggtgatagagattgtggtgtaagttgtaagagtacaccttatttattgttatgttgatgccactatagcaagaacttgctggattcttattttaatttctttctttctctcttaacttctctttttctttctttcttttctttctttctttctttctttctttctttctttctttctttctttctttctttcttttcattttgtttttttgcagacatgggatctcactcaggctggagtgcagtggcactatcatagctcattgcagcctcaaactcctggactcaagtgatcattctgcctcaggctcccaaatagctgggactatagccatgcaccaccatgcttggcagatttttaaattatttttttagacacaggatcttaatatgttgcccaggctggtctcaaacttcttgtctcaagcgatccctcctgcctcagcctcccaagttgttgggattacaggtgtgagccacaatgcttggcttgaattcttaaaaagaacttatgatgtaagttctatgatataagtaaataactcgggttgtacttgtaggccatcatgacaaggatgactgcttttctgtgctgtacttatttcttggttctgattctttatcttacttagaagcagctccttcattgtttcaagttgctttcattaatttgagtcagttttacttctatggtgttatccatacactctttcttttttgttacttgttttgttaattttgattacatttagaggcaaatgaatttatgtgcacttccctagatcaaggtgaaaccatgacacatctatgtggtaaagtatagctatgacatagaaataaagggtacctctttttaagcagttttctcctaatgtaagtccaatagtgctgaaattgtcttcagacttacaagtttgagtagattttagtatgtcatctgtatggattatgaatttgtaggctttgggtctgaaagctgtaattatcaatgtttgaaagacatctgtgaaggtgaggatatggagacaattagccaaaagttagatatataattaccacaccctgccttcctatcaggaactctggatatttaaaacaaattaggacctttagacaggcccttctcttatcagggtgcatcatcgggttgccttgaatgtaggtaatcaatctcttagccagtaagtgtcctctcttgcatatactattagctcacaggtctttcagagaccaacgtggaaaagaaccatgcctctcaattacatccctggctcttgctacagagggaatttttatagtgaagaaaaaacactggggaaaaaagtcacccaatttttatagtgaaggaatcagaagacctggcttctacttctagtctctcatgtgctatctgtgaccccagccaaggttgtgggcctccatttccccatctgtcaaatggagacagcatacatgttctaacgtcacagaattgttgtggtgatacaaaaaagtcatagatctgaaagcgcttttaaaagttctgtgaagtttctataaaacccaggaaattgggaaaaaatcatgcagagtcacatcatttccttggaatttggaacatttgtttctcttcccatctgtgactaagtactacacatatatgttttgatatttatgaaaccattgagtacatagttacactatgaatagttacgactggaaggtattgagaaaaatgacaaaattccttgttattgataattaacaaaggaactaatcctttcaagggtaaagctacttagacctggctcacagcacttatgctctaactgattttctttaaagaaaactcctgaagagttttctaagaacaagtgaagcaagattggaccctgagtacggaaagtgggcagctaaagcttctttcctcaataacaagtttaagtgccttatttatttttgtattattaagtgacacttgtgaaaatactttgttgagtaatgatgctgtggcaaaactaaagtttatttaggacactgctccgcccaaggtgagcaattaaagcaggtatgtaaacctgctcccctgggctcctccactcaaccacttaagtaagtagtgctagaaatgaaaaagggtgtggggcaagatacatggcatggctgggggtgagaagaagttggaaggggaagaggaggccccatgaaagaatgaaaaaaagtgtgaaggttgatagggaatctataactaaaaatggattctaactgatgactgatatcactatatcaagttaatacaaattgagatggcataagattgattaaaaaacaaacaacaaaaaaattctttttcccgcatggtataataataaccaccttattttaaatgtagccaggaagggttgtgtttgttcatgtgatcaggtttcctcacttcccacacctggggaagtatcggctaatattgatttagcactaatttatacctgatggtcaggatcaactagaatggagaaaaactggtacaaattagaggggctttgtgttcccagaaagcagtttgggctgcgactattgtgtatcaatacaaatcactttttctaggaggaaatggaaataaatttttcaaggacccgtatctattctcagctgctgtactgctagtgtgctcaagattttgtttaaatatgttaggaatggataagatcaagttgcattcttatattttactatgttagtttattaatctgggagctaagcaaaccagaagcagaacaggctttaaaatatctgactcattattatattatacataataactgttagctagtcaggtccatttcccttttcctcaatgaaatttgctataataaaaaaaatctataacctagtcttatatatttaaacaccactgtagattatttggaaccatagaattagataccaatcatgtaaaatgagtagacctcttagattttttaaaaaaaattctacaggtagaattttaaaaggtgttttcttttggtaatttccatgaattgatgtcaggtatcaatgtttctatgtatttggctgaaaatggagataatattttgggcctgaaattatacttggtaaactttcatttatttcatatctactgttgcgcaaatttgcctgatcataaagatcacctgaggaacttgttaaaaattatacagtcctaaccctcccaccagcagaccagctgaattagactctccaggaaaggggactgaaatctgtgtttttagcaagggacccagatatgcctgatgatctgacacatgtggaaaatacagttttgtttccttttcgtattcctcatgatgccagagctcttcaaccctatattcacttctgactatcttgctctccactgattgcactgttttctactccaccctacctgtattaatttgttttgtgctgctgtaacagaataccatgggctgggtaatttataatgataccacagactgggtaatttataatgaacagaaacttactggctcacaattctggaggctgtgaagtccagtatcaaggtgccagcagtcggtgaggttcttcttgtagcatcatctcatggcagaaggtgtcacatgctggaagagcaaaaagaaagagagagagagagagaatgaataaggggggtgaacccccacctgcaatagtgaacccactcccatgataatgccaataatccattcataagggcagagtcctcattacctaatcaccacttaaaggtgccacctcttaatactattacaatgacaattaaatttcaacatgagggggtgggggcagaaagaaagaaaaaaaagttcaacgtgagttttggaaaggacaaacattcaaaccatagcgccatctaagaagtaaggcacacttcatcagccactgtggccttttgtagcagtgagtgtctgctatggtggtagtggaaaacaagtcttgggcagggaggtaagggatggaatgaagggttggaagtatggttcagaaaagtctttcaagagattctgatcttctccttgacaattggtttgtagatgactttgctaccttctgaagtggccacactcaacctccctttgctcgatccaaaactctgtcttacttttgacctcttatcctccttccttcctgtagtagaaggggaaacattgtgcctttttgtcaatgttgtgctcttgatcaaatcctttaatgctaatggaaactaaatctattaatcttcctccccattcaaacgcttcttgatgtttttctccttcggcttctttggcttatgggtatatcgataggaatattttctcttttcttttttctttttttttgagacagagtccaatggtgtgatcttggctaaccacaatctccgcctcccgggttcaagtgattctcctgactcagcctcccaagtagctgggattacagcatgggccaccacgcccggctacttttgtatttttagtagagatcgggtttctccatgttggtcaggctggtctcaaactcccgacctcagatgatctgcccgccttgcccccccaaagtgttgggattacaggcgtgagccaccgcacctggcctgtcttttcttttaaactagactaacatgtactttctttggctctgctcaaccccaagatcccattttatatcatgccttattttaattgttacactcttaaaaggaatattctgcattgatgcatctaccttcgtacccatcttgctaacttagttgtaatctggcttcgattgggccatattttatggacactattggcttgaagatgatcagtgatgagatccagtgctttttgcttagctcttaacctgctttcccattcagcagcatgtgacattgctgatcaccttgtccttttaaaagctgcatcaattagtggtcatttgatataacagcagaaacctactcaaattattgacatgacaaaagggatctgagtacaagactataggaaactctcccacagaaagtatagtaggactgtacaaggactggaataatgaatgatgaagccatcagcaacaagtaaagttataacaagtaattattgaacacgtggtatatcctaggaactacataggtgttaagtgatcaagtagtgaacagaagagacaaacaaggtcgctgcctctagagactttacaatctagtaggaaagacttgccattaggaggtaaacaaatgtgtattgacaacatttaatgagcaaaatagatggaaaaaactgacttaatgatagattattataggttattagtgatgggtgaggactcaggaaggacattctaagacatggcatttcaagggaattgaggagcagggaggtagaagtgatttaggctgaggagacacctgtatgcaggccatgcaggagcgtttcaggggaagtgaaaggaggcattgtggctggaactgaaaaggggaggagaagagtagagcaaaagtagtcaggccaggtcaggccttttaagctattttaaggaatttggatttcattgcaaagttattggaagacaccaaacctttttttttttttgagatgaagtctcaatctgttgccaggctggagggcagtggcatgatctcggctcactgcaacctccacctccctggttcaagcgattctcctgcctcagcctcccgagtagctggactataggcacgtgccaccatgcccaactaatttttgtatttttagtagagacggggtttcaccatgttggccaggatggtctcgatctcttgaccttgtgatccacctgccttggcctcccaaaatgctgggattacaggcgtgagccaccgcgcccacccgacactgaacatttttaagcaggaaatgtggctcaacatatttccaagtttaccctgactaataagtagaaactaaattaaagaaggcaagagtagaagctgggaggcaagttgagtagctgcagcaatagattaggtaagagatgacagtagtttgacttaatgtaatagcagaagagatagaagtggatggattagacatccatttattaaaaacaaatgagaggactagctgctgggttggagggggcgatggtggggagaaaaatgagaaatcaaaaatattgtctaggttaattgtttggaataactggatagatggtgaaaccatttgctgaaatggggaaaaaatggggacaattttctcagaggttaagagaaagcaggaatatggaaattaagattttaggcccattttagacacattcacttcaagtattcatgggtacttgacgtatcaagcaggcaactgaatatacaaatatgaatcttggaggaaatgtctgggctggagagtttcatttaggagttgccagcattttgcagtatttaaagccatgggaatgtctaagattaccaagaaggtgagtttatacagaagcaagcagagaatagaggccaatttttagagggaactagaggaggaagaacctgaagagcactgagcagtagtggttagagaagtaggaaacagaacaggtgagtacagtgtcccagactcctatagaagagatttttttaaagaactgagcctgaccagcaatgtggaaaactgctaaaagctggaaaaggaagaggtcccagaaatatccactgggtctggcaatatggaggcagttgatattgattagcagttttcagtggcatgaagccagattggaatagactaaacaggaaaatagtagattaataggattaaataggatatcagaagtaacatgtagacatctctgtcaagaactgttgctgtgacaagatcaaagaatttggaccatagatggaaagggatggcagaagaatctttgttttgccttttaaagtaaatgttggcataacagcatgttcaaacattactgggaaaaatcaataatttgatgatgaagaagatggagataataactgcagaaatgaagtccctgagagacaagagggtcagaatttaaatcagaagtggaggagatggctttcgataggaaaggagaacatgtattacctgtacagaaaggaaaaagaaattgatccaaatgttgaaaaaatcatagatttgatggtgggactgtagtggagatgtatcagcaggaatgggtctggagttggggtggttttggaggattgaataaaatgcataagaaacaaaataatcatcatgggaaagtgaacttcctctcagactctctccctctttctggtcacctggtgtgatttctccttctttctgtaagtcacttcattcttttctctcagaaggcaggtttcctctgcttctctgtgcccatgacagaaaatggccactctatgcacaattctttatagaaaaatattttatttcttaatttcagattcccaaaggagaaaatttaattggcccagctttagtcagttgttgaactcgggtgaaatcaaccatggccagaggggcaaggttatttgggacatacatagctgtcaggcccaaaccctctatgtgttgggggaggattggttctcagagaagagggatattagtttgtcagatgacccacgaagcagctaccaaacttattttctgagaccctgaactctattttaaggagtacttctgccctgccttcttttctagtattgttttctttcattttttttttgttgttgttgttttgttttgttttttacttatccctccatgactcacgtataaattttcacaattttgtttttcaccttcttttcatttctatgcttttctcctttgtgaccatggcttcagctaccatatggacatggatagcccccaaatctatatctcttgtcttctcaacttcactgtcgtttaaaagctgtctctatttggatattctctggttattttatttatagctgaactcattatcttttcaccaaacctcctccttcccttagctgccttgtttgtgttaaagccatgactatcttctcaggcatccaagcttgaatcttcagaactgtctggcgttctcttttcaaagtccacatgatcatcagctgagaaggagcatgactttcaccttatttcactctccatgtcctttgtcattcccctgactcatgccacctaaactaatgtggagtatcctctaaaccttctacatcgtcttccaaccatcaatctctaattcaatgctttaagctattcttgcattaatcttcataaagcacagctccactcatgttctctccacccattcaagaatcttcaacagctcctcactgcatatccaataaagtgcaaaccttacctggcaaccaagggccgtcatgacccgtcatcaacaggctaagacttatcttccattaaccatcagccaaaggcaaactgttcaatcatcttctgcctggttttgtgcattcctacctacatgacttcttcatactcttcttcctgaagccttttctcaagtgagctttcctttccctcacttcaataatactctatttacatcctttttatataaggcaaatctgtagatatggctttagctttgtcggcatatctttttactcctctttaccaaagtgtgagaacaggtaaaccctactgagtgtaaaacagtgtctgacacttcaaaaacattcaataagtaacctgacaaggagttgctatggcttgatgctagtattgttgctactaagcccgcatttagccttattaggggcattaatatggaccttttcaataagatgctgagtagggcactctgaaaattgtgtttcaaaaagtttaaaataataaaaagaaacttctctagtccagcactgctgatgaattgacggcaccctaacaacagtccctcaacacacttactcgtgtggcaaaaaataagatttggccacataggaagaaacctatgacatactttaatgactttcaactctcaataaaaaaaaataacattatgataatcaaacatattcccttcataggactactattgctttcaggtattatgaacactctatttgggactaaaacaaatagaatgtcacaccatagaaagagaatatttatagtcctttggcccccaagttttacctgtgaatgtgctgactttatacaatatagtcttttagttacatggtgagagtattatgcatcagcttaagatgcattggaggtgccactggcatcatagttggcaattggagctgctatggcgatgaaaatctgaaaaaccagtggttttcattactgttttctatttttgagaaataactgtacacttattctggatgaccttaccagttaaaaataaaatatctattactattgcttcttctgaacttcttttagaaacaaagttttcattatttacatataatagtctcgtctacttaattatcatttattttcagttcctttacacaggtctcttgagaatagctcttcttaatagtgagatagaactaaataccaatcagcagatgtcactccttaagtgatcctcttcagttttctctgtttatttcagttgtcctttttttttcaatgccttttctccattgccaattctattttccttcttttggagataggttcccactctgtcacccaggctgtagtgcagtggcacaatcatagctcactgtaacctcaaactactgggctcaagcggtcctctgcctcagccttgccagtagttgggaatatgcctggcccccattttccattttcatcctctgatgagcctccaggagccagtaggtctaacaaccataatgcaaggtattctatctttttgaatggcagcttcaatacaaatatctgtgtggtttacagtagccacatcagatatttttctactctgcgactaggcttttgtagcagagatacacctgttagattttttttcctgaggaaaagcacaagttttagttcataagataaacactggctaaaatttgccactcttaacaacattaaacaaatatttattgatcatctaccatatactaagcactgttgtagagattcagcagttataaaactgataaaaagtcttcacttcatggctgttctattctagacagacaaaacaaaaaataattataatatattatggtttggttgctgataagtactctgcaaaaagagtaggataaagagcaggaaaagccgaggggtgcttacaatttttaaaaaagtgttcaggaaagctctcatcataaaggtggtgacatttgagtaaagacctgatggaaatgagtgagcaagccatgtggatatctgggcaagaacctttcaggcagagggaacacctagtgcaaaggtgcacgtaggctgtcacaagcagtaaggagtttaatttaagcatctgccagggacaaaaattcagtcaaggcttttttgttgttgttgctattaggaatcaatctacaagagagtttaatcagcttaagatgaacatcagtgcagatctgtttagtgttctctcccagccatgacctcattgcaaatactgacagcctggactgcctctcagatttggatgggccttggatgctcagccaggcaaacccagatggagctagaagaggaaggttttggtagctctgtgggctctgtggcttcttcatcttatgatctctccacatagggctgcatataaatcgcatgtaaccaatgattccaagttttaatttaacctaaaatgtagtctattaccatatttgcactaagaagaaagtagaacagaattctacctcagattagctaatggcagatcctcgtcccacagatagccatggcatggggctactgatacagaagtatttctcatgccaccaaattgtgccttcaattttgtcttctttacacaggacaacatagtaagaggtcattgttaacattaagtcttatataagattttcagagattgttacacttacattcaaccagtatggaaaatcggcactaggcctaactaccccatagctagcatagtagcataacaacgctcttctagcctagcaatccacatctcattctagggggtttccaatttactaagaacattttcttaaagcttctatatatccttggagcttactttgtcctcaataagaataaaatattatcaagaactcaacaaatggacatttgaaagcaggcactgagtttaatttattttaggccacctttgatttgtttgaagcctgtattccttaaatatgaagatcagtacttacgtcgtgagaataaaggtttaagagacaaccaaggtttctatagcaaagagaaacgactgagcttctagattggtcataatgacttactagtaactgaaaatagtattttaagatcatactaattctctgtttctctgtgtgagttatttagatttgctttagatgtctaagtcagctgtggtagatttgaacaaacacagaaagtccttaaaatatgactaggtatgttgctttagatccaaattaggtattgatcattgtgattgtgacctagaataaatttagaattattgtaacctaatgtgttgaagttgttccataaatatatttaggagtagctagagatgacatttctataatgcaactatgctgtaatcaaagcaacaactcagaaatttaccagcatgtaaaagaaaaatcttaactttttttcttcttcttcttcttttttttttttttttttttttttttgagacagggtgtcattctgtcacccaagctggagtgcagtggtgtgatcaaggctcactgcagccttgatctcccggccttttgggctcaggtgatcctcccacctcagcctccctaaccgcgtccagctagtatttttacatttttagtagagatggggttttgccatgttgcccagactggtttcaaaatcctgagctcaagtgatccgtctgccttggcctcccaaggagctgggattacaggcgtgagccaccgcacctagccagctttacatatttttaatctgtcagattttttgttcttgctattctgagaaaagtcactgaaaagaaatcatttatcattctttttacacacaaaataatgcagtttttaaattaatgagataggccatttatataaaatttgaaagagtaaagtttttattcataattaaaatatatgttattctggaaaacaaaaaaaaagtagtggtctgtcttcatttgtaaaatttcctttgaactgatgggaacttatctcacagatgagatttgtgggccattgtgaatactctacagattatgtaccccacagctttgagctgccaggtactatagcagagtgcttcctcagactcttgagccagtctgtctgggtgaaatttttagctccccatatactaactatgtgatctcaggcaagacagcttatttatgccacaactgagaccacagtaaggataataatagtatctaccttgtggattatatgaggactgaatgaattaacacacataatgttcttagaatagcggctggcacatggtgaataaatgttagctcttattataatatgtggtaaactgaggaactatcactagttttacttggatgaagtactgcatgaaatttttgtatttttattgagtttcatcaatttttttactgaacctagtatgctttctcgtctgaacacacaaggaagaaaagaaggatggctcctgtacgtgaaagtgacccctgcatatagtgcctgaaatcagaggaagcttgtcagtgtgggcagacaccacgagcagaccaatttgacattgtgcttctcttttaacctcttgaaaattaatgaaagttatctgatgaagatccttacattaattgctcccgattaaggtttaaaaccttggtttactgtggggtaaatttatgtttttgatagtcatccaaaatctttgtacgctttcagtttcattacagaataaaaaacaaatttaccacaatggattattacattacatctggtatttattcctcccaagaagctatctgcttcggaaaagccaggggcgcccttcattaatatatctaactgatggtgtaatgacataaaattccttgttgacccctgctattcagtgttattgtcttggaacatagaacttgataatctcttttcactgcataactacaaatgttaggctgtaagagtattttactttgttcagtgcaggttccagacatttctcctgatcaccagaagttcttttgattaataaggctactggtcacgaaaactcagcttactaaaagagatccagtcttctggttctaactaaaacatcccaccggatgcaggtgtacttgcaaattaaagtttgcctcatgtgtcctgtgtctcaagtcatacagacggcccaggagggtggagcccctgcaacctgcctagcggggcgtttgcgtgtctgggggtgtcgggacacgcgcaggacacacacagtcccactttcctagtctcgcacttacctcaaggctgtcaacttttacgctcctccctgcgcgcacagcccccacctcacgctgccacccctcacgccccgccttcaaagtaggaggcaccattgtcattggacactgcttctctcactcctattccagaaccaatcactcgagttctagtggggagcgcctaagccaatggaaatgctcgctgcggcagctgccgggtcctgggcgctgggaggcggtgccgggggcggggtgcggctggggcgaattagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgagcggccctcggggctgcgtgatccgggccgttgccctgtcagcacgatgcctggagcggtggcggcggcggctccgggctccttgcggccccggccgtgaccgccacaccgagcccagccgggcggttgcggccgttggacgtttgttttcgcagccttcccctcccccctcgccgaggcggcgggggtgtgcgttggggagggggagccccgagactcctcccccacagcgatacccccgcccctcccccttacacactcgcacgcactatcgcgccggctcccacacgctcgcgcgcctcccgccccgcgcctccgtgtcggccggcggcgtccagggcccgcagagccaccatgtccactgcctcctcctcctcctcctccagttcctctcagacccctcatcccccgtcgcagaggatgaggcgcagcgccgcggggtccccgcccgccgtcgccgccgccgggagcgggaacggtgcgggcggcggcggcggcgtgggctgcgccccggctgcgggagccggccggctgctgcagcccatccgcgccacggtgccctaccagctcttgcggggcagccagcacagtcccacgcgtccgcccgtcgccgctgccgccgcctcgctgggcagcctcccggggcccggcgcggcccgcggccccagcccgtccagcccgacgccgccggcggccgcagccccggccgagcaggcgccgcgggccaagggccgcccgagacggtccccagagagccaccggaggagcagctcacctgagagacggagccccggctcgcccgtgtgcagaggtagcgagcccaaccctcccgtcctcccgggctgcgtctccccgacggtgccctccgtggaaacttcagcctcttcgggcttctctttgctagtgcattatcgaaggtgtgaaagtggctttgggaatctcacccccctgcggtcgctgtggggcttggaggagcgaactgaaaagcgacttttatttgaccctcatgccgcccctcagagtctctcttccatcactcgcctgcttcgagaggtttttcagtttaagagctggctagctcattcgtgtgtttgccgtttgtagccggggaaggagaagctgggcgaaacacttaacacgcacacaaactcttcagcagcggataaggtggcggttgtaatctctaccgtctctttgtgcttttctgcaaagttcctaacgtgcctgtaactaccgggatagtattttattttttagagggttggtggcattagtttcgatgtaaggatatcggctggatgtaatgatatctgctagaggggacagttttgaatgtacaattgaagtgtatacggttttttccctcagtcctccctctctccctctcccccagccccccgccaccccgcctctctctctccctctctttctccccctcccctttatatattcatgcatcagagcactcctgcactggaaacagtttgtgctctaccggagattttcatggtaaatttctgaaaacttatttgtggaacgtgttcgtttttttccttccatttttaagtacacttaacagttcagttgagctgttcaaggatctcaagtttctttttttgttaggtgtcaaaggtaatggtgagctggtggatgctgtgggtttcccttagtgttttctgttttgctttggttttgtttatgtctagggacacagtgcatgatttagttgagccctgggggagaaaaggaagattagccaaaacagggacttaaagctcataagggagagtggaatagctaatattgttagataccgaactagagctacagatgctgctgctgcattgtggagggaacagatcatactgggtggaaaaatctctgcttggaagggaaacactgtcaaagtctgtacattgtttatgtggtatgtggaatttttttttttaatggagctttcttgatgaaggtgttagagttggagaaagtggttgtctgcattatgatacattgcagtcttggtgtttttgttttaatatttcagacccgtaattagcatgttgctaacgcacttgttttctgaccacttgatggtgaaccagtgtaggatgtagtgcagtgggatgagtacatgagcagcaagaaatacatcctgtaatctgtatgcattgggaggaatatgctcctgcactcctcccccaggtcaagccagctgctgcagaaactgacatcctccagcaaatcctgaatgaatgaatgaaaacaacgtgatcgccctaataatgaccacaactgaacacacatctttggctgtattttatagaaaaggccaccattttctaacagattaatgccatatgcaactcctttgcacattttctagaactgtatgaaatgagaagtaacagaacgaacagaaaacagttacataaattttttagtgatttcgcttcaacagtgcacaaattgagttttgggattttcttgtagggactaagaggcataaaataagcattgcagattgtgtacagagggtctggtgggtgtgagtaagagaagtttcggcaattgctgcaacaacataatggccatctagtacctcctccccttttgtatataaacactaacatcttacaacggataatagtacaacttgtttttctgcatccttcaaaaggcttaatggcctaggaattacatgctccatcatcaagcagttttaataaaatttgtgatctggcttaaactattctctttgttgtagtgtggcacatacgagtttaatgcgattttaatgcaatcatgatgaaaacacttttctgagtctggttgtgcagcagacagatttgcagtgtcagagagcttgtgttgggaatgcaagggctttctttgctaaagatgtttttctgctgttttaaacaccaggtggttttgtcagtttcttacattgcagtgatttttgaatgcgggcttctgtgcccccagttccgtgattatattactcctatgttacttctccatgtcccgccttttacccccactacccaaattaaaactgtcctactaaactgttctgtttccttagccatttaaaatccatgatctgaacagttgatttaatttttcgaatgattatcttctcaatttcttttgaatgctgtaaggttctgacttgagtggattttagcctccactggtcaaggttcctgccgctgccactgctgctgcagacactgacatcactatactgcatgaatgaaaaacaacaacgtgctccatttcttcctctgctctccacctcctcctttttctgcacacttcagtgtatgtgtgtgtgtgtgtgtgtgcgcgcaagagggtgttaaaactgcgtttgaaactacacttgaaagcattaagtagttgatggctcaaggggtaggtatatagtataaaggcatattgtttatgaaaagctgcaagggctatgggcatttcgactaaaggtgacataactgagcattcagtgtttcatgcatttcatctggagtgatgattataggagaaaatatggaagcttaaaaatgtttttatgattcttttaccaaaaaattatgaaaccactcaatttctaaataaattatatcattatctgcgtcttaagcattcttaatgtgaatatttgtagggctaaggctagagtaatagagaattgatattcagattgtttcacaaggctgaggaaaagctgaattctataaataggaatagtcaattttaatattattataatattaatttatacaacccaggaaaaaatgataatttcctttatttttgtagtatagttttaaataatttaaatggttaccataatagaaatacgtaaattgccaaataccttgctgtatatatagcagacatggagttttacaaattgaaactgttttgtttgtgctcatgcatcatcctctttttgcttgttttttttcttttgtatttttaaaacttcaaggtttgttatttacattcattcctgtacttctgccattagtaaaatgtcatcctccctcttgtttggttctgaagggtattgcagtggtgaatgacaggctgctgaatgaatcctcaggctccctgtgatgtgtttgtaatagacgtaaaatcataaagtattatgcaaatagttatttttttgtaatggtaatacataaagtctacctttgagataaatagagcaactcaaatgagaaaaagcaggatgttagtgttaaaattaatgatctttaagctaaaatcattagtaacaaccaaaagaaaatatagtaaagttgcttctttttgaaacctcacagaccagaacccatggatttaaacatagaacaaatacagttttactgtccaagatagtaagtaggaaatgcaaatctttgtgtgcgtgtgtgtgtgtgtgtgtgtgtgtgtgttttgtaaagatagatcattaggattaattataagttctaaaagatgtaaaaacagtcatatttagaatactctggatggagaatacagcttatttttaagtgtaccaaatctgataacaaaaacatggaagagcttgtaatttatatagctcctgttttgaaaaatagcatatgttagttcctgatttaacatatcaggtttatttaggcctaatactctaccagattgctaactctagagtgaaatttgattagactttttcatgagtatcttgagagcctcattgttttatacataaagaagttatgattctattctaaaagataatgcaaatataatgttaactccatgtaatatatgtttgcctgtgttcattcatttgctttcagtttttctcttttccttaaatttatctttttaagtcatttttatactgtgctcaatggaatacaaaaaattttaataactttttctcttttaaaagagatactcagatattctctttctataaagttttattctcaggctattcttgaaaattaagatcctccctttccattttaaaattaattaattttccttgagtgcttatagatacttgtttcaaagctttcttctacattaatgttttagctttttctaaagagacaggtttcacatactgacttttgggaaaggttttcattctcagaaaactatgctagagagcagcagtgttcattatttacagaactatttttttccatcagttatctcatggtgcctaaaatttctagatcaatcagtgaatagcaaaatagataaatgaatttatagttatttaatcaaaatctattgtcttatgttcaaagattatattcctctcaaataactgttattgtaagcgtattgaatattgaatacctagcatgtgtaaatcatcttaatcagtttttaactgtatgtaaagttctgtgtgtatatatcgaactggaaatcattttattaattacagtactttttacagaaggactgccgtgtacgtttctgtaaggacttaatgcaaattaggatttgtactttggggaaatgttgaaggataatggcgtccttgtgatttttgttttacttgtgataagtcagactacatgtgaataagaaaataagggagtaactgggctccacagcagtgagtggaatggaaataaatgacagtgttcaacaaatggctagtcggagagggttttccttagtctgaaattttaaaaaattctaaaagtctgttttattaaaatgttcacaggtagttaataatctgccaaagagtatagtctaatgacttagttcttcttaattttagtttggtcttttctccagaacttaacatttccagacaccactaagatagactttctggcagcccctgtcctagtctgtgtctggcactgctttttgtcttcagtatataatttattcttttattaagtgtctaagaagctaaatcactgacactctttttgtgctacatactgtttaattattttaacgagaggttgaaaatatctaacttctggtttctgccaaaagtaagtggaggaaagggaacacaagtactcatatattgatatagaaagcctagggaactgatggaaggcagatactacctgtatttccctctgctcttcatttggacccttgaaagtgaccataagttgactcatcatttggctattctggaagaatttttgtgcttattctgaaagacaaattataatggattagcagtaattctgaaaaatctaaggattttacttacgaacaaattgtggaaaagtatttcattgtagcatgaacaaacatggcagatacctttaagcagtgttgtttattccaagtgaatgttactaaggcacataccaagttcatgaatacctcagtgacttcccctatactatgctgtgtctctagttttaggtaggaaagaagaaaacatatatttgtgtgctaactatataccaagcaatgtatactttgattcagcaaggatttaggatgtggatcttctcattccagatccagtgttcattccataagactatgctgttgctcctaactcaaaaagactctaatgttgatgatcagctgtgatttctaagctaaaagaatgacaaaggaattggttttcttttgtttccatggcactattacgctgtgctggggtatggtctgacattttcagaatgtctaaaaatgtgagacctagtttgttgaatgtaactaaaataaaatatagatggattggccatttttctccatttctttcttgcatataaggagaaagagacagagagaatgtgtgtgtgagagagagaaatccttgtttctgagatagagagagaaattcttgtttctgaagataggaacatgattgtatctgggctttcttgtgtgtattcagaatcggtactgtcctcgaatcactttgtagtgaatataagtgcttttctccccttttctctcttcataaatgttaaaagttaattacatatggtgctaaactgatggaagcttcaggaatcactaaacagagactggtctcaagtgattgtcccagcaactggcactaggttgattcagccctcccaaaagacaacaggcttccaagaatctgcaatttgtgggttgaacagtgtacgtatataacttaatgaagtccaccatcgtataccttaatgatggctcaccaaaaagaatgatgatttaaagaagctagtgggctgggcgcagtggctcatgcctgtaatcccagcactttgggaggctgtggtgggcagattacttgagatcaggagtttgagaccagcttggccaacatggtgaaaccctgtctctactaaaaatacagaaattagccgggcatggtggtacacctctataatcccagttactcgggaggctgagacacgaaagttgcttgaacctgggaggtggaggttgcagtgagctgagatcatgccattgcactccagcttgggcaacaagagtgaaactccatctcaaaaaaaaaaaaaaaaaaaggaaaggaaaaaggaaaggagaaaggaaaaaggaaataaaagaaaggaaaggaaaactagtaacccacggttgtgtggcaaggtcagtgtccaaaattgtctaccaggttattagaattgttaagaaatcctgctgggcatggtggctcacacctgtaatcccagcactttgggaagctgaggcaggcagatggcttgagttcaggatttcaagaccaacctgagcaacatgacaagaccttgcctctgcgcaaaatataaaaattagcctgggcatggtgggacactcctgtagtccagctactcaggatcctcctgagtgatcctcaaggaggatcacttgagcccaggcggcagaggttacagtgagctgaaatcaccctactgcactccagcctgggtgctagagtggggtgttgtctcaaaaaaaaaaaaaaagttaagaaatccaccaaccatctagatgtgtttcgtaatgaaaaggtgaaaactgctacaacttcctgtctagtgttactgaagatcaaatacttattaactactgacagtaataattccttatttattctctgtagccataaagaaaacttttgtgaatagtccgtatagctaattttaacttttacattactaaaaaattagctttctgatgaaacattttctaacgtcattacacacttgattgttaagcacagtgaacaagacataaacgaactccttgtggcttgattagctttattaataacttattgataacatatacataaaattgattactatagatgatattgagaataagactgaatgagtattgactgactagacttgtgctataactgattctataaatttgcttttgggattatttcctgtttttctgatgaaggtggagcaaagcatgtttgactgaactggtccttgatagtataaccgggctgttttctctagaactaattatcaaatgaaaggccaaagcaattattttccaaatggttccatagacatgtcgtagaggcataaatgtatcctgggaaatactagatttggagtcaagaaacctgagttctcttttcagttttgacatttgtcttatgacaagccactaactctgcatcttatcttctgtgtctttaaaatgaaggggatagactttttaagattttggttgggtagggaaaagattgagctatttaaaggaaaagaaagtttattagactagatgattcttaaaatttttatttattgagcctttatgccaactaataatctttggtagaatccaatataaggtacttttattaacctcttttcacagatgaggaaatgaggtcctgggaagttaagtaatttgcccaaggtcaggcagcatgcacagggctcttgtaatgctctaagtcctgacttcaagatagctgaaagttgttgttggaacccagttagttatggggcaggaaagtatgcacaatgtattatcccactgcttatacagttaagtcatagaaaggctaaatatagctttggggcggtgagggaagaagagaaagctaaatgggactagacgctagggtgcatggaacttaaaatagctgtaagtatccccagtaattatgccatcattgggccttccctttggtccctaaaggacctatcactttgtttagacagaatttagcattttatttttaaaaacttcctttcacatgaaatttcaaaatctgggtagaataaggtctcttttttgtgtattcatatttggcaatgtaaactttaaaaaatctgcccatttgtaatgtattataaggctaccttcagccccataattatgattctctacatttatcatcctttgatattttagcaacatttaacatagtatctttttatacaacactgtcatggcaaagcaatgcacactaccttaaaaaaattatttatatgtacttggctctttcacttcttttaggtttgttgatgtaatatagaaaataaattttaatctctattttaataatttcttctggggtgttttggcattttttcaatgtcatttgtgcttactataagttctgcatagtagttaatgtggaaacgattttcttttataagtaacattagaaattgtgtttattgttaggagagcaaaagtattatatagagtctttgtgatggataaagtttctcataacatttcttctgtaattatatttacttttctagttaaatatatcagttgtacattgaattagtgaagtgtaatgctggtatcttagaagataataaaaacagtaggactcagtggctcagggttacatcaagtctagccatatggaaactttactattcctcatacaaacttgtgaagtgatctttctatgaaggtacaaaaatatcatagtaaaatatagattggtttatattagctaattataaacaaaatgtatttataatatctttcgaagttttgtaagtgtcattttatttcttctaaagtattcttggagttactctgacacattgaccttaaaagaatcaatcaacagtcctcttcctgctttatgtcagatcatttaagtgtctaggacttaactaaactggtgttggcaaacattgctaaatgcagtttcattagtattgcaaaagtgaggatttagactgtgctcagagattagatttttgaaaaaagctacagtattctgcaatatttcgatcatagagcttaaaaagtgtatttcaaaggtctattaatactttacatgccagagtgacctcttagtttgtaaaaaaaacgcattcagggaattgcatttgctcactttttatctttttaggtaacaaatagtgggtcaaattcttagcagattttaaatgagttatccttgttcagaaatatgctattgtcactgagttttagattttatatatgaattgtttatttctaagttagcttgagctttttctggtgttctgttttgaagttgccactctgtttatgtgtatttttctttcattagatgaagcttgaaatattaattggttcatcctatggtttctataacatacttacatctaacgtatcttgctgcctttacctattataatattatactatagtttagcctaggatgatgtcactggccctttctttctatgcatacatatacattagtgcagaagtctgaactgtattgttgaatgtggcttcttgtgtagtaatgtagtaatatgtagtaataatactgtgtagtaatcttgggcagtgatgccttgtgaggctgttgagataaggaggaattggctttgtctaaatatctgctattgctgagctagaatgggaagtgacaaacttttcatgtgttatgtcaccatttacctgaaactttggttgaatgcagtgacccatttttctttctcttcttttattttttctttatctttctgtctttctgtctttctttctggcagtgtctcgctgtgtcacccaggctgaagcacagtggcacaatcttggctcactgtaacctctgcctcctgcctcagcctcccaaatagctgggaccatgggagtgtgccagcacacctggctaattttttgtatttttagtagagatggggtttcgaactcctggcctcaagtgatccacctgccttggcctcccaaaatgctgggattataggtgtgagccactggacctggccctatttttctttcttataatcagactttacctattttcagtttctattgacttttagtttttgccttaaagaatattagtgacctcaccagggcttatagctgaggagaagtgggtgccatggcggttctactggagactactgtgggcaatgtggttgtcaatttgcacactgagcagcagccttgcaactgtgaactttttgagagcaggtaccacagtttaatggcatttgtgatggcagtgccaagcatctagaaggtactcgcctgctttaatttcttgagatattacaaaataaaatattacagttattgccttattcacagtatacaaaggtattttatcatacaaactgttgatcctacagggactggtcatggaggagagtctatttttggcctaggattgtatggtgatcaagcaagcttttttgagacagaaaacgtcccaagaattaagcacaagaagaagggcacaatgtccatggtgaataatgacagtgatcaacatggatctcagtttcttatcactacaggagaaaatctagattaccttgatggtaccatacagtatttggtgaggtgacagaaggcattgacataattaagaaaataaatgagacctttgttgacaaggactttgtaccatatcaggatatcaggataaattatatagtgattttagatggtccattttgatgacattcctgatttattaatccctgatcaatcaccagaacctacaagggaacaattaaagagtggtagagttgacacaaatgaagaaattgatcatttcaaacgaaggtcagccgaagaagtagaagaaataaaggcagaaaaagaagctaaaactcaggctttacttttagagatggtgggagacctacctgatgcagatattaaacctccggaaaaatctgtgtatgcaaattgaatccagtgaccacagatgaggatctggatataatactctctagatttgggccaataagaagttgtgaagttatctgggactggaagacaggagaaatcctctgttatttctttctttctttctttctctttttttctttctttctttctttctctctccctctttctctctttctttctgtctctctttctttctttctttttttgttgagatggagtctcactctgttgcttaagctggagtgcagtggcacgatctcggctcactgcagcctctgcctcctgggttcaagtgattctcctcccttagcctcccaagtagctgggactacaggcgtgtgccaccacacctggctaatttttgtatttttagtaaagacagggttttgccatattggccaggctggtctcgaattcctgacctcaggtgattcacttgccctggcctcccaaagtgctgggattacagatgtatgcttttattgaatttgaaaaggaagaagattatgagaaagccttcttcaaaatggacaatatacttatagatgacagaagaaaacatggattttagccagtctgttacaaaggttaaatggaaggaaaaagtgggaaatacaccaagagtgatttaaaggagtatacaaaggaacaggataaaccatctaatttggttctgaaagataaagtaagcccaaataggaggcaaaatataatgttgtactagatgagcaggcagaagactccaagtcaagtcactcacacacaagtaaaaatcacaagaagaaaacccatcactgctctgaagtaaaagaagatgaagactacataccaatcaaaaatattaatccagataagtatgagaaagtttggagtttggtcactacgaagaagaagaaagctgttgggagaaatgaaagagtaaaaagagagaccgaactcagaactgaagtcgtagctgatcgcaagagaggaatggccattatagtaatagtcacaaatccaaataccagacatctttatgaaagagaaaggagtaaaaagagactgaagcagaaatccaaagaaaaatccaaagataaagaaaaatctaagtacagatgaaagatgaagaggcagaattgagtggctaacatattcacccttgtctaacttagagtgccaggaaagcaggtgttcagattttgtgtcagagcttgttatttttttcatactaggattatcaccctttagattattaatactgattatatagggcactgaaagaactcaacattttctttgtatacttttttacactaatgttattgttatacataaatggtagtcttcatttttgaagtctttcacatttttactcttcttttaaaatgaagtatttatgctacaaaaatacataaacgtgtttataaaggcaaagggataataaatatgaatatctgtatactcatcagccagcttaagatctagaatattgcctatactttagaagtcccctaagaaccctctccctctcaagtaattatttggaaatttgtgtttgtcatttgctttgtacataggtatctctaaatgaaatgttaattttgtatgtttctcaattttgtataaatggcataatgtttgtttacttttgtgactttcatttttattgctgtattgtattatatgaatacttattcttctgttgatgtacatttgagttttatttagttttgtttttgctgctgaaactgctgctgtgaacattgtctgtctaggagttatagtgcttgatcatgtgctatgagtatcttcatttgtataaaataatgccaaattataaaaaatattagaattatagcctttaatattactattcagttatgttagctagtctttaggacacttgccccgttgtactttgtattaaacatgtggtcaaaaaataatgtctttatgcggatattcctgtttaatgaagtacgtgttgtagttaacttcttggtaaagcaaacaatgttaaatgaatcatattttgtggattttcttttttatgggcatatagaacactgaagaaaatcttacggcctctgactataaccatgtaagaaactgtataaaattgtatgtaggaattttaggaaatagggaggtataggaaaagtaatgaaatgaattataattaatatttgttttgttcattttaaaatattattctattattgaattaagtgcctcaaaatataaaataaatgtatagtgcagtagctgaatctttgattatttgacccactgtattattccatagttaatgtagtgattctagaggctttgatagtttagttatgatttttcatttatcttgatgtttttataactctgtattcaaggtaattttggtggatatctgtgcttcaccaaataatagcatgtcatttttagtattccagcatctactatggtttctggtgtttagaaagccagccttgcagtaaatattttttaaatccttacatagggtttatatagagatttctgtttagctatatatgttcaaatctgtgatttgaacccagctacatgaacaatgattgttagtgcatgcaagtcctgtgaatatctgacaaaggttaaaactaatagattatatttgtgttgcccattttgtaaaaatgcctaatagtttaggtaactgatggtttttatcttcatttaaggcctgttattcagtggtagtggtggaaaaacactgatttagactttcacacaaaataaaaggagctgggtgctcttgctggtagagataggtgggataaagatgggtgatgtcagcatagtccacatattaaaagatggaagatagatttccacagaatgagtttctaagttacatttaaagttctattaagtgaattttgatttagtgaggctccatggactcagcttctgaatttttgtttgttttttttgagacagggtctcactctgtcacccaggctgattgcagtggcgcaatcatggctcactgcagcctcagcttcctgggctccagcaatcctcccattttagcctctggagtatccaggaccacaggcatgtgccaccacacctggctaattttttaatttttatagagacgtggtctccctatgttacccagactggtcttgaactcctgggctcaaggaatcctctcaccttgggctcccaaactgctggtattacagagccaccagtgctgaccctgaatctgttatacttagagaaactaaaccatccatgcccaaaatttggtgggctcttcaagttaaaaattctgatgtttttatagtccctcctaaagactgtggtaatactgagctccaagtaaggagaatgtgaattatatattaatttgaacttcatcgtaatgtaaaaactttaaactgtaaagcagattttgaggtggttatttgctctacgcaatatctaacttatgtgcaggtaaaatgacccaatttacaaaatgttatttacgcaaactttttaggaagtcagttacacaaggttgaggttcatctgaggttgtaaaaacatattaactgaatagtgtaatttctcattgctgaataaaatgttctactgagatttagcaaaattaatatcctaagaaactattataaatgaacatgaatacatcttttccattccctttctgtctgagttttacaattctgaggaatgtggtattcaaataacccctaaaagggaaagaactcatatatgctaatgattttctcacatttctgtgaaaagatatgcttatattggataaatatcccaagactttttctggaatattttgtccttatttaaaaaagtattactttagttatagttccctaggaaattattcctaaccagcctcatatttctgtccttcttccaagaaaaactttcacaaaacattctactcttgtcactgtcagggggacagagcagtaagtaagcataattagactacaaatatggttagtgctgtagattatgattttgtgtatatttgtatatttctacaggctgattttaatttgttgttttcgtatatacttaaggacccagggaaatgtgtgtatgtatgtgtatgagagagggagggaaggaaggagggagagagagagggagaaagagaaagagagtaatagcatgcgcaccctaaagttcacattcctttttcagcaatcactggataatccctggctcctgacattttctccatacagagtagaggttcatgatcactttttcataatactttaggtaattttaatatactgagggatagtgacttaggatttgctcacttcgtataagataaaaccaatgatgggcacacatttacctgtgtaacaaacctgcacgtcctgcacatctatcctggaactttaagttaaaaaaaaaccagtgaacacccaactagacatattcctgaatgtcttccttgtgattcaggggaagtttactatttatagtgttatatttccttctcggaagcatttattcaatgctgaacaccttgactgaactgtttacctcagagttatttggtaaggtgtaagtttgttgtgtgtgggtttggagaaaaatcaatccgtttagatataaatcctttcttctgaatcatataatatagttttagaatggcaatcctgttatctgcagtttaattttcttaacaaatgtatcaattttctctgctggggttggctttataatttttgagtggaagattatgttggtatttaaattcaaacttgaaacaagcattgaaaagtataattactgcatttctattggctggaaatgagtatttttatagttggtacctgtgtatggcaagttaaaacagacatgatccttacacattctacaagtttacaaatctgaattttttaaagtatcattataactgtctttggatattttgctcatggtttttatcttcttcttgatcctgttactgtctgtataaaaagttttaaagtgtattcaatctctttttcacaaaatagaatatatcatactctcttagtacaggaattcgtattcaatttacatgctttgaaaaagtgacctagtgtggccaggcacagtggctcctgcctgtaatcccagcactctgggaggctgaggcaggcggatcatgaggtcaggagatgaagactatcctggctaacacggtgaaaccctgtctctactaaaaatacaaaaaattagccgggagcagggggaggggggggtggcaggcacctgtagtcccagctactcaggaggctgaggcaggagaatggcatgaacctgctaggcggcgcttgcagtgagccgagatcacaccactgcactccagcctgggcgacagagcgagactctgactcaaaaaagaaaaaaaagaaaaagtgacctagtgtatttttctgtgttactgagaataaaactaataaaattcaacaaattttactctatataattgcaagtttgagtcatgtgttttaaagattcatatgtaatatatgattagaagcatagttatgaaggtaagagtattgaatgatttaaatttacactcagagacttggtacagaaatggagttggtttcttcacttattggcatgatggttccagcctttatggttaagagatattcagacctagagtgtcattggattgagttcttacttcctactagcataatctttgactttttctcctcactcatttctcccatccttctggtcactatatcttgtcttaccttctcagaattatctactgaacatggtggggtttttttgcattctttccatgtcctaattattacttcttgcttggacttttggaattgtcacctcttaagtcttttcccatgccagttgtcttgcatctttaatgtaatcattatactgctataagtacagtctttctttaaaaacaaaacaaaaaaaccccacaaaaactgattttaatgaaagatttctgttggttccttggtgaattaggggtaaaagactcatctcactatcctccactgtgtaccttgtgttcctgccaaactgaactcactttctttgggtatatttttcctgtcaggaatacttgtgcctctaatatacatgatttttgcctgaaaaccctagccgttctttgcaaacagctttccaatatcatgcttctctgcaaaatattcctgacgtttccaggtaaagagaagtgtggctttctttgaatattcaaagcactgtatttacacctttacatcgtactgtcactatttaagacacttgtcatctcatctgaaatgtcagtttcttgagggcaggaattctggactgttcaggatctcattgcccaccaaatgtatttctctacttgaatgtttctatttcactctaacaaattgcctgacattttactacttagagatccttttgagttgacagtcatttattgattgatgattgacagagtctcgctctgttgcccagactggagtgtaatggcataatcatagttcactgtaaccccagactcctgggctcaagcgatccttccacttgagcctcccgagtagctaggactacaggtgcatgccgccatgtctggctaatttattttttattttttattttttttagaaatggggttccactgtgttgttcaggctgttctggcctcaagttatccttccgctttggcctttaaaagagctggggttgcaggagtgagccaccattttattttttaaaatgcgtatctctgaaaagatatccttgaaactcactatctttgtatgaattagttcaattagattattttcctcatgatattaaattgagaacaacagtaccaagataatgggagtcttcttggagatgagatgggagtgacggacataatgctttttggggagagtaagtagtagtctttcagtaagatgatgtttggaatatgagaatatagtctttcatctccatatggccccaaatcccaaaacctagaactaaggcagcactggagtctctgttgataagagtttacagtttacaataaggtttttgtggttaagtctatgttaaaaggatccagaaagttcaactagtgttacgtgttttaatgctgatgagcagagttttttgttttgttttgttttgttttgttttttactatcaggtgtattgttattagtagatacttagtatcatcagtgtgaaattacataccaccttgctttgacaaatcttaagaactttcgaataagttatgggagtcctgaccatcctttaaggaaaacagtgcactcctctaaaagcctattcaaagaggtcacattgaggaattatatatgttttctagtctttttgaagtacttttttttaatgtcttcggagaatttcatttagaatactcttggagtgaatctgtcttttaggggtagatacgacttttgaaaataaccaaatgtcattaagaacctaatgtggagagtaaggtaggtgattaagttagattatcttatttatggtgacagatgatgatgcttatgcaatgagagtcactttaaaatttggacagactgtctccaagagtaatttagacaaatagagttattaataatacaaaaagtcttctatagtagactcctatatgttcacctaatcctcttttctctccctcttgtgcctacttctaggctgtaatttctggccccctttgcagttctgtatttttttctttgctgacctctgctgcagttagataaggctaaatgataaagaacactttcatccttgttcaacttaaaaattcttatgtggtcctcctcattctttcttttccctcatctgccaactggatgcagagaatctagtaaaggactctgaccaaggtcctaatggaatggtagagccatgagatgaatgaagtctgaatccctaaatgatcaagtaaaaagcaatctgtcagtcagaaaatacatattgggcttttattgtgataaggcactaattttttataaaaataaagctataattttaaattgtagcggctagcattaccacccttactgtactttagagtttgaagaaggtagtccactagctgatgctattggagccaccttgaaaattaaccttgggagttcctctctttccttatctaatctgtcacattggcaagtatggttaatttgtgttggcagtgcatctgtcaatgcaagagacactccatcaacctgttctatttttgtgtttgtaaaatgtcagagcatagaaatcatggtcttttatataaatgaggaaaatagaatgacaattggacctgaattcaagttgtttttttcactgtcttgtactttattcacagtgattttagatgagcctcacataaagaatattaacgagaaatatggagctattctacttgaggctcttcccaaaagtctgctttggtaaagaggtctagaatacatgccaggcgattttaaatttttgaatatttatttcatagtaaaggctaaggagaccacttgtgatagccacaagtttaacaactgttttgtaagtagatatactaggtgtcagataaatgaaaatatgacaacattcttgccttttaggaacatacctcctggtagataagtcttgcattaatcatttaagtgcaaggtaaacatattttgattgttagtttttttcctctcctgtctcattctaaagtgaaagtaaaatagctgagatataggtgaaaagagagacagatacaagtgtgtgatctccatgagaaataagtgagctacattacttataatgctccgaacatgcgtagttcagttcttgtcacctgttaatactaaacacatagaaaggattttaaaaatgtaatcagaagtgaagggagagagaaaggagagaaaaaatccactggagctatctggcttggtgtggttttgttttcctcctactttgagatgagtccagtacatctggaggtattattcagttttgtattccaaatgccccagctattctaggtattgttaatgattcaggctgtatctaaaactatcatctgagattaattcactcatttcttgggcacttagggtgaacagtgctctttgtttgttgaggagaaaaaaattaaatacagtaaacactaaaactttgtgactgtagtctgtatcgcctggacagtgccattttgactgaagcacagttcaatcggtaatatcaattgactctttttgacaaagataataatgcccagttttgtggctattttagaaaataaagcataatgctatcctccaatatgttatgacactttgccctacacttgtttatgctgctggttgttttatttcttcagttgctctcaatccttggcaaaacttcctggcaatcttttatgcacaatatttgtagaattgttgaggtgaaaggtgttctgtgtatgcagacatagactggtgttttactgtgttgtgttttactcgtggcctctacaaaagtgtgatttctgtaagacattttccttcaggatattttctgctgcttttggcctttccgactttatgaagcactcaattttggataagctactgctttacagctacatatttgattctttggtgtcaatatatatgaaagtaaatgctagaattaacgtctgtgtttccgtatttctgaagccttcattctgttgagtctgtttattctgggtttactctagaaaagtgtagctagttgtgtttcctagtaaacaacatattcaccattgctggatttggggacacattgtgggggtggggagaatacagcttgtgagctatatttaatttactacattattttgcattgagcaaatcagtggtatccagacatatttcagtacagatttctatttatcatttgctttgcagcagtagattagcttggctggaaatcataccttactcaggttaaatagttactctttttcctaggcctttccccttcatctcttctacatttaaccatggatttaactcttcaccctattgctagacagttacgagctaatttgtagttattacataagcaaagtgtttaagtgtgtgaatcttttgtttataaattgtatgttaaaatatatttggattaggaattctacttttcagtttagatatcatgagaagggctattcacttgtctaggagactgttgtgttttctgtattatatttagctgttctttattcaaataggaaataagaatgcagataattttccaaggaaggatgttacttttcagaattagaggaattataggcatacacctatctaaatacattttacatggcataatttgattgtccttttgtagagattccataatattaatagccataatcagctttttcttggccttgaaaataattttagggatgctttgttctttactgacatgtccagtagttggtaaggtagtgtggaaggagcctggttattctctttgttctgtaagaggcccttctagatttaccccattgcaaggagaagatcttcctcaaggcttctatcttttctacatggctcttcttcaaccccctcagtccattatcccatcatttctcatggtaaatatctttctccataaaaggaactactatttcttaatgctttcctggttcttgctatagacttccataggatgcacttggaactttgtgagtgtcaggcttggagggagagaataggcaaaaacctattgatggttttagtgtgaatcctccaatttcagttactttctcctctagattgagcaggagctgatttctttactaggttacttagggagaaaacttacctctctaaggctagccaattcaatgacgttggaggaatattagaatttattttttctttctttctttctttctttctttctttctttctttctttctttctttctttctgtctgtttctctctctctctctctctctcatatatatatatatctggctctagaaggaatttaataactcacatttagttatcagacattctggaaatttatagtcttaaattcaaatgtgttgagagggaaacaatgtaattttactatccttctatggtcatttatttcatttagtggtggaagacttgcccatagagatactgaacatactgctgctctcttctccttcaaaggtgctggctcaatgactcacaccttccaccagttcttatgttaattcctttccaggcttttgattgaagagcattctctaatagattttcaggaaagactcataggaacaatattccgtaagttcttgctagttatgtagcaagaactcagatatagcttttttaatctgtagcctttatacttgaaggtcactttagctttatcagatatatttgatatgttgattattttccccagatataagtatgtcctttccgtatgtcctttcaagttatcttttattttaggagagttttaaaaattatagtttttagtattttttgttttgttcctttggtcatttcttgagggactcctgttacacacacatgttggaccttctttgcctatgttacatattactttctcttgaaatcttgtctcctcatttttttaattctgtagtttttttcttaccatttcctatttctgttaaggcattatccattgtgtttattcattcttgtgtttcttgtaacttagtcttcatccctaaaataagttttgatatcttttctaagtttttcctgagtttgatcacctctattttcatatcttccttgctgtcaaacacatcatttccgagtattttttaagtaatgaggtttttcatcactgttgtcatttaaaaaaggatttttagcttactttgaaatattaggtcacagttttcatcttatgtgagcatgtctttctggcatgctttcattattcatagggacatcttttattctttgtatgcttttattcccttacaataactttaggaagaatctgctattttctgttgttcattttttttaagtaaaatgattttttttgtacttttaaatagggtggatagttcatgataccatttctgtcttcaaggctctagtgctcccactcttcttgtttttgtaaaatgacttctaaaaaaattctcgattctgctctcttcctgactccgttgtccaactttttctcaaccttctcttttctttgcttctgtctgctcaattttgattagactctcagtaatttctctttactgttggattccatgttggaagcagttcttttttgttagatttgagcatagccatattgctctagtatctcagactttattgagttgatgtcctcttgctttcacttgcaaatcagattgtgtggaatcccctcccagtttggctactattctagattggccctttacatttacccattagtgaattgtgttctctggaccatcagaagcctgggtacattcctttgctgtctctcacacagatgctgataccactatggcccaatacttttttatgctttctcccaactcatttatatttggtgttttgtggagatattttgtgactttattatgttgtagatgccaatactccttgacttacaatgggggttacatcctgaaaaaaaaaaagaaaatattttaagtcaaatatgcatttaataccccagtaaacccattgtaaagtcaaaaaattgtgagtcaaactatcataagtccaaatgcttcttgacttaggtatgatgggtttatatcctgataaacacatcataaagtcaaaaaattctaagttgaaatatcataaatgtggaaccatctgtattgtccttgaatcttttgtttggctattgtcttaatctgtttcgtattgctataacagtgtcacagaccagcatggccaacatagtgaaaccctgtctctacaaaaaatacaaaaattagccagacatgttggttcatgcttgtaatcccagctacttgggaggctgagacatgagaatcacttgaatctgggaggcagaggttacagtgagctgagatcacaccactgcactccagcctgggtgacagagtgagactctgtctcaaataaataaataaagtagctatagaatattatagctagtttataaaattttcagactcagggttaaattatttaatgaatttaaactattaaaatctaaatttaacttacatattagagcagtctgatttaattttactttgccactttcacaaaaaagaaattcattgttcacaattctggagagtgggaagtacagtatcaaggtactagcatttggtgagggccttcatgctatgtcatcccatgacagaggtagaaaggcaagagagcaaaagagggttgacctagctctaataacaacctgctcttgtaatagcattaatgcattcatgaaggcagagccctcatggcctaattgcctcttattggtcccaactcttaataccatcagagtggcaattaaattccaagatgagttttggaggggacattcaagtgtagcacctttcttccttgctgtctgtctgtcgttaaaatctattctgccagcatcttcatattgttggaatacattgacaaaacttctatataaggaacagtcttgaatattgacttattactctatttaatggacagaaaatgctacatatattacatagatatacatagagatacacacaaacacacacacactcacacactctccatatttgtccaggtaatggtttcacttaatacactaacagtgtttgtgtttgtgtatcagtgtttgaagtgaaactgttacgtggacaaatagggagagcatgtgagtgtatgtgtttgtgttttgtgtatgtctgtgtatttctgtatgtatggacatcaatcccaagtaaaagcaagtgaaaaattttagtagtatcctctactagaagagtgaatatttttctatttgttgcctttatttcttattaaataaaaagcaaattttgagggaaaatgctttttcctatgtgtcattatattgaggaaattattccctactttaattatcaaggtgtttgaccagtaatattagttagcactttaggaggctgaggtaggcaaatcatttgagcccaggagttccagaccgtcctgggcaatatggcaaaaccccgtcctctacaaaaaatacaaaaattagctgggcgtggtagcatgtgcctgtagccccaaatactcgggaagctaaggcaggaggatcatctgagcctgggagatcaaggctgcagtgagccgagatcgtgccactgcactctagtctgggtgacagagcaacccaaatgtccatcaatgatagactggattaagaaaatgtggcacatatacaccatggaatactatgcagccataaaaaaggatgagttcatgtcctttgtaaggacatggatgaagctggaaaccatcattctcggcaaactattgcaaggacaaaaaaccaaacaccgcatgttctcactcataggtgggaattgaacagtgagaacacctggacacaggaaggggaacatcacacaccagggcctgtcgtggggtggggagagtggggagggatagcattaggagatataactaatgtaaatgacgagttaatgggtgcagcacaccaacatggcacatgtatacatatgtaacaaacctgcacgttgtgcacatataccctagaacttaaagtataataaaaaaaataaaataaattttaagttcaattaaaaaaaataaaaatgaaaaaaagagagcctattttataacctttgttgttgtgctcttgttaaaaacagtttttctttataaattgagatgtaatagtgagcctgtctcatttcataaaaaattttccaagctgtggtgctttaactggaagttaaattcacagaattttgtgaaatattgttttctgagtaggaatatttgtgttccttttgcttacaatatgactttccacctttggtcagttattttagttgtttttgtagttgctaatactttgtgattacttctttagtatatgaactcattagtcatagtggattttagatgtttggaatttcattaacagaattcatttgaaatttgtaaggctgatgaatctccttctactaattactactttgctaaagttcgttaaaggactatcattctgccacctcccaaaaaaacgaacttaaaaaaatcttttgccatatatgtaattaaaaaaaaaaagtattccaaatatcagagctccatcttaatttgttgtgtactttttcagtgcttgttaccaggcttcttgtagccatattagtgaagttttcttttcaaccttgatgcaaagatactcccttgagttttctttgaaaatagactgaaggcctccttctaaatgtcttatgtgtcatttgacataagtttattgggtgagctgtaacctagagaatcatgcccaaatagctgcctgactgcattttttggtttgtttgtttttcctgatggacctcaggttacagagttttgtcaggcctcatttggtcagaagcatgtttgtttctcttgtcagcttcttgattggtttctttccagattctgcagggcagccatatggtcatttctgcatgttttctagattgcttctgtggtagggttccaggtttggttgatgagtatttcagattctacccacactgagagagcttcagttttgctctttggttttatttcagatagcatattcacaacttgtgtccttcctgtcacttatctgaagttcatttgaatttggtgattttattttacgtggcctatgtatttggctaatgtttcatcattttatatgtcaaggaggaagactattaatggctgttgaagtgcttagattatgctaacttaggaaaactaaatctagtaataattctattggatgataaatattaatgtacattagattgggtagaaaaacataccagtcacctttccatatcttgtattctcagttattttgttacctttttttttaaatttattttgaaaatcattgtctataactgcaaggcaaggagaaaattacttaatgttagtagtgataatacattaaaaactatagctttcaaggtattctcattacagaattaatgaagtaaatttctactaataaaattgagctttaggaaatttatgcttagccttagtgaaccaatagcaggaaaattccacacctgtatttatttatggctatttttgatctcaggtagattaagaactatatcatttccagatattttgaagtttaagaaaagcaacttaatgtcttgtattcagtctgatcttgatgaatttggtattttgatttcaatgaagattgaattaatatgaataagtgaagttaaacatcatgaaaaactcactgactacctgttaaaataaaggttttataaagtagctatagaggctgggcatggtggctcacacctgtaatcccagcagtttgggaggccgaggcaggcagatcacctgaggtcaggaattcaagaccagcctggccaacatagtgaaaccctgtctctacaaaaaatacaaaaattagccagacatgttggttcatacttgtaatccagctactcgggagcctgagacatgagaattacttgaacctgggaggcagaggttacagtgagccgagatcataccactgtactccagcctgggtgacagagtgagactctgtctcaaataaataaataaataaataaataaataaataaataaataaataaataaagtagctgtagaatattatagctagtttataaaaattttcagacttagggttaaattatttaatgaaattaaattattaaaatctacatttaacatatattagagcagtctgatttaattttactctggcactttcattttgtaagagaacctactttgtttttttcagacttacatttttgaggaggtagttttttttgtttttttttttttttgttgttgttgttttttgttttgtttcgttttgttttgcttttgagacggagtctcgctcttgtcacccaggctggagtgcagtggcgtgatcttggctcactgaaacctccgcctttcgggtcaagcaattcacctgcctcagcctcctgagtagctgggattacaggcgccctccaccacgcccagctaatttttgtacttttagtagagacagggtttcgccattttggccaagctggtctcaatctcctgacctcaggtcatccacccacctcggcctcccagagtgctgggattacaggtgtgagccaccgtgcaggctcaggaggtagcttttattgtaactacttttaacttttatttgcatgcaaaatgccttgtttgcgtggttgggtctttttccaaagaagctatagtgtactttgtctttcttactttctagtgttcctaagcattctaccttagagtgttttgtatttaggttttaaggttcttattgccatggccagaacttaatttattaatagctactgaccttttgaaggagctgactacatgtttaaatttattagatctaaaagtttagctgctaattacagatttcaaagaattggttgacttttttgcagcaggatattttctagagtgtatagtcaagcttttaatgtctctaaataggttgttgaataggttgttgccccccaaaatttattttttgagatacagaaagaaaatataatttctgtatttttattttttattttctacatatacatttctatttttctgttttataatatataaaatattagcaatatcatagatatccagttcataaataagcagctacacattactgcatgcctatatatttaccaatagggacacttagtaaaaataatttgaagaccatagttctgacagagtagttatagaaagtgaacactaagtgtagagcatgtgatctttttaaagagatagataaagattcaatgattaaaaatataataaaagaaaaattaagtaaatatagagtaaataagtaaaagtatagattagaatattattatacagaccaagggactcatttatagattgtttatatatttaactcattataaaacattaaaatgggctgagtattgtgactcatgcctgtaatctcagtgctttgggagcctaaggggaaaggattgcttgaggccaggagtttgaaaccatcttgagcaacacagcgagaccccatccccataaaaaatttaaaaattagccagatgtggtggtgcacacctatagtcctaactactgtagagctgacgtgggaggatagcttgagcccaggagttccaggctgcagtgagctacgatcacgccggtacactccagcctgggcaggtgacagagcaataccctgtgtctaaaaagaacaaggctgggagtggtggcttatacctgtattcctagtattttgggaggccaaggtgggaggatcgcttgagcccaggagtttgagaccagcctggtcaacatagtgaggcctcatctctataaatttaaaaaattagctgggtgtggtgatgcacacctgtggtcccagctactcaagagactgaggcaggaggatcacttaagtctgggagtttgaggctgcagtgagctgtgatcatgccactgtcctctagccctgggtgacagaactagaccgtctgtagaaaacacaaataaaataaacaccaccccttcaaaaaaaccattaaaatggttcctattgtttatttactaaactaaaaggagttttaataattaaatggactacatacagcgtttcaaattgtttggagcaatttaagtagaggctcaagttattcacttagaatggcgtttccttatctggttatagctgacctttatataggccttttaaatttagaggtcaactgataaatgtcggctttgcctctcaacagtttgttgtcttgtgtttcttcgcagtggaaggaatttaaagtaaactttaaaattttaaacaaattactataaatcagataatgggagatgttaattttctgtttcccagtgttgctaaaattagtaggtattgcctttataaccaggaaaaatattcaaaaagttaatataaataacttctagtagtattaatagaactagaaacagtttatgtatcttcagagttacctatgatgtggggaggaggtaaagataaagggagaagaaacaaacaataaaacagaaagcaattagcaaggaacattccaaaataggaaaaaattacatgacaaattaaaccaaatttcttataacaataaatataagtgggataagctcaccttttacaaccagaaggctcgctacaatgtttttttcaaaaagtataaaaacatactttgttttatgatacacataaaaaaatcttttaggatgggcataccatgtaaattaacagaaagaaagcagaagggggtcataatattcagtatcataaaatttcaaaaataattaatgggacaaattataatatgatgcatataagctgtaatgttgatgtcaagaatctatatgtaccctttaccattatgtaatggccttctttgtctcttttgatctttgttggtttaaagtctgttttatcagagactaggattgcaatccctgcttttttttgctttccatttgcttggtatatcttcctccatccctttattttgagcctatgtgtgtctctgcatgtgagatgggtctcctgaatacagcacactaatgggtcttgaatcttaatccagtttgccagtctgtgtcttttaattggggcatttagcccatttacatttaaggttaatattgttatgtgtgaatttgatcctgacattatgatgatagctggttattttgcctgttatttgatgcagtttcttcctagcatcggtggtctttacaatttggcatatttttgcagtggctggtaccagttgttcctttccatgtttaatgcttccttcaggagctcttgtaaggcaggcctggtggtgacaacatctctcaacatttgcttatctgtaaagaattttatttctccttcacttatgaagcttagtttggctggatatgaaattctgggttgaaagttcttttctttaagaatgttgaatatcggcccccactctcttctggctgcaaatcaaaaccacaatgagatactatctcacaccagttagaatggcaatcattaaaaagtcagaaaacaacagatgctggagaggatgtggagaaacaagaatgcttttacactgttggtttgagtgtaaactagttcaactattgtggaagacagtggtgattcctcaaggatgtagaactaaaaataccatttgacccagcgatcccattactgggtgtatacccaaaggattataaatcatgctactataaagacacatgcacacgtatgtttattgcggcactattcacaatagcaaagacttggaaccaacccaaatgtccatcagtgatagactggattaagaaaatgtggcatatatacaccatggaatactatgcagccataaaaaagaatgagttcatgacctttgcaaggatgtggatgaagctggaaaccatcattctgagcaaattatcgcaaggaccaaacactgcatgtcctcactcataggtgggaattgaacaatgagaacacttggacacaggaaggggaacatcacacaccagggcctctcatagggtggggagctgggagagggatagcattaggagaaatccctaatgtaaatgacaagttaatgggtgcagcaaaccaacatggcacatgtatacctatgtaacaaatctgcacattgtgcacatgtaccctagaacttaaagtatacttttaaaaaaaggaaaaaaaaggaatctatatgtgctaaataatatagaactaaaatataaaggtcaaaaatgtgcaaaaaataaagagaatttttagaactcaatagtagtttaaagcttttagagtactcttctaagtctgtaacagataaaactgataattattcctatattctataatttaattcaattgatatataagacaaggaactatatattctgaaaacaaaatatcttctctgtaattcatgaaacgtttataaaaaatgaccatgcttttggtcacagggaaaatttcaggtaattccaatgagtagaaatgggttccattagattctctgccttcagtataatacaattagagctaaagtaatacagataaagaggaaatctggtaattttcagatcttttctatcaattcttgggtcaaaggaaaaaataaaaactgcagttctaagctattatctgcctaatatgataacatgcattttcttctgtttttctggtaaactatgtattctgatttcaggaaggtgaaggacagcattcaataataaatgtttcttcaccccctgtaaagaggaaggcattttgtttgatgtgagatatgactctgaaaagagttagccttgggaacctgtaaatctgttggattctatcacagaatgcacattagtagtaaattatttaggatagatatatggagaatcctctatagttatctgtgtagatttggtgttcagtgtgattaatttttaacagagattcttgtgatacccctatgggaaggagaagtatcatagtttgttatggcagattgattgaactgtgtataatgtctgtagattttgggttctttttacctctgtcccttgtttgcatctcttgttcagtattcctctaggactcaaattcttcgtctgtgaatgaggaagttgaattaaaatataaagttatttatacatgttatttttgtatagctctgaataaattcattaagtgagtattgaatgttggttcctatttagtctgtagggtttaaacttatgttgtgatgggagagagaaacaggcttagggtgccatgaaagcagagacaggcaagtatatcttagaaggaaggcgagaggaaagggcattagggaaactttcacagaggcagtgtgacatctgaactggtcttgaagataaatgagtttgtcaagtaaacaagaaagagagttctagctcaggaagtagaatgtacagaggcagaaagaatgtattttacctttggaaaaacacaggccattcatgtgacgcttagcatgggattatggagtagtaagatattaggcattgaggtatatggcacccaaatcgtgaaagcttattatgtcatactaaataatataggctttaaattaaagacaatgactaaccatggaaatgttttctatttgggtatgacactgtaaaatttagttgaaatggatacagggatagcagttagaaaactggcagttcaggtgagacatgaatgggagtcttaattaaaataatggcaatgagatgatatgcagatttatataaaatggataggcttcatagggtctgtgggagccctggaaatgtatgtgagatttaacatgaatgtattttccttgggacatggttcatacatttcatctgatcatacaacagggctattagtgtaaatatatatatcacaggaaaaattgacaggatgacattctacaaactatgaagttagataactttaaattttattttattcactaatgactaatcttttttttcactttctgtagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcaggtaaaatcaggaaatcaaaatcagcttattaccctgcacttcttctgttttgatcacagtaaagaaaatgtaatataatcaaatttccccaaatttgaaatacatccaaccaaggaagaaaggaaaaatccattgttttaaataaactttgcagtaattgttttttgtcatctggcttttagaagttttgaaattctttaatacttaaatagcacatcagtctatattacatggttgtagacacgttgtaattttaagaattgctttccaatacaaattaaaatgactggtaaccattttagaaaatataattttttaagaagagtttgcaccgttcttgaaaataatttataaagtagtaacaaatgcctaatgaaatctatgttggagaatttatttttttctgtttaaaaccaagactaaaagccttcagagggaaatagaaattaactgtctcattttccctgtttttggaaggatctccaagcttttgatttgaaaagcttttcctccacatcagaaaaaaaatctgaaaacatctttattcatgattatctgagttcttgaccatatcttcataacagtagtcaatcagcatttattggcataaagaagaatactaaaaatataagagatagtcattggttttaaaaaacctgcagcacagttaggtagatgagatacacatttataaaaattggtaaaagaagacagtgtataattcgacgttagatgaatggagtatgtaaatgtgagggcattcaaaggaaagagaacattttgggctttgtaggttagggaaatagaataattagagtttcatgtccgaagactgaggaaaagagagagagttttggacatgatctgtaaaactctgcttctcaggttttgtcattttctcaggcaagcttgcaactgtgaaattggcttcttctttatcatctgtctcatcagttctgtccttgtaatgttttatgctgctctactcttttgatttccattcttcatttagtgaggaagaggataagtttaatatggcaggcagtggaatttccaaatagaaataactagcaaaacttagaggtgtgggcctggacagttagagatctggacacagataattaattcagaaccatccttctagaggagttagattcacaaatatgataaaatgtaggtatagaaaataaaatttaaaaataattttaaaaagaaaaaaatttaaaaaaatgtacttatagagtatgaaagaagaaggtcaagtgatggaggacttagtttttggaagggtgcacacacacaagaaaaaaactaatatattcatctgaaagcagcaagaggaggagggagttaatatttattaactgtgtaccgtgtactgtttgttttataacctgtttcatttaattctcaaaagaccattgcaacattacacagatggaaaagcagtcactcagggaacttaaatgatttatttaggagcatagagctagaaagtgttggagccagatttctaacacaggctaatctgttaaccaatataagctccatttttattattactgaactgggattataggataatacaaacatacatatgtatgtatgtacctagtgctgtgacactgcactaaaaaatggtagctattctttttagattaccaaaccaacatatgaaatgaatgctatgtgctgacactatcgagagggaaacattatctagttttttttttgtttgtttgttttgttttttttgagacaggagtttctgtcttgttgcccaggctggagtgcaatggtgtgatctcagctcactgcaccctccgcctcccaggttcaagtgattctcctgcctcagcttcctgagtagctgggattacaggtgcctgccaccatgcccagccaagtttttgtatttagtagagatggggtttcaccatgttagtcaagctggtctcgaactcctgaccaaaggtgacccacctgtcttagcctcccaaagtgctgagattacaggcatgcgccaccactcctggcccagaaatattatcttattcgctcttcacaaaaattctgaaaaagaagagaagccagagaaagagcgaaaggctaagtgaaaaactggaatagtgaagccttagaagtcagaggagaaagctattctaagaaaggaaaaaattgttgacagtatcagatgctaaagagaggtcatggtgattaaggaccacatttagggatcagaggcacattgtcttggagagtgcagtattggagataatgccagagtaggagaccctactatttgagagttaagagagtgatgtggagatagaaggaaagaacgctggatatgtttcttacacatgtctgattttttatctgtgcagtggggttaataaaacctaacccataatattactgtgtgattaagtatgataatattgaaggtaaatttggcaaatactatatacacatttaagttagtagtagtatatgtagacatgcccgcttgtaacatttgcagggtctgcagcaaatataaagaccaatatactatatgtacgtaagttaaatgaacaaattattgagtaaaatacattttgtcctccccccactacccaatgacaaataatcttcatatggacctggaagatgaggtttaaactaagaattctcagattcttcagagttacatgccggtatatgtccacatggggcaggcccaccaggcccattaggcccacctcgtctgagcctaagtcccattctcttcctaccctacaatctattctgtactttaagctggctttacacatacacttggacccaccagttctcacattcaagtgccatcctcaaaaagcaagaaccagggaatgggtctgcagaccttagaagccaagcctactgctgtttgttcaggaaattcctggttttagattacctggagtatattctacagccaggcatgggctcataacgtccatgctctttgctcccaaggtctcttatcccatggggaggggcatggctgctagaaggccagaggaatttctcctgaattttgaggtccaggataagggcttgtctggcttgcatctatctggatgtaggtcatttatttgagaagtttgacattgaaaagaaggtaaaatatagggctcattttacagatgaggaacctgaggcttagagaagttaagtaatttgtacatcattacatagctgtacattaatatgtactacatacatattacatcgttatgtaatatgtactacgtacgtagtacatcgttatgtaatatgtacgtagtacgtattaagcgtgaggacagtgaacccagacctggctgattctaaagcgtttccttttttttcttcagctgtctattgccttttatggcaaccactaactactaacctacttcttgcctcacaagcataagaaatggtccttccctaaccatttattagtttaattgaagatacaagagatgaacatatgagatactttttatggcgacatccgtttctcctggattaactgttgaactcttagggtgggaagaacttgttttatttatgtagtggaattatgtagtggacattggtggaaggaaggtggtatactcagcttgctacagacattaaacacctgggctgtttggccttggtggagggtgtcttgagggtgttcttccttttatatttctgtttcaactaccttaattattgagagcttgacataaaaaaattaatattgtttagtatgtttacatattaaaaagaagtagcataatgttgtgaaaagattgtagactttggaaccagatcatgtattcaaatcaaggcccactgagggaactttctgggataatgaaaatgttaattaaaaaagtagttaattttaattaagtaaaaattatttatatattaatggtgtacagcatggtagacacacacacatttgaaatgattacatcaatctatttaacatatgcgttacctcatttttttatgtgtggtgagaacacttaaaatctactctcttagcaattttcaagtataccatatattttactgtagtcattatgatgtatagtagatcacttgaagttgtttcttgtaactgaaattttgtgtcctttgaccagcatctcccaaggactcctagcctctgataaccactattctactctctatttctgtaagttaaatgttgtatatcttttttttttttttttgagacagggtcttgttctgttgcccaggctggagtgcggtgatgtgatcttggctcacttcaacctctgcccctcagattcaagcaattctcatgcctcagcctcccaagtagctgggaattagctgggactacaggcccctgccatcacgtccagctaatttttgtatttttagtagaggtggagtttcaccagtagagaggctggtcttgaactccttgcctcaagtgatccactagacttgacctcccagagtgttgggattacaggcatgagccaccatgcctggccagtgttatatgtcttaatagaagtttgggttatgttggcgaattcatttatcggaacttacccaagtgtacacttgtgcattttgctgtataactttaactttaaaaatacagaatatgaacagaaaacaaatactgaactcagatgtttagagatgaagtatactgctgtctgcaactttgaaatgaataaaaaataagatgaattgatgggtggatacctagatagatagctggtggagtaaatagagcaaaatgttatttagagaagctcagtattggctttatgggccttcactgaacagttttttttttaactgttctgtttgaaatttttattagtaaaatgttaaaaaaaaattcatgacccactgacttaactgctttgtgacccagtcttaagctttcttttctgtaaattgaagttagtaatacccgatttgcacattcacacgtttattctgaggattataagatacagctttacatttttaaggcctctgaagaaatggatcactgctggttatttagagtcatctgtttagccttgtagaaagaaaaactaaaatccatttgtgaaatttaatattttattactgtagccttgcagatacaacctttttaaaacaaaaaatgtattaccaactcttaaaattgaacttgcaattaaggttactataataaaacagtaatgtttcctcagtcttcaccccatagtctgaggtgtagtctctggacaaattttaaattctgtgtttgaatgtgtttttaaatgcgaaagtaatatatattctttgtaaagtggtcaagtaataaaaataatatatacagcaataatcagaggtatttcctacaacttcccaggtatagtaatgattagagctattcataaatattggcattctctctcctgggcacatgataggattctacttctctgcccacttgaagttaagtgtggccatgagacttgatttgggaagatgctttaaagaactggtgcattctctctgacagggaagtaactgttcattcctactctgtccatctgggtcactgacagtgacaagcatagccttcttaatgacccatacatgtagtatgagcaagaaattaacttttgcagttttaagtcatttggatttggagattgtgtagttactatcctataatctagtctttactaatatgcaaagtataacccttttaaacaaatttttgtaggcctttcagagcatagtatgttatttttattaattaaaagcttttcaaaagattcagtgtggacgtaaaatcagtatcaaaatagaatgaaaaaaaaaaacctgagcactggaagtggtttttttttttcttagagttttgccatttgcttaattaacttgttttcttaatcttatttaaacatttaaaaattgtatctttaatggtttattttcctgttatacctttatttgagttttataggccttaaactttttctgatacagttagatgcgattttctttgtatgagtagtccatccaaaacagcccctggaacaggctacctcagtctcaaaatgtcacctcttttgaaatgtctattaaactagaagacatgatggtgttaatctacagagctaattttcattaacaagctttctgcaagtgaatgtattcagtcttaacaagagaaaccaccactgccttcttgcttctttcttctttttaaatgaggatttaaaatgcttttgattagatttatattctaataaaatgatggatttaatgctttttatatataacttgtaaaagaaaaaagtcacttgcctaaacatcgaatttccactttaggaatctgctccctgccaaggtcagcatcctgtcataatatcttataaaatctctgtgcttctcagttcttgcagggatgcttagtgatatatttatagacattctataattatcccagaatgtttttaattcagctaaattaaaagaagtaaatatttcaggttatgtatttttgggttttatctgattttgttttaaaaataatgctttttgatggtaaaataatccatcatatatttgatggcaaaataatccataatatagaaggacatgaatagtagccactaactccctaggcctactacttaaaaaaagtattattaacaggtttttgggggacacatattttgagaaattttctgtacctatagaaatatattgtttagacatatacacacagagatggaatcatactttatatcatattactgacttgctttttccatttgatggatcatgggcatctctccttataacatataaatccctacctcattttttttttctattttttaagttgtggtaaaatatatataacatgctagggaggcatggtagcctgtgcttgtaatctcagctactcaggaggctgaggcaagagaatcgcttgaacccgggaggtggaggttgcagtgagccgagatcatgtgactacattccagcctgggcaacagagtgagactctgtctcctcccacacaaaaaaaaataatgaaatttaccatgagtgaaaatgaattaaccattttttaaatgtacagttccatagcattaagtgcattcacattattgtacaaccattatctccatccatgtctaatacttttttactttttccagctgaaactctgtgtttattaaatactagctctccatcctccccaccacacgccagcctctggtagccatcattctattttctgtctctgtgaatatactctaggaacctcatataagaaaatcatacagtattttccttttttgtctggtttattttacttagtataatgatttcaggatttgacattgtagctgtgtgtcaaaatttccttcctttttaaagcagaataatattccattagatatacataccacattttctttatccattcgtctatgggtggacatttaggttgtttctgctttttgacagttgcaaataatgctgctagcaacattagtgtgtgggtatcttttcgagtctcggctttcagttcttttgtatatatttccagaagtagaactgctagatcatagggtaattctgtgtttaaatttttgatgaactgatgtactgtcttccactatggctgtagtattttatactcacattagcaacgcacaggggtccagttgttttttcttgttgttgttgttgttgttttttgtttttttgtttgttttttgagatggagtctcgctgtgtcgcccaggcaggaatgcagtggcactatcttggctcactgcaagctctgcctcccgggttcacgccattctcctgcctcagcctccccagcagctggcactgcaggcacacgccaccacgcccagctaattttttgtatttttagtagagacggggtttcactgtgttagccaggatggtctcaatctctcgaccttgtgatccgcttgcctcggccttccaaagtgctaggattacaggcatgagtcaccgtgcccagccaggggtccagtttttctacatctttgccaatattttcttttttccttttttaaaacataatagtcaacctggtatcttactttgattttcgatttgtatttcctaaatgattaatgatgctgagcatcacttcatctgctttttggccatctgtatttcttttttggagaaatgtctattcaagtcctttgtctatttttgaattgggttttttgttgttgagttttaggagttctttatatatactggatataaatctcttatcagatacatggtttgcaaatattttctcccattctgtgggttgcctttttattcttttttttttttttttttttttttttttttgagatggagtcttgctctgtcacccaggctggagtgcagtggtgtgatctcggctcactgcaagctccacctcctgggttcatgccattctcctgcctcagcctcccgagtagctgggactacaggcgcctgccaccatgcccggctaattttttgtattttttagtagagacggggtttcaccgtgttagccaggatggtcttgatctcctgaccttgtgatccacccgcctcagcctcccaaagtactgggattacaggcgtgagccaccacgcctggccaggttgcctttttattcttttgatagtgtactagtttttaattttgataaagtccagtttatctatttttccatttgttgactgtacttttgttggcatattcaagaaatccttgccaaatccagtgtcaggaagctttcttcttattttcttctaagaattttagcctttaagtttatgtctttgatccatttgagtccatttttgtataaggtaagagtccaacttcgttcttttggatgtgaatatccagttctcccagcaccagttgttgaaaaggctgtccttttcccattgaatggcctcgacacccttatcaaaaatcaatttaccgtatatgctagggtttatttctggctgctgtatttatcacagtggtctgtgccttgtggctttttgcattatgccataattgggaaagattttttccactccaagttaaaaaatttcatttaaactatattttcttttaatagttttatgtttctttttacatatttgtgtctttgatatttctggagtttattttgatggaaggcatgaggtgatatccagctttatttatttttcaaagtgactaacagttgataaagagtttatcttttccctgctgatttgagatattgttatatcataaatttccattcttatttggatctctttctggcttctctatgctatactatataccattaatatcttttttaatactgaatgattttaatttgtattgcttagtaattcattttaataatttgtatggctagtcttgcgtatttatttttctcagttaattttataatttgtacaattcctcaaaatgttttatattacaattaaatatgaattcaggggaattgttaccatattgaatcttatccaagaaaggggtatatctttttattcattcaagtattatgtttgcccttcagaatattttacaacttcttattggaacaacacatttcttgttaaacttatatctaaatattttgtcttttttggttgctgttgtaattaggatatttaatatctaatttacatacaggacatcttcaacttgacttttcttgtttctagtaatttttaggtaattttctttggtttttcggctgtacgatcatccaaatagtaattctacatccttttcgttatttatttcttggtatgtgtcctcttttggaattgcatttgttgccactccgagaaccatgtaaactaacagttatggtactgaaggccttgacttttttttttttttttgagacggagtcttgctctgtcgcccaggctggagtgcaatggcactgtcttggctcactgcagcctccaccttctaggttcaagtgattctcctgccttagcctcccgagtagctggaattacaggcgcccgccaccatgcccagctaattttttaattttttagtagagacggggtttcaccatgttggtcaggctggtctcaaattcctcaggtggacctcaggtgatccacccatctcggcctcccaaagtgctgagatgacagatgtgagccactgtacccggctgccttggcctctttcttgactctaatggtaatgtatctagtttactcactggacaaggtatactgacatttgctgtgaagcatgtgtgtttgttatacgtagagtacacatgcttattttactaatggtttttcttgttttaatcaggaataataatttatgtggaaaatgccatttcatcagtgaatatgtttgttaattctatatttgtttattattcagcaatgagttcttaattttttttcatgagccttagagtatttttacacttgcttcataaacaggttttgcaagatttccttcctctgtgctctagcataacacagtataaatatcatctgaattctgtcacttgggtctgaaaggattttacctaagtaacttacttactagcctagtatgtttttggattgtagcactttagaaaattttcttaatttcttccatggcacttggtctcttggttgatatcagggagagatttcaaaacttgtattctctgagaggtgagagatgggatggttagatcttaaataaaattacatatactgatacttccctttctccaggtgatggtattattatatttggtattttattgttttaaattaatttttaaaagttaaactgtgaaacatgagacatgccaaaagcacataaagcagtttctcttaatctcattagacttcagtctatggagttttatgatcctgcctctatgtcagcatctttccctagaaatctatttgtttttatttgtttttaagaaacagatccagactaagtagttagcatttggctttaggcaacattcaataaagttaactaactctgaactaaaacatatatattcttttctgttgacgtcatatttaaagtacctagccttttcctccattcctgaaaggagcttggttagggaggactttagtcaaaggaacagatgatgcacctcaaatacttactgatataaaaaataactttcagttttatcactctgatcagaaattcatttcctgaccaaaagtcacactttatacagctgtctgagtttcctgtgcccttgtcaaagggcttgcttttgaaatatatttaagaaacagcagttgctgaaacattttaggggctgggggacttcttcatgaaatggaagcaagactgaagatttgactgtttttgcctcttagattgcattctaggggtctaaattattttttatggagctggcccctgactggctgttgagatcacctttactttttctctcagccatcatctaattatgagacagaggattgtagaatcctagagttgaatagttcacaccaaattagtcatgttcctggtttagggagtaatttctttggttgctaaaggaatatactcagttatattaatgaaagattttaacccataactaaaatatttaacattttattcattagtttcaaataccatctctaaaattaccaaagtcaaaattctacttattaattttaatacgttatgtgttcatttgtttcaaaagtagaaagtatacagcgaaaggcctttcccatacccccgttaccctgatactcagttttcttccctttacgagaaacatttagctggaaacaaaattaacctgtttttcttcattgctttctcatgcctttgcccctaagcacactctaggtaaaattgtgaaataggttgtatttatttggaataacactcttactctggtcccctgacctgtgttggttttgtacattgacttatacattggttctcaacctgttatatcttgtatcaattttctatgaaaaattcctgtgataatattaaacagaatttactgagaaagacatttttacgttagagacattatgccttaacagttaagatcgcccgggcgcggtggcttacgcctgtaatcccagcactttgggagaccgaggtgggcagatcatgaggtcaggagatcaagatcatcctggctaacatggtgaaaccccgtctctactaaaaatacaaaaaattagccgggtgtggtggtgggcgcctgtagtcccaactactcgggaggctgaggcaggagaatggcgtgaacccgggaggtggagcttgcagcgagccgagatcgcaccactgcactccagcctggacgacagagcgagactccatctcaaaaacaaacaaaaaaaaccaattaagatcatagagttatagtttaaaattaggtcatagtttacggtatggtatgagaaagcagtatgcctcttaaggtatactgttttgtataaatgaatgaataaatgaatgattgatatgggagataccatattgttaggaaccagtataaactaagggaaaacttttccatgctattggaattctaacagcttttgggggacaactattattgtcaacatagcctattgcaatgaggattatatgaaacaatccatgttaagcttctagcacagtatctatgacataacagacactgatacttattagttgcctttgattagaatcaatagtattttactgttaccgggtttaaatataataatatggaattaagtggacaggaaaagtctttattactagtatcaactattgattatacaattatgaacattaggtctggactggtaggaaatggcatagaaatgacacaagtgaccccagagcatgtgagggctgtgaaattcaataaacaatttctggtaggtcaggattcattcagtcagaggtagttattgtgtgtttgctgtcttacaaataagaaatggtacttcaaatctataggttcatgtgcaggagagcgtatttacattcttaggaaagctactccctcctccattacttagttatcctattggtgatattcatgccatcatcttagcactatttttatgacttcagtgggtgttttttagaatggtgtgaaaaatatttttggccatatgtagtaatcacctgtgttgctgattttctgtcagatgtaagagattttaaaacaataacatgttcaaagctagcaagaaaaatgagtgggtatatggtcaacatgacaccttgagtgcagattccgtatcttattgatttcaattttttagtctaacactggttttcaaactttagaatccatcagaataatctgaaaaggttgcttaaaaaataagaagtatatttctgggccttatctaagagttccagatctagtagtctgaggttgagcctgagaatttgcttttctaacatgtgatgatgctgctgctcatttggggactgcactttgaaactggtctaacataatgagcacaaaacttagcatagagttggagcttgataaaaaatttgaatatgtaagtgctgctattgctgaattcctaaagcttaaaaaaaaaccttccgactttacataaaataaaaatgcagtcttaacttccacagtgttttgtttgagctgaattctgcctttttctacactctttgctaatcagagcagctatttactatatctggttaccactcttcccagaaaggcaaaggataattacactagaaccacaatcttttgtgctgctttgtaatacttcatcaggatagacttttcaaaataatatttaaagaagttttaaaagaagttaaaaattgttttattagtcaaaaacaaatttttgtaaacaaaaacaaatatttgtaaataatggtttgtcattacctattctaaacttttttataatttaagattagtctgtggtcataattaattcttaatataggtatcattgatttttcagctaattacatctcatttcttgctaggtttatcattgctataagtactataaaataattagcagtcagtactcatatttctataattgatttataaactacaataaattttaagaccagtgatgaaccacataaaatagattttttaatatttaaataagattaaagaattttgttatgtttttgttgatggattttttttaagtggctttagacttttgcacattgacaaagcatgttttttgctaggagttagtttgagctggtttgaagttgataaaactaaaaagcatattggccctttctagttagtgaataaagatatacataacaaaagcacccagtatttaagctttttggttgatctagccaaaaataatttttctaatggtattcattttgaagcctctttagtcctgtgcagtgggattattccctttgtattttacttagagaaaaagtggttctcacacaggttggagctgggaggatggccctagaggttggaaagaaatttcatagtctggactttggagacttccagggagtgagaatagaaaaggaccccttctacctataggtatcctttttacatagaggctttttttttccaactaccttttttgttaatagtcttacagataggttttagttctgcattgttcaagtgtacagaagtttcatttcttttaaatgatggtatgatattacagtttttcctaaatttatttaactgtggaaccctttttgtctactccttttaacaccaaaggcatggttatatgtagcactatttaaaaaattctagtctagattaatggacagaataacagaccagttggaaggggctgcttgctgatatgaaaggaaagaacttttgctactttgtgttattttcctgattgaaatggtaaaacatttctcaaatacacaggtttaataaattggattcaaattagtcacttctgtgacttcttaatcatcagctttaaatagatttgattttggtagccatcttttggttttgttttggctaaaataactcattaaaaatcagtgatcagtgtatagaacactgccctccaattgaactttctttagtattggaaatgttctatatttgtgttgtcctatatgacagccggtagccacatgtggttattgagcttttaaaatgtgctaagtgtgactaaggaagtttagttttattaggtcctcattaatttaaatctaaataggcacatgtggctagtagctgttgtattggacaattcaatctatagaatatatttgtagatgagaatttttttatactgtttattttaaattgatggaattaaaactactctttgggggatatttttggaaagttaatactatgatgaccttaaattatatgcattctatagttacatgattgagagaactctttcagtcgtttttcttttttttaaactacagtcactgtcacttcatgagggggatatgttttgagaaatgcatcgttaggcattcatcgctgtgcgaacatcatagagtgtacttacacaaacctagatggtgtagcctactacacactgaggctatgtggcatagcccgttgctcttaggctacaaaactgtacagcatgttaccgtaatgcagactgtaggcaactgtaacgtagtgatatttgtatatataaacatagaaaaggcacagtaaaaatataatacataaaggtagaaaatgatacacctgtatagggcatgtaccatggaatggagtttgcaggactggaacctgctccaattgggtcagtgagcggtgagtgaatgtgaaggcttagggtattaccgtaaactactgtagactttctaagcactgcacatttaggttacactaagtttataacaaatacttttctttcttcagtaatgttaaccttagcttaccataacatttttacttcataaacttaattttgtttagctttttgagcctttcataataacacttagcttaaaacacaaacatattttacaaccataacaaactattcttattctgtaagcttttatttatttatttgtttatttatttcctttttagacttttttttaaagctaagacaaacatacacattagcctaggcccacacaagatcaggatcatcaagacatcactaggtaataggaatttttcagcttcattataattttatgggaccactgttaggtataccatccatcattgaccaaaacattgttatgcagcacataactatacatatactactaacttgatttcttttgtaggtaattcttttgtgtaaataacacactctgaaataactgaataagttttcatattcatttttaagaaaaggataataggaagaaagaagataatctgtgagataagagaactcagatttagttccttttgctgttggcgtgcttgccagtgttgaagcagttgcagaatttttgtggctattaatttatctgtaagttggagatacagtatatgtaaatgtcctttgaaaaagggctgtacaaaatgaatgtaattcatattataaatgttgattttgaataattgtggaaaatgctaaaaatttgactcattttctgtgaatatactttgagttataaagattatgattcttaatcttttcattttgataagagtaatgctcagttgctagacaggtaaaaccattaagttatataaattatcaaaataaaagtgactaaacaattgaataattttggaataaattcattattaaggatacaatgatttggagggttgaattattttcagagtacgtcatcttatctaggacggaacataggaaattctaataagtaatagttttttataagcaacttatttaatatattgatacctcttatccgtggtcttgctgattgaataaagtattttactctgtcaattgacttaaaaacttctttttactagtgaactgctcaagcagtttatttttgtgtttattcagctagcattcagttgttaacggtttttttgaatatcattgcttttaagacgtggtgattattttaaaagttttccacaagcattttgaactgtaaaatagaactgatgacttcttcataagaacttacatattatgtagtcacaagtatggccttaatataaatgatacctttttcagcatgtattgaaaaataatttttaaagctgtatatagttactgtgacaatcattgccctttaagtagtggttttgaccctttctgatttacattacgcaagtcttctcatgtattaaagatgatattttaatattgtttaattattattttttttttgagacagagtttcactctcgtcgcccaggctggagtgcaatgacacaatcttggctcactgcagcctctgcctcccgggttcaagtgattctcctgtctcagcctcctgagtagctgagattacaggtgctcgccaccaggcccagctaattttttagaggcggggtttcaccatgttggtcaggctggtctcggactcctgacctcaggtgatccacccgccttggcctcccaaagtgctgggattacaggtgtgagccaccatgctcagcctattgtttaattttttaatacaactattaaatggtcttaaccactgtatggcattatttcggatttagtgatttgtgttacatttgaggatagtatctattaatggctaaataactgaaaatgatattttagataaaaatgattctgttttctgacatatggttcaggttttttagaagatgtattactttagtttatattctgtttatttagcttatattttactgtttttaatctttttcacttttataataactttatgtgttttatataaagatgcctgatatttttcaaaaaagatactaatacttactcttccccaagcacagaaaaagtagtacaatcagccctctagctaaatatttgaaatgtaggtcattcttaatactattgcttttgagatacttttgttcattttacctctattgaatttagtggaaataccatttcatatttagtttggctattctctttaaaaacaccaatacacatatctttactattccctttgaattttataattaagttatttatgttattgatgtgaagatatcaaatttttaagtaaggtgactcagagacatctttgagcatatataattcagaatatggcagaatattttaaacatttcacggggtcacaaaactcttagcgtttaaaggattttagtatagctctctaactggtaagtgctaagaattttaaatatgtttcagttgcttgagattaggaagtagagataaaatttcttattttatttatatatatattttttaaagacacctagctgttgggcagaagagggtgcagaaaagaggtcacatcagcgttctgcgtcatgggggagtgctgatcaactaaaagaggtaagttatttctgttttccgtctgtaacctgttttggtcctagtagattaccttagtatttcctgaatgtaatgacacttttaaaatttatcctaaccttacctctttcagtaaggttaggacaaattctagggtaaggttagaataaattctaggcaggtttttgtaaggttaggacagattctagtttggtaggctgcattctacattttggtgaacaagtctaaatttaccctatttgtgtattttgcgtcttttataaatatttgttatgcactcagtcagctttaacctttccagagtgaagtctaattttatgtaatactctctatcttgttcattttagttatcttttgttctctcttcagcttgcttgtttttaagttgtagcaaccagagctataggttatagctttgtacaatggtaggatagtgttttctgtttctaatagcttttttatttgagacggagtctcgctctgttgcccaggctggaatgcggtggcgcaatcttggcttactgcaagctccacctcccaggttcacgccattctcctgcctcagcctcccgagtagctgggagtacaggcacccaccaccacacctggctaattttttgtatttttagtagatacacggtttcactgtgttagccaggatggtctcaatctcctgacctcgtgatccgcccgccttggcctcccaaagtgctggaattacaggcgtgatctaatagctttttaatgatatccagcatattgttgccctttggaacccaacagtaatccatgcttctcagaaacttagtttctatgacccgtttccttatttattatgaataacctgaggtgtcatatctttatgtatattttggattatttttcctgatacttttatccatctaaattcttttctatttctttttacaaattacagaaactttagaattgaaaggtcatccagccaatctcctaaataaatactccttaaaaagatggtcatctaatctctgttattcttttttttttttttttttttttttttttgaggtggaatctcactctgtcacccaggctggaggacagtggcacagtcttggctcactgcagcttccacctcccaggttcaagcgattctcctgcctcagccacccgagtagctgggattacagatatgtgccaccatgtccagctaatttttgtatttttagtagagatggggttttgccatattggccaggctagtctcgaactcctgaccttaagcgatctgcccacctcggcctcccaaagtgctgagattacaggcatgaaccaccacaccaggccatgatcattcttagtgatggaaactcactactttacaaaaagagccagtttaattggtttaattgtttcaagtttttaaatctgttctcttatgtattgaacttagaattagataacttagttttgactttgccctctggatcaatattgagtaagtctaagtcttttaaaggctagcagtaagtcatttttttcctccagagtaaacatctacatttctctcaaattttttttcatataccagtttccaggcctctttgtataatttttatgtactataggttatcagtgtccctcatatactgtggtgtctggactgcatagatatagtttattagcatgattttacttatgattgtattacattttagcagcttctttatagtatggatgtagagacctactcagctccttctgcctaccatacatgtatgcaaaaaaaatcagttttctccagcaacaacaaaaaataaatgaagctaagtctaatatctctggcttactataactacatgtctatgtatagcatatgaataacaaaaaagtgaacttgtatttttatctcagagttgaatacagtcttagagttatcaacgagatttaggctgaaaggaagtaacgccagatattaatttgaatccgtaggaagaattgaagagtgctgggaatagtaaatatgtggataaatatgaaagagtttttaatactgttgtgttggatttataatttaactataactggatttcagtaatatatgacatacactcttaaaaaggaatgactgattcagtgagaacatttgattgttttccacagaaggcaaccattaaagctggacaaaactgtcaaaacaactgtttgagtactttaccaaacaaactgagaagctttattcatgaaaactaatgaacatagggtaagaatagcacaaattcgtgatctggtgctactccttttctccttttccttgtccctagctctgtcgcatagcatttcagtcaggatgaaaaccagcagctttgcttccacttttgcagagaaatcacttgctatggagaattgtaggttaaaatagtgatctttgtggcaagtaaacagagagggccaacagctttattagtctaagactgtagtccaatttggggccagcagtaggctcatgaactagttgagtttaatagaaagttttgagaggtaagacagtagtgggagtttgataaattccccacatatcccaggttgagtggaggctgtggacatgcacatcagagaacagagtgggctcaggccaccgatgtgttcttggccaggagagcctaggaataggtgcagatgaaattcaagtgggctactggaaataaaaccagggaggcagagcttgcagtgagccaagatcgcgccactgcactgcagcctgggtgacagagcgagactccatcccaaaaaaaataaaaaataataaaagaattttcacaaagagttagtcattctaaaaaagaaggaaacaaaattctagagttaaaaagggcaataactaaatataaaaatgttagatgggtttgacaacagatttgcgatggcagaagaatcaatgaattagaagataagtcaatagaatttatatactctgaagaacagagaggaaaaaaaaattaaagttgaaaaagcctcataggagaaaagagacagagcagagaaaaagaatcaaagaaatactaacagagaactttccagatttgatgaaaaacaatctacagattcatgaagcttaactaaccacaactaggaaaacacaaagagagccataaaaagaagaaaatgggtcatcacatgtaggggaccactaataactttaacagctgactttaaaatcagaagcgatggggaccataaggcctgatgcattcaaagtgctgaaagaaaaaaaaccaaaaaactgtcaaccaggtattctatatccagcaaaactagtcttccaaagtgaaggtgaaaaaatggcattcccagataaaacttgagagaatttctccctgtcagactgtcttataagaaatattaaagcaaatcttcaggctgaaaggaagtaacactgtatattagtttgtatccataggaagaattgaagaatgctgggaatagtaaatatgtggtaaatataaaggagttttcaacattgtttggttggatttatagcaggtacatgaaatatatatatgataatagcacaaaggagttaggaaaaggacataaattatagtttctatttgactgatattaagtattattgtgatatagattgtgataaattaagacacattataatccctagagcagttgctaagttactaagaagataactccaaaaatgtaaaagaaaaaaaacaaacaccagaggaattaaaatggcatactaaaaaatatcacaaagcaggaaaggaagaataggtaaacaaaaaaagttgtgacacaaaaatagaagcctacagcattcatccctcccacccccaatggagtactaaattttaacaactatctgcacagggaaaaacaccattcacaagaacccaaaatcaagtgagcaaccacagtaccgagttttaagttcatagcaccaaaagaggcattgagtaggccaggagagagagtcttgaattgctgatgttacccctccattccctggcagcagttgtgcggagcacagaatctgtgcactttggggaagaagagcacagcgactggggaactttacactgaactcagtactgccatatcacagtgaagaataaagccatgctggcctcagccagtgcctgtgcatggagggaacgtttggaccaaccttagccagaggagaatcaaccattccagcagtcagaactttttattggcaagctttaaagagagagacagacaagacagacagacaccccctgtttgctgaggagaaagtaagggaaaagaataacagtctttgtctggtaatcaagagaattctcccagatctttttcaagacctccaagatggtaggtataactctacaaatctgaaaaaaacacagtgttattgggcttggggcccaagtctctttgaatacctggaaagccttcccaagaaggacaggcacaaacaagcccagactgtgaagactacaataaatacctaactcttcaatgcccagacactgaggaacatctacgataattagcaccatccaggaaaacatgacctcaccaaatgaaccaggcaccagggactaatcctagagaaacagagatatataacctttcagacaaagaattcaaagtagctatgttgaggaaactcacgcctgtaatcccagcaccttgggaagccaaggcgggcagatcccttgaggtcaggagtttgagaccagcctggccaacatggtgaaactctgtctctactaaaaatacaaaaattagctggttgtcgtggcacacacctgtagtcccagctactggggaggctgaggcgcaagaatcgcttgagcctgggaggtggaggttgcagtgagccaagatcgcaccactgtactcctgcctgggtaacagagtgaaaccctatctcaaaaataaaaggaagaaggcataccaccacaaaaaaatcaccaaaaggaagacaagaagggtagaaagaaggaaggaagagaaaaccagaaaacaaataataaaatggcaggagtaagttcctacttatccataataaaatggaatgtaaatggactaaactctccaaacaaaagacaacgagtggctgaatggatgaaaaaaaaaaaagagacccaatgatctattgcctacaagaaacacacttcacctataaagataaacatagacttaaactaaaaggatggaaagatattccatgccagtggaaaccaaaaaagagcaggagttgctatgcttatgtcaggcaaaatagatttggagacaaaaactgtaagaaaagacagggtcattgtataatgataaaagggtcaattcaacaagaggatgtaatgattgtaagtatatatgtactggagcacccaggtgtataaagcaaatattattagagctaaagaggaagatagaccccaatacaataatagctggagacttcaacaccctactttcagtattagacagatctcctagacagaaaatcagcaaggaaacattgggcttaatctgcactgtagaacaaatggacctaatagatatttacagaacatttcatccaacagcctcagaatacaaattttcctcctcagcacatggatcattctcaaagacagaccacatattaggtcacaaaacatgtcttaaaacattcagaaaaattgaaataatatcaggaatcctctctgaccacagtggaataaaactacaaatcaataacaaggggaattttggaaaccatacaagcacatggaagttaaacaatatgctcctaaatgaccaatgagtcaatgaagaaatgaagaaggaaattgaaaaacttcttgaaacaaatgataatggaagcacaacataccaaaatctatgggatacagcaaaagcagcactaagagggaaatttatagctgtaagtgcctacatcaaaaaagaagaaaaacttcaaataaataacctaacaatgcatcttaaaaagcagcaaaagcaagagcaaaccaaactgaaaattagtataagaaaagaaataataaagatcagagctgaaataaaatggatttgaaatgaagacaacactacaaaagatgactgaaattaaaagttagttttttgaaaagataaaattgacaaacctgtagccaaggtaaccaagaaaaaaaaagaatacccaaataaattagaggtgaaaaagaagactttacagccgataccacagaaattcaaaagatcattagtggctactttgaacaactatatgccaataaattggaatatctataagaaatgaataaattctcagatacatataacctaccaagacagaatcatgaagaaatccaaagcccaaatgggccaataacaagtagagattgaacccatactaaaaagtcttccagtaaagaaaagcctgggacccaatggcttcaccgctgaattctaccaaacatttaaagaacacctagtaccaatcctactaaagcttttccaaaaaatggagggagatggaatactttcaaactcattctacaagactagtattaccctgctaccaaaaccagacaaagacacatcagaaaagtaaaaacaatagggcaatttatctgatgaatatggatgcaaaaatcctcaacaaaataactagcaaaccaaattcagcaatactttaaaaagatcattcatcctgtccaagtgggatttatcccagggatgcaaagatggttcaacaaactcaaatcaatgtgatgcatcatatcaacaaaatgaagaaaagccatatgatcatttcaattgatgctgaaaaaacatttgataaagttcagcatctcttcatgtcaaaaaccctcgaaaaaactggctgtagaaggaatatacctcaacataataaaagctatatatcccacagctattattgtgctgaatagggaaaaagaaaagaaggatgttcactttcaccagtgttattcaacatagtactggaagtcttagctggagtaatcataaaagagaaagaaataaagggtatttgaattggaaaggaagaagtcaaattatccttgtttgtagatgatataatcttatatctggaaaaacccagactccatcaaaaagctattaaaactgataaattcagttaagttgcagaacacaaagtcaacatacaaaaatcagtagtgtttctatattctaaaagtgaacaatagaaaaagaaataaaaagtcatcccatttacaatagacacaaataaaattaaataccttggaattattcaaagaagtgaaagatctctacaatgaaaagtatgaaacactgatgaaagaaattgaagaggacaccaaaaaatggaaggatacttcatgttcattaatttgaagaatcaatattgttaaaatgtctattctacccaaagcaatcttagattcaatgcaattcctatcaaaataccaatgaaattcttcacagaaatgaaaaaaactaaaatttgtatggaatgacaaaagacccagaatagccaaagctgtcctaagcgaaaagaacaaaaccggaggaatgacatgacctgactttaaattctactgaagagctatagtaaccaaaacagcatggcactggcataaaaacagacccgtagaccaatggaacagaacagagaatccagaaacaaattcacacacctaaaatgagctcatttttgacaaaggtgctaagaacacacattgggaaaaagacttcaatccatggtgctggggaaactggatatgcctatgcagagaaagaaacctgactcctttttttcaccttatacaaaaataaaatcaagatggattaaagacttaaatctgagacctcaaactatgaaactactacaagaaaccattggggaaattctccaggacattggtcagggcaaacatttcttgactaataccacacaagcacaggccatcaaagcaaaaatggaaaaatgggatgacatcaagttagaaagcttctgcacagcaaacaatcaacagtgtgaagagacatcccacagaatgggagaaaatatttgcaaactacccacctaacaagggattaacaaacagaatatataaggagctcaaagaactccatattaataaacctaatagtatgatttttaaaatgggcaaaatatttgattagacatttctcaaaagaagacatagacgtggaaaacaggcatacgaaaaggtgctcagcatcattgattattagagaaatgcagatcaaaactgcaatgaggtatcatctcaccccagttaagatgacttttatccaaaagtcaggcaataacagatgctattgagaatgtggagaaatgggaaccctctgtacactgttgatggggatgtaaattagtacaaccactatggagaacagtttggaggtttctttaaaatcttgaaaatagagctaccatatgatccagcaatcctactgctgggtatatacccaaaggaaagaaaatcaggatattgaagagatatctgcactcctatgtttgttgcagcagtgttcacaatagccaagatttggaagcagcctaagtgtccgtcaacagatgaatggataaagaaaatgtggtacttatagacaaagcagtactattcagccacgaaaagaatgagatcctatcataatgacgtccagttccatccaacaacatggatgtcattacgttaagtgaaataagccaggcacagaaagacaaacattgcatgttctcagtcatttgtgggatataaaaatcaaaacaatagaactcgtggaactagaggatagaaggatggttacttacaggctggaaagtgttgggtggggagccatggggaggtgggaatggttaatgggggaaaaagttggaaagaatgagtaagacctagtatttgatagtacaacagtgggactatagtcagtaataattcattattcgtttaaaagtactaaaagggtataattgggttgttagtaacataaagaataaatgctctaggggatagatacccagtttactctcatgtgattattatgcattgcatgcctgtgccaaaatatctcatgtgtcccataaatacatatacctactatgtacccacaataattaaaaaatttttttaaataaatatttttaaaaaaacaaacagactgaaagcaaaaagatgggaaaagataaaacagtaacaataagagagctggaatagatatgttaatatcaggcaatgtagactttaatacaataaagataactgaagagaaataggaaagtttcataataataaaaaggttagtgcaaaaggaacttaaaacaatcataaggatatatgcatctaacatctgcatttcaaaaatacattaagcaaaaaatgtaaaatgagaaattataattatatgacagtaattagagatttcagcatcccattattgagaaaccaattagagaatcagcaaggtgatagaagactttaacaatattatcaatcaacttgacctaactgacatgcatagatggaaaacacccagtcactgcagaatagcagaaagaaatcttagaaaatcccaaatatttgacaattaaggaacacttttctaataacccaaggatattttttaatattttcaattgagtgaaaatgaaaactcaacttagaatttatgtatgcagctaaagcagtgcttcaaggaaaatttatacttttaaatccacatatcagaaacagagaaaaacttctcattaattacataagtttccatcttaagaaactggaaaaagaaaagcaaatcagagcaaaaacaagcaaaggaatgagaaaataaagaataagcaaaaccaatgaaacagaaaagtactagagaaaaatcagtgtaactaaaagtttgcagagatcactaaagttgaaaaacatttagctacactgactagaaaaaaagcagacccaaattaccaacttcagaagtgaaagaggtgacattactaccaactgtacaaacttaaaaaatattatgaaacaatattatgaacaactttatgccatcaacgtagaaaactgagatgaaatggacaaattcctaaaagacacaaattagtagaaaggtataaagtgccaaagctgacttaggaacaaatagaaaatgtgaagaaacttataaaaagtaaagaagctgaataaataatttaaattcttcccacagagactatcccggggtcacatttgatgaattcgatcaaatatttaaggaaaaagtaatgttaattatttacaaactcttcttctaaaaaatagaaaaggagggaacactctccaatttattttttcaggtcataagtactgtcctttcaaagtcaggcaaagacatctcaagaaaataaaacaagatgaatatccatcttgaatataaatataaaattattaataaaatatgagcaaaccaaatccagcaataaataagagggattatataccctgagtaagtgggatttgtccaaggaatgcaatgatggtttaacatcagaaaattagttaatggcatgaattatattaatagaataaaggacataaattacataatcacctaagtagagtcagatgaaacatttgacaatattcaacagtcattcatgattaaaaaaaaaaatcaacaaactgggaacagaagaaaactttcttcatctgataaactgcatttatgaaaaacctacagattactcatattaaatgataaaacagaatgcttttctcctaaggaacaaggcaaggatgtccactgtcatcttgtcaccacttttattcattactgtacaggagattctagccagtgcagtcaggcaagaaaacaaaaagacattcggattgtaaaggaagcagtgcaacttcctttattcaccgaagacataatcctatatgtaaaaactcctatggaatgtacaaatatattattataactaataagtttaccaaggttacatgatatgagatcaacatacagagatcaattatatttctgggtagtagctatgaataattaaaaaataagaaaacaatttattcacagttgcatcaaaaaagattaaagtgtttagaaataatttaagagaccactccagaatttatacactgaaaatattactggatgaaatttataaggatttaaataatggaaattaaataaatggaaagacttaacttgttcatggattggaagaatcaatagtaagatggtaattctcaaattgatatatagattcaatgcaatttctatgaaaataccagggcttttgttttttggtttgttttttactaggaattgacaagctaatcctaaagtgtgtatggaaatacaaaggatctagaaaagtccgaataatcttgaaaacgaaaaatttggtagaattatattacactatttcaatgtttcctgtgaacctacattaatatagttagtatagtattggcacacataaagatttataggtaaatggaacaaaatttgtgaatctagaaataaacccttatatttgtggtcagtttattttagccaaagaagccaacacaatttaattgaaaaagacagtcttttcaacaattggtgctataataattgaatatttgtatgtacaaaatacccttaagtcctagctctcaccatagagaaaaatcagctttcagtgaatcataatcctaaatgtaacctctaaaattctaaaacttctagaatatattaattagacattcttagatacaatctcaagagtaaaagccctaaaagaaaaaaagataattggatcttcaataaaattaacacttatacttcaaaatacaccactaagagaataaaaagacaagccacagacttgaagaaatattagcaaatcatgtatttgataaagggcttctatgtagaatatataaagaattcttacaaatcaataagaagataaataatctactttaaaaattggtaagacacttgaagtatttcatcagagaagaggatggctgacaagagacatcagacaccacttctcagaaagaagaaccatagttacaggtgaataatcataacttgaatagaatatcaaggggagagtgctggagtccagtggagaactcacaggaagaagctaggacacagaaaaagaaggaaaaagaggctggcagagattagctaggaagcccaagggacttgctattttgttgaaaggataggtggaagtgttttgggctccccttcccctcgcagcaaactgctggtattcaagagttcctctgcccttatgaacccaaacactggtgtgggtggtgatttggggacttactgagggcattacaccagactaccagctcatgctgggttgcttaccctccctgtggacccgagctgtgatggcaggcccaatatatttgggacatgcctgttgaaggactgagtcctgcccaaggaacctcaggtcctgcccttgtgtctcgacatcactggatcccatacagacattccctggcactcactcagattgtagcagccacatagtgctggctggacccaggggagctgcaggattctcagtggtctctccctcagggagtgctgctcctaagggaagggaaagtgcagtgcacaaaagtgtgtgctgtcctttgcccgagaactccccacttggctgagagtgactgctacttccagtgcagatgtgggcactgtgcttggctcttcaagggaggaacagggttccatcccagcagccaggtggcctcagtgcttaagcacagatgtggagaagggatatctctcctctgcagcttgtccactgctgcgaacacagccatggctgctcctatgggaggttggtacaggcgtatcacaagacagccattctagggcaattaggtatggctgtgtccgcactgataatctaaaaaataagaatttattcaagctgggcccaggcttgtgtgaaaggtggggcacctcccccttatatgtggagttgttatgttcctgcaacagaaatcaggagaaccacaaagatgtatgttttaggctgaagacaggttctacaccaaagatagtttggcagtaagctgtgagatgggcagatttcacagctcttggctacactgcagtgtggatatagacagtgttgtctgtcccgtcagagtgtcccaagtgcctaacaggggtgtgacagggaagcaaatcatgttcctgcctgcctaggtatggagctgaggcagttccctcccccacatagagagcttgtcacattctaccaggagctcctctcaccacccgcttcagggctagtgattgtgtccaccattggagtattgaagagcaggcttggtggtttagctctacccagctttgtccccatcaggggctgagcagagatctcaggctactgtgcattacacagtctggccaatttgaagcaacagagagatccttccagtaaacaaagatcaagcatatacccatctgcttctgctgtagctggcctttacacataagcaccacctattggtctgtaggttaaattgcacaacccaatacaaaatctgctaacacaagtgcacagttctggggaatgagataaacttcctgagacctccaccatcctggcccaagaggcagtgagtttgttcacatgcccagtacatcacttctacaactagtatttgagaagccatcacacaaagcatgtctgaaaccaagtaactcatagaaactttgctttcagtggaaagcacccagaataaaagccaaaaggccatacacaacatatattatagtctcatccttaagatggaaaaaaaatcatgtccaaacaaaagtaaattcaaaaataagaagagagagtttatccagatgagaaggaactagagagacaattctggaagtatgaaaaaacagagtattacaacacctccaaaggatcatactaactctccagcaatagatcctaatgaaaatgaaatcttttaaataccagataaagaattcagaatattgatactaaagttcaatgatacccaagagaaagttcaaaaacaatacaaagaaatcagaaaaacaatttaagatataaatgaacagtttattaggagatacttttttaaatccaccagaacttttagaaatgaaaaattcattgaatgaattacaaaatagagttgaaagttttaacaagtagactaaaccaatgagaagaaagaatgtcagagcatgaagacaggtcctgcaagttaatccagctagaaaaagaaaacagaattttgaaaaataaagcctttgagaagtatgagattatgtaaaacctccaaaccttgtcatagggagaaggtttcttcctgagggagaagaaaaagaaaaaagtttggaaaacctatgtgaggagataattgaggaataattctctcatcttactagagatttagatgttgaaatagaagaggctcaaggaaatccaaaagatatattgcaagatgactcgaccaaaatagtcttcagacaaagtcagtgtgaaggaaaggaatcctaaaatcagcaagagaaaagcatctaatctcctgtaaaggaaaccccaacagacttacagcagaatgctcagcagaaactctataagccagaagaggttgggtgcctaatttcagacttcttaaaagaaaaagaaaactgtcagccacgaattttgtatgctggtaaactcagctcggtaagtgaaggggaaatagtatttcccagacacgtgaatgccaaaggaattcatcaccactagactggtcctacaagaaatgctcaagggatttctaaacatggaaatgaaaggttgacactcaccatcataaaaacacatgaaaggataaaactcacagatcttataaaacagttccacaactgagactacaaagcaactaggtaagttaacattatgataggaacaaaacctcacataccaatattaattctgaacataaatgggttaaatgctccacttaaaagatacagcttggcagaattgattaaaaagcaggatctaatcatatcttgcttacaagaaatccacctaactgctaaagacacgtaaagactcaaggtaaaggggtggaaaaagacattccttgcaaatggaaagaaaacgtgagcaggagtagtcatacttacatcagataaaacagattttaaatcaacagggaaaaaaagataaggtcattatataatgataaagggatcaattcaacaagaagatatagcaattctaaatatatatgcacccaatactaggccacccagattcataaagcagatactgctatacttaagaaaacagatagtaatacaataatagtggataggggacttcagccccccactgacagcactaaatgggtcatcaagacagaaagtcagcaaagaaacactggacttaaattggactctagatcaaatggacctggtagaaatttacagaatattcacagcagccatagaatatacattcttctcattagtgcatggaacagaacaccaatgaagtcactgatgacaaaagcaaatggacaaacattctaagctcttggattgtaagagcttaaattaatatggttaaaattgccacctacatattcagtataattcctatcaaaataccaaggtcatttttcatggaattagaaaaaataatctgaaaattcatattgaaaaaagcccaaatggtgaaagcagtcttaagcaaaaaaagaagaaaagtttattgcatcacattacctgccttcaaattatactacaaggctattgtacccaaaacagaatgctactggtaggatagcaaaaacataaatcagtggaacaaaatagagaacccagaaataaagtcaactgatttttgacaaagttgacaaaacatatgctggggaaagtacactcttttgaataaatggtcctgggaaaattgtgtagccatatgtagaagaatgaaactgaacctatatctcttatcatatacaaaaattaactcaagatggattagagacttaaatgtaagacctgaacctataaacattttggaggaaacctaggacaaacctagaaaacctaggacaaacttgaacattggcctaagcaaaaaatttatgagtaagatctcaaaagcaaatgcaacaaaaataggcacatgggagttaattaaactaaaaagcctctatgtagcaaaataaataacagagaaaatagactacctacagaatgcaagaaaatatttgcaaactatatatctgacaaaggactaatgcacagaatctacaaggaagtcaaacaatgcaacaagaaaaaaaatacgtaaccctgttaaaaagtggataaaggacatgaacaaacatttttcaaaagaaaacatgcatatagccaacaaggagatgaaaaatgctcagtatcactaattatcagagaaatgcaaaataaaatcaaaatgagatagcaccttataccagtcagaatgactattaaaaagtcaaaaaaaaatagttgttggtgaggaaaagggaatgcttatacaccattagtgagaatgtaaattactacaacctctatgcaaaaatatggagatttctcacagaactaaaaatagaactgccatttaatccagtagtcctactactgggtatctacccaaaagaaaggaaattatatcggagacacctccactcacatgtttattacaacactattcacggtagcaaagataaggaattaagttcacggtagcaaagataaggaattaagtgtcaatggctgatcagataaagaaaatgtgtgtctgtgtgtgtgtatatatatgtatatacacacaccacggaatactattaattcataaagaagaatgaaatcatgtcttttgtagcaacatggatagaactggagggcattatcttaaatgaaataactcagaagcagtcaaatattacatattcttactcataagtgggagcttaaaaatatgtatacatggacatagagagtagaataatagacattggagacttggaagggttggagtggggtgagggatgaaaaattacctaatggttacaatatttaggtgatggttccactaaaagcccagacttcagccgggcgcagtggcccacgcctgtaattccagcactttgggaggccacgcggggtggatcacttgaggtcagaggtttgagaccagcctggccaacgtggtgaaaccccgtctctactaaaaatacaaaaattagcttggcatggtagcgggctcctgtaatcccagttacttgggcggttgaggcaggagaaccacttgcacccaggaggcagaggttgcagtgagccgagatcatgccactgcactccagcccgggtgacagagcaagactctgtctcaaaaaaaaaaaaaaaaagaagaagcccaggcttccctacacaatatatccatgtaacagaactgcactttaccccctaaatctatataaaaataaataataaaaaagtatttcatcaaagagaatgtatgaatggcagatgaccacatgaaaaggtgttcaacatcattcattagtcattagggaaatgaaaattaaaaccacaatgagggaggtgtgatggcccacaactataatcccagcacttagggaggctgagatggaaggatcttttgagctcatgagttcaagaccagcctgagcaacatagtaagagttcatctctacaaaaaatacagaagttagctgggcatggtggtgtgtgcctgtggtccgagttactcaggatgttgagacaggtggattgcttaagtccaggagtttgagactgcagtggactatctatgatcatgccactgcactccagcctgggtggcagagcaagaccctgactcaaaaaaaaacttaaaaaccatagtgagatataattaacacacacacacacacacacacacacacacacacaccaatgactatttaaaagacggattaattgcaagcattggttaggatttggaggacctggaactctcagacatttttaggaatataaagtggtacatccactttggaaaacactttgctagtttctcaaaaaggtaaacagaaatttagcatacaacccaacaatttcattcttaaaagtctgtacaagaaaaatgaaaacacatgtctacattgagacttatacacaaatgtttatcgcagcatcattcaaacttaatccgtaaatgtatgcatgtgctttgcttcatcaactatcattttcctctccttgggcttccttatttcctgagacacaataatagtgaaataggccaactaatactcctacagtgacctcttaagtgttcaaatgaatgagagagtcatacctctctcacattcagtcaaaagctaggaatgattaagcttagtgaggaaggcaagtaaaaagccagtacagaccaaaaactaggtctcttgcacccaaataaccaagctgtggatgcaaagggaaaggtcttgaaggaaataaaaattctactcaaacaaacacaagaatgataacaaagcaaaacagcattattgctgacacggagaaaatttgagtggactagataaaagatcaaaccagccacaacattcccttaagccaaagcttaatcagagaagggccctaattctcttcaattctgtgacagctgagagagaagaggaagctgcagaagtaaagtttgaagccagcagacattggttctgaggtttaaggaaagaagccatatctataaagtgcaaggtgaagaagtactaagtggtgatgtagaaactgcagcaagtgaactggaatacctagctgagatcattgatgaaagtggctacactaacaggttttcattatagacaaaacagctgtactgtggaataagatgttgtctaggactttcatagctggagagaagttgatgatgcctggcttcaaagctttaaaggacaggctgactctcttgttaggagcttgctttttttctttttttcgagacaaggtcttgctctgtcacccaggctggagtacagtggcatgatcgtagctcactgcagctgcagctgggctcaagcagtcttcctacctgagtatcccaagtagctggtactacaggcatacaccaccacacccagctaattgttttttatttttgtagagacaaggtctcattatgttgcccagactggtctcgaactcctgggctcaagcagtcctcccgcctcagcctcccaaagtgctggaatcacaagtatgagccaccacacgcagctgcagctgatgatttaagccagtgctcatttgccattctgaaaatcctggggatcttaaaaattatgctatgtctattgtgcttgtactttataaagtggaagaacaaagcctggatgatatagcacatctatttacaacatggtttactgaatattttaagcccactatggggacatactgctcaaaaaaggaaaagattcttttcaaaatattactgcttattgacaatttgcctggtcacccaaaagctccgatggggatataaaaaaaattaatgttttcatgcctgctaacacaacatccattctgcagtccgtgaatcaaggagtaatttcaatcttcaattcttattatttaagaagtacattttgtaaggcttacaggtaccatagataatgattcctttgatgaatctgggcagagtaaattgaaaaccttctggaaaggattcaccattctagatgccattaagaacatttgtgattcattggaggatttcaaaatatcattaacaggagcttggaagaacttgattccacccttaatggatgactttgaggggttcaagactagagtggaggaagtcactgcagatgtggtggaaatagcaagagaactagaattagaagtggaacatgggctgggtgcagtggctcatgcctataatcccaacactttgaggctgagatcacttaagcccaggagtttgagaccagggcaacatagcaagaccctgtctctttgaaaaatagaagtggaacctgaagatgtgactgatttgctgcaatctggtgatcaaatttgcatgaatgaggaattgcttcttacggatgagcaaagtaagtggtttcttaagtaggaatgtactcctgatgaagaagctgtgaacattgttgaaatgataacaaaagatttagaatattacataaacctagttgataaagagtggcagggtttgagaggattgactccaattttaaaagaagtcctgcgagtaaaatgctatcaaacagcatcacatgctacaaagaaatctggtatgaaaggaaaagtcagtcaatttggcaaacttcactgttattttaagaaattaccacaactgcctctgccttcagcaaccgccatcctgatcagtcagctaacatctacgagacaagagcttcaccataaaaaagattgtaacttgctgaagactcagatgatcattagcattttttagcaataaagtattttaaaattaaggtatgtatattgtttttagacactactattgcacacttactagactacagtataatataaacataacttttatttgcactgggaaaccaaaaagttcatgtgactcacttcattgctatattttttatttcttgtggtggtctggaatcaaacctgcaatatcttaaaagtatgccttcattcaacaatgctgtggtaaaaaaaaaaaaagcagccataggcagtatagagtaggtttgactatgttccagtaaaagtttatttgcaaaaacatatgacaggctagatatggccagcagaacatagcttgccaatccttgctaagtaaagtcagatgagtaagactacatgttatatgattatagttttatcaaaattgcagaaaaggcaaatctatagaaaggaaaaaatgcctattatggttgcctgtgaccagaaaactgatgattgacaataaatagaatgaagggaaatttggggggtgatgaaaaagtcctaaaattggattgtgattcttgttgtataaatctgcaaattgattaaaaccttatgaattttactattaaaatggatgaagttaatggaatgtaaattatacttcaataaaactgaaaaaagggaataggtataaaagactaatgtgattttcatgatatttcatgaagatactaaattctgtataacaggctataaaaatgagagtacatgggtgaagaccgaacatgaaaataggaagaatagttgtaatagatgtcaagaattataatgtgagaaagtcatgaaaaatcaaaactattgttgaagcactaaatttttttttttttttttgagatggagtctcgctctgtcacccaggctggagtgcagtggcgcgatctccgctcactgcaagctccgcctcccgggttcacaccattctcctgcctcagcctcccgagtagctgggactacaggcgcctgccaccatgcctggctaatttttttatatttttagtagagacagggtttcaccatgttagccaggatagtcttgatttcctgacctcgcgatccacctgcgtcagcctcccaaagtgctgggattacagacatgagccaccgtgcctggccaaggcactaaatatttttaaaagttacacaccactaaagttcagtgctttttgaaataatgtatcatcatcttccttgacataggatcgaattaaacagtattatatccattcctttttgtactttttttttttttttcttttgagacagggtcttgccctgtcaccaggctggagtgaagtggtgtgatgtcggctcactgcggcctcgacctcctgggttcaagtgatccttctacctctcagtgtgctgagtatctgggactataggcatatgccaccacacctggctaatttttgtattttttgtagagacaatttttcggcatgttgcccaggctggtctcaatctcctgggctcaagcaatcatccagcctctgcctctcaaagtgctaaaattacaggtgtgggccactgtgcccggcacatctgttcttcataattcacatgtatactctctctatcagataatttgcttcaggatttctgattaaaatgtcagtaaaagcacttgtatataatttgcctctactttgctccaaacctgtaagaatgcaatgtgaaaaaatttaatcataagtaaatacattttatctacatttatgacaagaaaaatctcaacagaccatagaaatagaaaaaaaagtcttggtgatgagtggatgttgatgcttacagtaagtcctcacttaatgttgtcagtagattcttggaaactatgactttaaaggaaatgatgtataatgaaaccacttttaccgtaggctaatggacagaaacaagaattaagtccttatggcatatttctggttataaaaacatcaccagacttctagataaagaccaaaaaacttgtaatattaaacactgaaacaactgtgagctggaggtaaatttaagaaagagtaataaaaatattatttacccaacggttccagtgtagggtcatgagtggctgcagtgtatcctggaaggttagtgcacaggatgagaaccaaccctggacaggatgccattccttcacaaggcacacttacagatgcacccacactcgctcagactgggaccatttagatacggcaacatatttgggatgtgggaggaaaccagagtacccagaaaaaagccatgcagacgtggggagagattgcaaactccacacagtggccccagctggaattggttgttttcaatgaacaatatgatgaaaggacctattgtacagaaacctaggtaatcttcacgggaaagagaaccaaaagtattctgcaaatggcaggagattggaactgggctctctgtataaaagtagggaactgggaccgtgttttaggcagtgcaactatacctgaaatactatacccgaaataattccacctgacactgttggtattttcctgtgacccaatgaggcagttatgcaaaaataggaatgtaaccctataatatatgtagatgtggcacctgaattagagctctacttatgagggaccaaagttccagtcttctttatgttagacctactctggagctgtgtaactccagaggtgtgagtaaccatgcaaccacacagcaggcaggagttcgcagaggataaaacttccacataagatgaacctgcaaacaaatatcttaggaaacatgttgccataagagatatcggacatattaagtagcctcatttacatctgaggaaatgagagtaagaaccacaattccaaaaaaaaaaaaccttataaatgtttaagatgttcaaatgaagtcataattcactatgagaatagaagtaaataagaacaggtggaatgaaaaggggccacttgcaaatcttgtaacaaaatttgataaaattaaataaactgttggatggattaaagtcaagttggcataacggaagagagaattcatgaatcagaactatcagctgggaattgaaagttaggatgaatcaagtcacgtagaacatagaacaaagaggtaaagaggtttaaaacatgaaagagaagagacatggaagatataaaccaaaaataaaattcagagccctccctcaaccatctgagtggactccctcctctcgtccaggaactgaaagttaacctgaaagactggttcaggccattatgggaagcaggggtggacatgcctctttatgccctcctcccttttggaatttgggaaaaactgaccagcatttaacatcaacacagaccttaagtttgataagaaacatttacagtctattctctctgaagcctgctatctggaggcttcttctgcatgataaaagtttggtttccataacttcttatcggaattcagacattcctttctattgataataactcagccatttgccaatcggaaaatttttaaatctacctataacccagaagcccctgtctcgagttgtcctgcctttctggactgaaccaatgtatatctcaaatgtatttgattgatgcctcatgtctccataaaatgtataaaaccaagctgtgccccaaccaccttggccacatgttctcctcagggctgtgacatgggccatggtcactcatatttggctcagaataaataccttcaaatacagagtttgactttttttgttgacagagataactgagttaggaactccagaatgtaagaatagtgccagggaagagaaatttcccaaggttgaaaatttgttagatttggagatggatgtgtgtcttcagattgaaaaagttaccagtttcaatgaggagaaacagagagggggaaaaaaaaaaccacctctaagtatagcataaaggaactgtagatcaataatacacacgtacacacacattctagcaattagggaaaagcatattacttacaaagaaatgacaaccaggttatcaatgcatttattagaaatcacagttaatgctcgtatacaatgaagttgtgaccatgttaaggaaatgaatccaagtgaaacatcatttccctttatgaaaagattgattttcctccagtgcattgtatttactagagatttgctaacccagcctttatttagattatacacttgtttaatttctaaacaattgtacgcgtatacttttccattggttagatttgtgtttccctgctgaaataacacaataattttaaattaatgtataaagcattaagtagggtttaagatgtctgctaaggaaataaggatttaatgaatacttaccactttttacaaccgttaatttgcacccatttagttgaggtaaaaacaaagacaagtacatgctgaagataactttttagcattcattatcagcctttggtgacactgcattagtttatatagtgtcaacatgtgcattaacatcaaatgagtaagattgtatgctcagtattgtgtaaagcatctacaatttcagaagaaactttagatacagtctacttcttaaagagcttaagagcttaattacatattagacaacacaactaagacttttaagtgataatcacaaaaggactttaaattagctcccactatccttattcagtgacagaagttcttctgcccatgatagaaaattagaatctggtcactcctaaactcctgtgttccctttaagtgagtaaatgctttcttatctcttatgataatcaaagcttacatctctttttatgtttacagctacttcccttctcccagagtgtactgctgctgggtgacttatcatgggtgaagggatcccaggggcttcttttctctttcttgctcattttttccctaactcaacagtctctatttctgacctctgtggagttggagcttggaaaaatgagggaaaaggaaatggaatagaaatgttcctacttgactgctactgtcataagagagttttactttttctgggcttaacagatttttaaagttgactttctcttacattttcatgggtctttggagatcccctgttctgcacatctcttacctacagttatttctgggttagtgtatctcttactctctcttagcctctaaaattctagaaataaccttcagcttctcagctgctgagctctatttcctcttcttggtggccctcttaagaaggacctaaaacaacccttcatgatggttcacacactcagatttcccaaatggctcctgagaaactctcaccaatttttttggggaggtgggggggtctgtttaatacagggagtttagatttattctaatgcagcagtaaatctatatcatcctaccgcactcttttcagagtgtggagtgtgagtcaaataccagtccccttaattatggggaacatacatgagtctttccaagttgttccattaaaactcctctcttttcatttgaggtaaagcaggaagtatactgtcttaggtattagatttgattttatcctacttggaacctcataaggtaacctgttactctttcatagatgctagcagaaggtataagactcctgatttagagacaggtgactttattattcacagcacagcaagtgtcaagaacatcaaatttatgtcaattctcctggaccccaagtcccatggggaaatgaggaagactcagatggatcctgtacatacagtagatcatattatggaagaggaacactgagcttgggtaatccactgcttttacaataagcagtaagcacatttaccctttgtcccagagggaacgtaagtagaactgttatattgttgttttctttttttgtttttgtttttactattctggtttttataaacaaaaattgaaaaagatagatttactattctttaaggcactcagtggaaagaagaataaaatcacatgttgcttcattatttcaccagcaagccctctcattagtacgttatattttttttagatggaaccatctgaaggagtaaaataaatgattagggatgtttcttgcttccagtcaaaagtgtttaatgagtattattgatagggtctcctttttaaagtaagacttccctttaataaaactatagttttactgagagggtacagtctgccctaacattctgttcattcttggtattttcagtacatatttgtaatgatattagggaagaacaattgcagtaatggtttttctggacctacaagataatagtctgaatattttatattatctctttgaaatcaaaggaattatgttataaaccttttaaaaatacatatattatttatccagtaaagtctctgtctaaattaaattgaatcgtaaatatgttttataatgctttcattatcttttaaaaaccagacccaataggaacagttttgaaggtcacataaattgtttatcaaaaaatatagaaacttaccagtaagttaatatacagtcatttaatcgcttcattaaatttttgttcattattatttcagtttcacggcttgtaatatctccagcatcaagaaaggaagttatgcagtggttggttgaaattatgagccaatagttatttattggtagttatttacagttgaacattcacacagtattcagtagcatcgctaggtaatagaggttacaaatgaaagctgtagaactggatttgccatttattagctgtttcacattgggaaggtactttgtttttgagtttttctcatctgcagtataaatttgaggcatcagatggatttgtgaacagtgtttttaaattttagtctggtattaaaatgtctcttgacaaatatggtttattaatagttgtaaatacatttctatattaaaacttatatgtataaaaattcttccaaagctagctgtatctgtagaggtgaatctgggggttcgggggtgcgtggtgtgtggaatctctgtctattccgggatcagtgggtttatgtgaagtctgcatgtaggcaagcatgtctgtttgtggatggatgtataggggtagatgtgcttacagatgaccctccctgtgtatatgtattgtgcttgcacgtatgtattttctttgtgcatgtttgtgtgcatgtgttgaatgaagagcagtttgttcatcagggtttgcttactgacactttaaagaaaaacaggaaaacaacagtgattattcatatttataggaaggcagaagtttaaaatttttatttttagaagtttgagatttttgttgagggatataatatataaaatttatatgtagagggatataatatataaaatttacttttaactagactatagacctttcttttgggacatgtgatctttataaacattaaagtttgtcgtatatttcccattttataaagaagagattaacagcttgagattcatgatttttcaaactatattttcagaaaaagtacttgagttaatatcttcagtgattgttttagggaaggagttatctcagttcagcctttgtcaccttttccattcccatttgtctgtaatttttgtaagatttatctccttgtgagttgttaacttcattcttcagtcagtatagaatggtgatgaagagagcagaatgtggaattccacttactgagtccaaacacttgtttaccacttaacaatgtgacttttagcaatatatttttttaacctttctacctgtatttcttcacctttaaaataataataatagtacctatctcatgtgcttttgttgaaaaataaatgagataattcatataaaagcaagtagcagagtgccttctacaatgctagtactcagtaaataattagataggcaaattttaatgatgcttttttattgttaattgacacagtcatcaaactggcctataattactcttaataattgctggaaagaatatgttattaggcagaatgtgcatcatcagagcattttcagcatgttgaattataatttgtttaaaattgtattactggcatttggcaaagcataaatttctattataggaatatccctttacataaagagggtgtgttctaatgtccgttgttagaaatgtcattagcagaaatagacatcatagttgtgtatttgcagaggtcttctattttccggtagctcattcctctttgccatgcaaggcaggaagcatagctccccagccctcttgaataatcagcatgatttcctcttctgttagtactatttcctactaagaaccttagaacctaattacagccttgggcatgtcattcatttctgcatccaggtaactgaattaagaatttttgcctcttttgagtcaggttactgctttctgctcttcagctgttaccttgagtgacttagtattgaggatataagcacttcccccagaaaatcttatgtggtgaaggctactatgttaaaataaaagaacacccttcacccccagcagtggaaggagagttccagttgtttcacgtcttagtcatcatttggttttgtcatcttttaagttaagtttagaccttatgatgggtgttaatttatatttccctcattagaatgatgttgagcaccttttttatgcatattgaccatttggatattctctttggctaagtacctgttcaagtcttttgcctactattagactttttcttactgctttgtaggtgttctttacatattgtggatatgaattctttggtggatatatgtgttgtaaatatattttcccagtttatgatgtgcctttttattctaatggtatctctgtcttctttttcaaagatgaaaagaattatagctattacttttggttcctgttaaaaaggattttagctttagtcaccttgtcctgggcaggtactaccctataggtcacctttgtgtgaattagataaaagcaccccctcttaagtagatgtagccccattagcataagatttttttttttaaagggcagtgtctttcagtgaaggaaaaggcttctttcaggtagcctgagtattctgctaaggctacagcttgctgagtagagcttggtctagcctggatttacccctcagtctggtgccttaatgcttgctcagcactcaaaccgcaaaccaaagatggcaccctagggcaggttatctttaaatattcagagtttctaactattgaatacaaattattacagtttatggattgaattttcttttttcaaaaggttgttcttaagttgtggggagctgacttccaaaattaatttcctagttttgagttggttatggcttaaaagtttagttatcagttagatgtctcacacccaggatatatttgtcccactgaaacactgttctgtggaatcttggttataaaccaacatatagtagtgggatagagagaccttaactactgtgtgtaatgggtggtctttctgtagcaaatattgttcagcagtctgccttggggcaggagtggcatacttcccacattgtcctaacattagaaataagaattacttcactttccagctacctctgatggttgtgcttgtatcgcggtgcagtggtacctgtggataagaaggatgaactgaggacaccaggtctcttgctagtgataatctataacatttttcctggttttaggcttgctccttctctttttttcttcccaaagcccccaaatcctgcttcctttctcactgccatcccttagtcctttaagttaagatttcccatttccctgctctatggtggaatagaattcattctgagaaagatttctgtcttcttcagtccttgaggcaaaagtgcacaaccagtcttttgaggataagggttttggttttgtattatttatttatttatttatttatttatttatttatgcaaatgttaacagtagtgggggaaataatcaggacaaaaatagcaagtaaacagatgatgttactaagttttcaaaaaatgtgtttctggttctcagatgttaagtaaggccagtttctgttttttcttcatttaattgcataaatgctttaatcttctcttggtgactatgcttattactctctctatagttattatttattccttgtgacccaggatcacttacttatttcctaccttttcatggttttgttttgtttttttttgttttcgtttttttttttgtttgtttgtttgttttgagacagtctcgcactgtcgcccaggttggagtgcagtggtgggatcttggctcactgcaacctccccctccaggttcaagcaattcttttgcctcagcctcccaagtagctgggattacaggcccacaccaccacgtctggctaatttttgtatttttttttttttttttagcagagatggggtttcgccatgttggccaggctggtcttcaactgctgatccacctgcctcagcctcccagagtgctgggattacaggtgtgagccactgcacccagctgacttattccctaactaatgttttaaaaccttggagctagtgtagttgggacccgtttcaagtttaaattaggcatctcacatacttcttgactagaatttgaaatatgccaagtatataatatacatttagaaagatggacttttaccctaattcccacgggattgtaaacaagagcataactatgttatattccaaagaaggtctgtctttggaattcacagtacatgtgaaaagctataggattatattatttaggttggtaatctaagtgaagtaaggtttgtagcataatgtaggctttttgtcttcaggggtttgttaagttggcttagaacaaaattttctggcttattttgacatctcagaggccttgaaaaaatagattgactaatatttatcaattttaagattttatgtttaaatatttttttaaatgagtaagtacagattatattattaatctctaggcattctgagctctttcatataagctctttgcagttttgcttttatacctctgtcctgattaaatgaattgtacaatttgaaatcctatttcttttttatcatagagaattatctgtcttgagttatattgattacctacaaattttgattcattttcttgtaaaaattaatgttctctgcaagaaaattatgtcagttcaatagagaggaaggcacacaaatattcacataatcttatttgtgtatcttttgcaagcacattttatgagagatccataagctacatagagctttaaaaaacttaaaaggatctaaagatctcaccataaaagaaaggatataaattcttccttgtttgggtgctttattttcttctatattgttttctcttctattaaccacaggtaaacattagttttctcagcgacctatatacttttacccttgagcatttataggctttaatactaattttctattgccatggttattcaaggtaaatatttagataattttggaatacattatatctttgttgtatctctctgggctcattgtagatgttcagggaataattattaattgattaacatcctcttttctacaaggaaaataataccaatattaaatgactacccccaatttgttaatggtttccttttacatcacctaaaatatgtaagtagtttaatgaattccaggtcatattatagtaatgacttttctgtgaaacgagggaagtgtggcccttccttttaggagaatataccctaaattatatttgtttttaaaggttttatgattacagagtaatatatatagtaatatattaaatattaataagttactaaatagctttgattctccacaacaccatgggatttacaattttaaagtgtttagtaattggtaaaccagatccattttgtttatgtaggacaggaacttagaaactaatgtggtgcatatgtttagagatcaggtttaactttaatcagtaggcatttgaaatattatttttcatcttataaaaggttttcaaaaaggatatttctggtgttacaaaggtaaaatctgaaataatctggggaaatgtagttagcatatttaccaataacactattcaaatttgtagaagtgaagcatttgtagcatatatttacttctcatttttaataatcccaaaaacttgcaagagtaaatcatggtggtgaaatattgtctcttcttagaaacttgaaaatgttttaatcagtaccccaaaactgaagaaataaatataaaaatttggtattcacttttattctcttcttacttctctttccctgtccccaaagcagatcgccaaactgaggcagcaactacaacgcagtaaacagagtagtcgtcacagtaaggagaaagatcgccagtcacctcttcatggcaaccatataacaatcagtcacactcaggtaggctaacttcttgtccagatttgaataattacttttagttcattaaggaagggaattcatcatttcagcatttaaaaaaacccataaatatttagctctactaaattactagtttgttaaattgttataaaaagattgttagaaagcagccgggcggccggccttggtggctcacgcctgtaatcccagcactttgggaggccgaggcgggcggatcacgaggtcaggagatcaagaccatcctggctaacagggtgaaaccgtgtctctactgaaaaaacacaaaaaaaattagccgggcgtcgtgccgggcgcctgtagtcccagctactcgggaggctgaggcagcagaatggtatgaacccgggaggcggagcttgcagtgagccaagatcgcgccgctgcacttcagcctgggcgacagagcgagactccgtctcaaaaaaaaaaaaaaacaaaaaccagccaggggcagtggctcactcctgtaatcctagcactttgggaggccaaggcaggtggatcacttgaggtcaggagttcgaaaccagcctggccaacatagtgaaaccccatctctactaaaaatacaaaaaaattagccagactggtggtgggttcctgtaatcccagctattcggagactgaggcaggagactcacttgaacccgggaggcagaggttgcagtgagctgaaatcatgccactgcactccagcctgggtgacagagcgagaatccatctcaatggttagccttctcttaataacagataaaacagaggatggtggtgtcaaggatgatactgacctggattgaaatctttacttccttcatttattgagcaactatgcacattatctcatttaatcttcctaacagttcctttacccatctttctctgtgtctctatgtatcttatccctattttacatatgaagaaattgaggattaacatttttattttcccctagaagtaaatactaacatatcccatggaacaaaatagtagtgtaacagaagaaacccaagcagtatatcaaaacaaaccccaattagggtttgtttcacaaagataaggatgattcaacattgggaaatatgttaatttagttcattgcatcagaaaaccaaagtagaaaagacagttgattttttagatgctgaattacacttgataaaaactcagtatcttgtgattaaaagaataaataacctcttactaaactaaaaataggatatttcataatgtgactaactgcaaatacagtaagatcctaacaataaaatattagtagcataattgttaaaaagtcaaggatgtctataattattgatattatttgctagtgatttagatgttctagaaacagggcagtaagataaagaattatcactacttacatatgatattatatatttagaaaatcaaagtgaattaactagactattaaaactaatgataggatagctaaaatgaaaaatactgacaataccaagtgttgatgaggatgtggaacaaccagaacagccacacattgctggtgggaacacaaaaaggtacaactactttggcaaacattttgtcattttcttaagaagttaaacatatgctgaccgttcaacctagaattttcgccctttgatatcaatccatgagaaataaaagcatatgtccacacaaacacttgtacatgaatcttctcagaggcgttattcataatactaaaaaaaaaaaggaaatagacaaacatccgtcaagttgtgagtggataaacacttcatgtatccatgcatccatgcaatactgtaggcagtaaaatggaaggaactactgatacagggaataacatggttgaatctcaaaaacatcatgctaagtgaaagaaatcaggagcaaaaggctacatactgtatgatttgttatattaaattctcaaaaaggcaacattatcgaaacaaagttttagggatgcggattgaccacagagaggccctagggaaattttttggatgatagagggttctaaaagtgactatactaacaaagctcaacaaactgcatacttaaaatgggagaattttattgtatgctgattatacctcattaaagctgtaaaacaaactggcaagtctgaggcatttgaagtgaaaattcttatatgccttcctttttcttcttaatctgatacaattaacatattgtttgtttcaggcagtttttctctaggagtccagtgcgcttacactagatcacttgactgaacaaagaatgcttacacaattgttcaaatttacattgaatttttaccatgtggttattcttaaaaattattatcctttgctatacatactggaatatttgtaggtggaatatgaagtctagaatgtactttaaaatattccaaaaaccaaaaaaacgtgttcacatgaaacaaattggtaaatgttgataatttttgaagctggattatgtgtacctgggggtttattgtgttactctgttgaattatgtttatgattggaattttccataatgaaaaggggaaaactgaaactagatgactagataaagtataaacatacccaaattcagtttcctcttatattagtaatgtttcaaaatatgatgaaaaatacaaaatgcctggaatcaaacttaaaagaaatatgtaaactatacatctttgagaacatgaaatataagacacataaatgggaagtcttaacacattaatagatgggaagattcagtatttttcaaatagcaatttacctgaaattaatgtacaaattgttttgcattccagtgcaaatttaaaaggacttgtttttattacttgaaaaactgtcttcaaaggccaatgaaaaagcagggcccattaatagaaaagaaaatttgaaaagacttttcctacaagatatgaaaatgtaatataaaattatagcaattaagtggcactctgcctagggattatcagatagtagctccaggaaatcaaatacagaatccataaagaaatggtggggcaattggattactgtgtgggggaaataatactgagactttacaccatacacaaaagtaaatcatgataggttaagtatttaaatgtgaaaaactgtaaaaatccagaaagaaaaatatttgataaaagttgattacctatttgataaaatacagttaactcttcaacaacaatgggggttggggcattgaccctcatgcagttgaaaatttgtttataacttttgggttcccaaaaacttaacctactaacagcgtactgttgcacagaagccttgccgataacgtaaaatagtcacttaacatattttgtatgtttcatgtattatatactatattctttaataaagtaacctagagaaaagaaatggtcattaataaaagcataaggaagaaaaaatatgttcagtgttcattaagtggaagtgaatcatcataaaggtcttcctccccattgtgttcactttgagtaggctgaggaagagaaaaaagaggagaggttggttttgctgtctcagggtggcagaggtggaagaaaatctgtatgtaagtcgacccacacaggtcaaacccatgttgttcgagggtcaacagtatttgaaaaaatactgatagtaatatatgaaaaagagttaaaacctcaatatgagaaaagttcatgcatcaataagagacaaaagacactgatgagcagcaactcacagttggcaagaatacaccattgtatgggaaatattattagtgtgctaaccaatgattagcagtctaccttatcacagatcatgtatgtcaactggattcagtgtaagatagaggtcatttgttttaatttttaccttattaatctttatttttcttatttctttcttgttgtataaatccttaagtatcaaaaggcttgtcttacactttttccttaacaactattagtggtagttaatttttgagaactcctgccaaggacttttgaaaacaggctttaaattgttaagtgagttgttgaacttagcataatactgttgccacattacttaataatccaacagattttctgaaatagttgacaagatggaaatgccaaatactagaacgtaattgtcaccatacagaaaacaaacatcttgtaaacatactcatacagagctatacagtagacttacatgatacatttaagttacgtgacttcaactatgctgttcccgtgaaatagaaaaaggaaaacaatgtaaataatgcagaagattctgccattctactgaacaagtatatacattatacaggtatacctttatacttacataaagggatttgaaaggattattttgactatgtaattttcattttactttcttacttcagaacctaaatttctatatgtgcacctgaattttattgtatttgaaaggtcagaaataactccgttcattgagtttcaattttaatatttaccatactctttagttcttgattgctttgaccacaaataatttgataccacctttatcttatctcataggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaaggtaaggttacatgggatatttgaatcctttttttctctgatataacgaactgtctgaaaagtactttcttggtaacagctttgttaagatataattcacataccatccagtttactcatttagtgtacaattcagtggtttttaacagattcagagttatacaactgtcaccacaatcaattttacagcattttcatcaccccaaaaagaaacattttatcctttcacagtggtctctcatttccctgtaatactcttggccctaggcggtcactaatctgttgatggattttttgctggttgttctagatgtttcatatcaatggaatcatacaacgtggccttcttaactggattttttttaacttagcatagtgtttttaaggttcacccacgtttagcctgttatcagtgacttcctttttatggccaaatattaatcagttatatggattttatttattcagtcatcaattaatggaaatttggattgttttagtttttggctattgtgaataatgcttctataaacatttgtatacaaggttttgtgtgaacatactgtttgcatttctcttgggtatatacctagggttggaaatgctaacatggtaactctatgtttaactttttgaggaactgccagactcttttccaaagtgtctgcattgttgtatattcctaccagtgtataagaattccagtttctctgcatcctcaccaacacttgtaattatctgtccttttttaattatagcaatcttagtggatgtgaagtgatatatcattgtggtgttaatttgcatttcgtaatggctgaagatgttaagcatcttttcatgtgctagtgatcttttttttttttttttgaggtggagtctcgctctttcacccaggctggagtgcagtggcgtgatctcggctcactgcaagctctgcctcctgggttcacgccattctcctgcctcagcctcccgagtagctgggactacaggtgcccgccaccacacccggctaatttttttgtatttttagtagagacggggttttgccatgttagccaggatggtctggatctcctgacctcgtgatccgtccacctcggcctcccaaagtgctgggattacaggcgtgagccactgcacccagcctttagtggtcatttgtatatcctcattggagaaatatttatttagatcttttgccccattttaaaattggcagtgaaattgctaggtcatagcatttgtacatttaaaatcttgatgaatattgccagaattaccctcccaaaaggttgtactatttgactctccttcaacatttcatgttaagtttataattttatatatattacaacatcaaggaactctttggacatcatggcatctctgtttaccattgaactctttttttttttttttttttttttttttgagacagggtctcgttctgttgcctaggctggagtgcagtggcaccatctcggctcactgtaacctcctcctcccaggttcaagtggttctcccgcctcagcctcctgagtagctgggattacaggcacacaccaccatgcccagctaatttttgtatttttagtggagacagggttttaccatgttgaccaggctggtctcgaactcctcacctcaagtgatccgcccacctcggcctcccaacgtgcttggattacaggcatgagccactgcgcccagcccattaaagtgttttttttatgcattaagtgaagtttaagaacagtcatgtaaagatgtaaactttggatctaatttttagaggatgagataattcacatatttgctgattccttaaaaacatcctcaaaaagcaaaactatactaaaataaaaaacttggtaaggtacctctgcttttaataagccatacttcaattgtagccatatcagaatcattctgggataacctacaaacttataatttttagaagttttagatttatgattaagtgtacctcaaagttttaattaaaatatcaccatgaactggccagtagccaaaaaaggaaaattgtctggttaactatgtcagtattccaacatagttaaccagacaatttgttcactttttctgtttatcaaacaaactgatagataattaaaaattatctttagagtagaatagttattgctgtgaagttggtatagtttttgtttagcagcatactgtagacaaatgaagtttttaacttttaggttcaagggtacacgtgcaggtttcttacataggtaagttgtatgtcactggaatttggtgtacagattatttcaccacccaggtaataagcatactacctgataaggtagtttttcaatcctcaccctactcccatcttctaaccctcaagtaggccctgatatctgttgttcccttctttgtatctgtatgtactcaatgtttagttttcatttgtaagtgacaatatgtatagtatttggttttctgttcctgtgttagtttacttaggataatggcctttagcaccatccatgttgctgcaaaggacatggtcttactctttttatggctgcatagtattccatggtatatatgtaccacattttctttatccagtctaccactgatgggcatttaggttgattctgtatgtttgttattgtaaacagtactgtcatgaacatatgcgtgcatgtgtctttatggtagagcaatttatatttctttgggtatatactcaataatgggattgctgagttgaatggtaattctgctttgagttgagaaatcaccacagtgctttccacagtggctaaacttacttacattcccaccagcagtgtataagcattcccttttctccacaaacttgccaacatctgtttttttgacttttttgttttgtttttgttaacggagtctcgctctgttgcccaggttggagtgcaatggcgtgatcttggcttactgcaacttctgcctcccaggtccaagcgattctcctgcctcagcctcccaaatggctgggacttcaggtgcatgctgccatgcccgactaactttttgtattttttttttctagtagagacagggtttcatcatgttggccaggctggtcttgaactcctgagctcaggcaatccacccacctcagcctcccaaagtgctaggattacaggtgtgagccaccgcacccagcctgttttttgactttttaataaccgttctaactgatgtgagatggtatctcattgtggttttgacttgcatttttgtaatgtggagcattttttcatatgcttgttggccacgtgtatatccttcttttgaaaagtgtctgtgcgtgtgatttgcctaccacttttcttcctttttttttttttttttttttgagacagggtcttgctccattgcccaggctggagtatagcggcacagtcatggcttactgtggcctcaatccctcaggcccaaatgatccttccacctcagcctcctgagtagctgggactacagtcctgtcccaccacagccagctgattttttttttaattttagtacacacaaggtcttgctaatttgcccaggcttgcctcaaactccagagctcaagaatcctcttgcctgggcctcccaaagtgctaggattataattacaggcatgagacatcatacctggccatttgcccactttttaatgggattctttggtttttgcttgttcatttgttttcatttcttagattctggatattagacctttgtcagatgcatagtttgcaaacattttctcccattatgtaggttgtctgtgtactctgttgttgaaacctattgttgtgcagaagctctttagtttaattaggtcccatttgtcaatttttgtttttgttgcagttgcttttggcatctttattatgaaatctttgccaggtcctgtgtccagaatggtaattcctgggttatcttctggtgtttttatagtttcaggttttatatttaagtctttgatccatcttgaatttatttttgtatatggtgtgaggaaggtatccagtttcagtcttctgcatatagctagcgaattatcccagtgccatttattgaatagggagtactttccccattgcttatttttctcgactttgtcaaagaacagatggttacaggtgtgcagtattatttctgggctctctcttctgttccattggtctatatgtctgcttttgtaccagtaccatgttttggttactatgtccttgtaatatagtatgaagtcaggtcatgtgatgcctctagctgtgttcttcttgcctaggactaccttggctgttcaagctcctttttggttctatatgaattttaaaatagatttttctgattctgtgaggaacatcattggaagtttgatgggaacagcattgaatctggaaattgctttggacagtatggctttttattttatttttatttttttggagacagagtcttgctgctctgtcgccaggctgaagtgcagtggcatggtctcggctcactgcaacctccacttcccaggttccaatgattcccctgccacagcctcccgagcagctggcactacaagcgtgtgccaccatgcccagcgaattttttggttttttttgtattttagtagagacggggtttcactgtgttggccaggatggtctcgatctcctgaccgcgtgatctgcccacctcggcccccctaaagtgctgggattatgagcgtgagccaccgcgcctggccagtgtggccattttaacaatatttatacttcctattcatgagcatggaatgtttttctatctgatactgtcatttctaatttcattgagcagtggtttgtaattctcattctagagatctttcccttccttggatagctgtattcctaagctattgtgaatgtgattgtgttctgtatttgtctctcagcttcgatattgttagtatatagaaacactactgatttttgtatgttttgtttcttaaaactttgctgaagttgtttatcagatcaaggagcttttgggtagagactatgggattttctaggtatagaatcatattgtctaaaaccagggatcatgtgcctttactcttcctatttgtggctgtcttttatttctttctcttgcctcattgctccagccaggacttccagtactatgttgaacaggagtggtgagagggcattcttgtttcattacagttttcaagggaatgcttccagtttttgcccattcagtatgacgttggctgtgggtttttcttggatggctcttcttatcttgaagtatgttccttcagtgcctagtttgttggaggtttttaacatgaagggatgttggattttattgaaagccctttctgtatctattaagataattatgtggtttccgtttttagttctatttgatgaatcacatttattgatatgcatatgttgaaccaacattgcatcccagggataaagtctgcttagtcatggtggattcactttttgatctgctgctggatttggtttgctagtattttgttgaggatttttgcatctatttttatcaaggatattcacctgaagtttttgttgtcatcgtcatgtctctgccaagttttagtatcaggatgatgttatccttatagaattagttaaggagaagtccctccccctcaatttttttgaatagtttcagtaggaatggtactagctcttctttatacagctagtagaatttggctgtggatccatgtggttcagggctctttctggttggtaggctttttattactgactcaatttcagaaccattattgttccattcagggattctctcttcctggttcagtcttgggagtttgtatgtttccaggaatttacctgtttttttctgtattttctagcttgtatgcacagaggtgttcatagtagtctctgagggttttttaatatttctgtggagtcagtggtactgtcccctttgtcatttctgattttgtttatttggatctttttttctttattagtctagctagcagtctctctcattctttcaaagaattaatgcagggattcgttaatcttttatggttttttgcatctcagtttctttcaggtcagctctgattttatttttgttatttcttgtcttctgctagctttggagttagtttgctcttgtttctctagtccctctatatgtgatgttagtttgttatctgagatcggatttttatgtggacctttagagcttgtaaatttccctcttaacactgctttagctgtgtcccatagaatctagtatgttgtatctttagtcccatagtttcaaagaatttcttgatttctgccttaatttcatggtttacgcaaatgccattcaggagcaggttgtttaatttccatgtaattatatggttttcagcaattttcttagtattgatttcaatttttattgtactgtggtccaagagtgtggttggcatgatttcagtttttttgaatttgtagaggattgttttatgtccattcgtgtggttgtttttatattatgtgccatgtggtaatgagaagaatgtatattctattgttttgggttgaagagttctgtagatgtctattcagttcatttggtcaagtgttgagttcaggtcctgaacatctccattaattttctacctcagtgatctggctaatactggcagtcgggtgttgaagtctcccactattattttatggacatcgaagtctctttgtaggtctctgagaacttgttttatgaatctgggtgcccctgtgttgggtgcatatatatttaggatagttaggtcttcctgttgcattgaatcctttaccattatatactgaccttgtcttttttgatatttgttggtataaagtctgttttgtctgaaattagaatagcaatcttgctttttttcagtgttccatttggttggtagatttttctccatccctttattttgaccgcatgggtgtctttgcatgtgagcctggtctcttaaagacgcctactgtttagtcttgcttctttatgcagcttgccagtttgcaccttttaattaggacatttaatccatttacattcaaggttaatattgatatgtacatgatccttcattgtgttgttagctggttactttgcagacttaattgtgtagttgctttatagtgtcactgttctgtgtacttaattgtgtttttgtagtggctgataacgttctttcctttccagatttagcagtcctttcaggacctcttgtaaggcaggtctggtagtaatgaattctcttaccatttgcttgtctgaaaaggatcttatttgtcctgtgcttatgtagcttagtttgactagatagccacttctcgcttggaataggctccaatctcttttggcttgccagatttctgctgaaaggtcttctgttggcctcatggggttccctttgtaggtgggtgacctgcctattctctccagctgcctttaacattttttctttcattccaaccttggagaatctgatgattatgtatcttgggaatggtcctcttgtgtagtattttgcaggggttctctgcatttcctgaatttgaatgttggcctctttagtgtgggtggggaagttttcatggacggtatcctgaaatctggtttctaagttgcttgctttctcctcatcatttttagggatgccagtgcatcgtggatttagtctctttacatagtatttctcagaggctttgttcattcttttttattctttttaaaaaaaattttggctaggcacggtggctcatgcctataatcctagcactttgggaggccaaggcaggatcacctgaggtcagaagttcaagaccaacctggccaacgtggtgaaaccccatctctactaaaaatacaaaacattagccggtcatcgtggtgggcacctataatcccagctactcaggaggctgaggcaggagaatctcttgaacccaggaggcggaggttgcagtgagccgagattgtgccattgcactccatcctggcaacaagagcaaaactccatctcagaaaagaaaaaaaaaatttcgtcttagttcagagaaccagtcttcaagctctgagattctttcctcagcttggtctattctgctattaatatttgggattgcattatgaaagtctcatagtgtgtttttcaactctctgatcagtttggttccttcttacaatggccatttcatcaatcagctcctgtattattttatggtaatcattagattccttggattgggtttttgctttcttctgaatcttgatgaccttcatttctatattatgaattctttctgtcatttcagccattccaacctgtttaagaacctttgttgggtaactaatgtggtcagtgggaggaaagaagacgctgtggctttctgagttgccagagttcttgcactggttctttctcacctgtgtgggctgatgttccttcaaccatggtataatttgtacagtcggttgacttttcgggatgtttttagagtctgaggcattgtacaaggtttttatttgtagctgacttattgtccttagtttcacaggagggtttattaactaagtattttcagtattgaagtttgcactctgattgaagtttgatgcctcttaagcgtaatggccagtaggtaagctcttgctcagccacgtggctcttctgtatttcctcactattgcagctgcgctccctgtcagtgctctgaaagtgtgggctcctctcctactcaagtgctggctgcagatcttggcttggcactcccaggctgcagccctggggtgagctaaggctttatgttctctcccagcttggaggcagcaggggaagggaccttggcagtggctatggcagagggcctttcccttgtctctggggtccaccccagagaaatagcagaactgctgccagtcggtgtgattggctttgagtaggacagctgcgttgtgggctcaagctggggggatcctgggggagacagactgacctcttcttagggccgtggcagcttgctggaggtgtggttaaagcactctgggtctttgctcctttcctagtacaagggtagcaagggcagtaccactgcagtggcagtggcagaggggctttcggttgcctctgggagctccactgcagaaacacagatccgttgctactgggatgttcagccagggggtggggcagctgtgctgctggcctgagccgggagccccaccgggtgaaaggtggggtgccgagggctcacagggaggacatgggctcctctctgtatggtgagtatgtcatgctagcagtgcaagtaaagccctcggcctctctgtttcttctctactccaagggcagcaggggcagaactctaaatgaagttttcatttgcatagtttcagatttcggccttcacttgtttggtatagaaaatattgatacattttgaatttcacctgattttaccttccttcatttcccctcttgacagtttttctaaaatctctgaaatgacaatgatcagagtaagagcagtagacacaataaatagtgaaaataaattataaataaattaacagcatattggttcttttccctagcactgcagtcctgtgtgtttaataacaacaaatattttcaattatataacttaatatagagaattttacttgttaacctcactttgttagcacacaaatgaagaatatggagtaagatctatttttacagaagcagagtagtaaagtagaaagagtccactgcagcagaatctctgatgccacttaattagctgtgccactgaactataggttcctcatttgtgaaaacaaaacaatggaccagtgagctctgaggtaccctcaagaccaaaatatgtggctctatgatgatggtttcctttttttccttctttttgctactgagaacaaagtattcaaactaaggaagattatgagtagtcctacttagttggatactgagttagtagaatttgatatccaaattcttctaatattagaattcttttgagttacattaataaactctattgagtactaatagaataaacctctttattagaaattttggataatttgcaaaggaaatagaaactatggttctgttcataacctctaaaaattaaactaggaaggaatgaacaaacagaaaaatctgtacctgtgaatatgaggaatatgagatttcactttttcttacaagcaagtcaaagtgattttttttttagctttgttaattctttcagcaaatgtttactgaatatctgccatgtgccaggagtagtgccaggcacaggactcccgctgtccttgaagagttttgtgggatgtgctgacctacaggtacatacagtgagctatggaatttttaaggcaaacaatttgatttaaaagaaatgtttagttcaataaaggtaacatacgcagaaattagcttaagacacaagcttggtctttagcctttgaagaataaactgggtcagtagtggtggaatatgaaatcaagggaaatactatgtgctttctatgtagatgaatatatgcaccagcatttggatgtttaatggtattcctcttacagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaaggtaagaatggaattgtccacttagagggtttgttatgggccttgctcattataccttgtcttagaccattacatctttttttttttcttttgttcaatggtgacattgtcaaagattggttaatctaggtttctttgttcattggtttcacatacccccttttttgtgactctaacaaacatcttccataaatgtgtcagagaagcacagcgcatggttctaacagctaataaaagccataaaatggagtgtgtacaacttcatataatgcataggtcttttccttggtattgtccagagcggatgatggttatggtaaagttagctttaccatggtaaaatcaagcttaaagttagattttataatcagattgatttgcgaggaaataatttctaaaaattctgttggaaaaagtgagtgtatttttaaccaagtttataaagcttagtgagtatctacaggacatcagggattttattacagtatgtagataaattattaactgttgagaacatctgggattcttatttcctatcaagcccaactgtctctccatgttcttctatccttgtgtctacttgtgtacaccaacacttcctgggttctttctgtttctagccccctaagacctagctacagaaggccatatagactgcccagcttcttccttcctagctacttacaaagaaacactgaacttatgtttataacaaatttactgcttgtcaccatagagaaataggtcaatggcaacaaaattgtaaaactataaaaagttagacagtttataaaatcttgcaggagttttatggtccttgttctgaattgaccccatcccctatgattgatgtattgttgtaagtaaaatgcccagatcataagtgctcagccaaatgaatttttacatatgtgtgtgctcctgaaaccactacctacatcaagtatagatatagaagatttttattatcccacaaggctcccttgcgcctcttcccaaatagtatccttcctctctccacttgaaagtaaccactttgctgacttccatcactataatttaatttcccctgttactagacttcatagaaattgaataatgtggtatatattctttgtgtctgacttcttttacttatcattatacctaactcttctaagatattaaatggaagctactttggactttgtcctctgcttttctatgtgggtagatcttaacagttctcccctttcttgttgactctttcattactgaaggccttgtggacccccttccttcattaaggatatattgaatatagtaccaggtgtctttggcttcatgtgggaagtctccatttcttaaaatgtcagactaggaaattttcatttcactgaagcatcctgtgagaataaacacctttaatcacttcctcacaaccttttaatgtggatgtttcacaataaaacatcttgcttccagtaggagtgtttgttttgaaggtaaatggaaatgataaataatagtaacttgttttaggttgtgtaggtggtaaatggagaaaccagtctgtcttcattccaaactcatattctttgttattaagtacagttcaggttggccacttttgctacttaacacttgtaactggggtaaaaatgaaaagtagaaataatggtggcagtacagctagacagttaagtctggagttctgttttctttaatactgtggataattgagagatgctgaaccaaaaagaaaatgtattgagaggatggtaaatgagttccattttggttaactggttgtgagattgccttcagggcctcccagtgaatagtggtttctgtagttcacaggtcttcacttacatcataagtttcaaacagtgcatgttctttaatatataatagctctttttcctaaatatgtataatcaattttattatgagaaagtataatcatgtcactctcctgccagggtcttttgcaggagacattgtaacatagaagttaagagtagcactggctttgggaccataggaatgcatttgaatcctgggaagttttggacataaaacctgcattaattctcaaagatttaatgaatggtagctgctgctataaaaatagtcacctttattatcacctgttagtttccctaatcctttcaggaaaaaaatatcaattatttaatacacagcttagtcaaaacctccttccctagcctagtttgtgtcaattatctaataagatgaattctgaccatttcttagacagattagaccttttcctaagtttgcctttgttggtatattttcctctgtgcccttttgttcctacataccagatatctgcctgcataacactaatttctttatattcatcctcttgtttttttaatatgtaaaatgagaacattggttcagatcatctctaaagctaaggtttttttcctaatagttaaaaaatatttcttagtaaaatagggtaataataccttcctcatatcattgaggttacatgagatacagcaaaatgcttagcacaacttattggcacatggcaaacaattagtggtgatgaatgttgcttaatagtgatttttttaaaatctctttagaagttatatagaatgggtttcagaattatttaagacatttctctgttttctacaagatcacctcagtttgagaattaaagccccatgacatcagtttcataatatctaccatatttagctgagaggcattactttgtgattaagatcaagttgatgttactactccctggaaaactgtgtagctctctgttatgcaatacaaggtttctagttctcaaatcaaataccatctttataaagagaaaattaaaatagcacctatcccttttatatatgtaactatgcacacatgggtgtgttagaattgggagttgaggtttatgtatttcaactgaggttatacttctagtttatttaaggaacacttattgagcatttattgtatgtcagatattgtactggagagtggagaaatagagatgaataatatgtgatatctgtctttaaggaatttatagtgtagtagggagtaattaggaatgtaaacaaataatacactattataaatacactattatacagtgatgtttagaatactaaaagtgtaaaggagggagttgtccagaaattttacaatttctggaactaatatatgtcattcaaactgtaggctagtttctgactcatttcttctttatgtaaggcccaaactctgggttttgctatttttaaatatactaattatttctgtgatcccagcattttgggaggtcaaggcgggcagctcacttgaggtcaggagttaaagaccagcctggccaacatagtgaaaccccatctctactaaaaatacaaaaagttagccaggtatggtggcatgcagctgcagtctcagctaattaggaggctgagacaagaggatcacttgaacttgggaggtggaggttgcagcaagccgagatcacgtcactgcattccagcctgggcaacagagcaagagtccatctcaaaaaaaagatactaattctttcctataatgtatgttttctacaataaatcataaattggtgtttttttattaaagacataaaaggaagctgtatagctttcctagagcttttcatcattatgaaaacagaattaattatataattttgaagtcaactaggattgatttgatttggagtacctacatgttctgcagttgctgtggagagatttgttctgtggtagagtaactagttcagacatctgtaggagcctggatagacatggaggggagagggatagctgcagtgaatagctgccctaatgagggatgtgctggtgagctgattatttttctagtattcattttatatacgtattctttttctgactttgctaacatcatttttgtgtgttcctaacatctattcgctatgaattatgtataatttgagacctataaaataattttgtattatcaatgtgcatcgcacattggtttttttctttgcctgtatggattgtaatgccaggacaaaaacactctgtcaagaaagtttcagctattgagagacttgtttcaagtgaatgggtttttggcgtttcgttttgattttttactagatttttccagtgacctaaagactgaagggaacttggtcacactggtcacatgtgtaaagtttccaggctaactaatagccataggaactactactgctcttctctgtgtggagaattcagagatccagaatgagagcactcatcttgacatcatcagaatgtaccctaagaggtagcttacattcttccacattatcatacccaaaataaagttcaaggaacaaaaatagccatttatataatacagatggcagtgtcggaatattagtttcttaagcagctctgccagcgttgcttgatggtagccaaactggtgctggttaagccacaaaatgtagacttcagtcagctacttatcattgatctttggcacagttcacttatgcagttgttataaaattctgcaattttgcaggatattgtggaaacattgattattgtaatcatgaaataaatggaatcgtttgattcaggccaactactgagtagagttgtattccaagagtccctaaattgattacttgtaatttaagctatattttcctgaaggaacagtgtacactatgtggatagagtttcccaagccaatgcatgtaagcctatttaactcattctgtgatttaactcataaatattcgtattgctaaacttttagtgttaggactgagcctcccttggtcttaggagaaaaaaatcaaaagtattaattttgtcttttcagggtctagggttgaccctaggcagacttttgaaacagactgcttttggcatcttcctattcctttatacgtatattttaacatacttgtatttatctctagggctctatttcttgacctttttttgacctatgcccttactatgctttaaccctctattttttagataaatcagccaagattttatggcacttttcttttgggggtttatattgtaaaagcagatatgatgggtatactacttagagctaccacaccttgaaaaatcactgcttttgaatctggatgcgtttatcaaaatattctctttatatggttctagggcgcttattatcctagaaggaccttttggtggtaaaattacagcatataaagatattattccaacaaaggagttagtctataggttaaaattgatctattctagaattcatgtccctaaggtcattttacctgtctttcaagaaagcatcttaagatacatacattccagtgtctaacagcacaaaataagtatccagtaaatgctattgtcccttctttctgaaaatgttaacaattttaacaatggcagatactgtgatagctatgagttattattcataattcaaaactacttaaatatacaactcagttttagccattattgctcagtttagaatataagcaaatcaaaaatttttaacatacctgcatatatatttcacttaattgtttgtctatttaccatgatgttagctccaacaagagtaaatgaccatattttggtcagtgctttactctcagtgaataaactagtgcctagcatggtgtagtgcttaatggagatttttttgagtattaagacctttgttcatgatatgcccattttttaatggatatatttttatagctatgttgaaaatgtgttttctttgaattgttaaattttatgttaggcttttaatgtttatgaagagtgtgtgatactcttcataaaaataaaaaccaagaataattaaactaagattatgctaaatttagtgataggcttttggtgggaaagaggccatgaagttcaaatttgctgtagaaataaggggaaaggaagtaactgctaaaactgtctcatcttccccttcttgctgttggtcatgctggtaaccagtaaactctgatagtaactgggtggaaaataatagggtgtcacctaggttcaaggaaaagggaatctgttggagttttcctcccccattatcttttgtgttcctctgagaagaagtatcaactcatagggaccactccttacactatctccttgtgacactgacagaaggcagacccagtgaagctcttgcctgagccataagcctttaattagaaacagaatattagattggaaggaacttgatcatctagtcagctcctcacatctctaataaagacactggagttgagatagacccaaacttagtgaaacagatagcataacaataatcaacattgactctggggcagccaggttgaagccctgctctgccacttaattatgtgcccttggacaagctactcaatcgatctgtatctcctcacctataaattggggatagctgcctcatagaattgttatgatgattaaatgtgttcaggtgattttattatttccaatattaccacagtcctttaggtaggtgacattgtcattattaaaggtgccagaatctgaggcttagagaaattaagtaacctagctaatttccatggcgtctacatgccaacaaagatattttgtaggaacctgattacatcttgctgcctttacagaaggaatagtctttatatgggcattcagctgtgaaagggcccggtgtgtacagaacagtaagaaattgaacggttggggtataggggtgaatggtggagagaagaaaacagtgagactggagatttagaaagtccactatttaggccgggcgcggtggctcacgcctgtaatcccagcactttgggaggccaaggcaggcggataacgaggtcaggaaatcgagaccatcctggctaacacggtgaaaccccgtctctactaaaaatacaaaaaatgagccgggcgtggtggcgggcacctgtagtcccagctactcgggaggctgaggcaggagaatggcatgaaccgagatcacaccactgcactccagcctgggcgacagtgcgagactccgtcttaaaaaaaaaaaaaaaaaaaaaaggccactatttcataagagtccttgtaagctttgctaagagaaagaaaagccaaggaaagatcttttgtcagctaaaggataggaccagcttcacatttaagaactataactcacgttgacacagaagtagaggcagtaggagggcaagataagtagccatgttaatagtctagtcttgtgattttcaaacttgatttattccacacccttgtcagcaattttgaatctgtacccctaataaaagtttatatatttctaggtgatatatgtatataattcattctacaaactgttaaagtttacctgttttaaaagattaaaagtgtgtataaatgtagaaataaatatatttaattgctctattttttcctacatgtcagcagattgtttcatgcctcttaactgggagaccacaggtatagggcaaagatgaggagacatagcaaggtcagaggaactggaggaaaggggctgaagaagagtcaacagcatttggtggccaattagatgtatgaggtgagggaggaggaggagatcaggataacagcaaagttcttatgaagttccagcatgggagatgtggaaacgattaccatcattaataaggtagtaaatattggagatggaacagactttaaggtgactataatgattaaaattccatgttggtttctgcctaaagacattataataccattttcctttagcaagaatttttttaaaaagaggaaatgctaaattttatctaatgttgcactgacaacattgatagcattttgctttgccttctcttttgaacatagtaaatgcttagtaaatatttaagtgaatatttaaaattgtagtgaaatttttattagaagttccaatgttcttttttccctaaatgttagtaaagtttacttgtttttaaagataaaaggtaaatatgtataatgcactgattttttttccccacacgtcagcagattgtttcatgcctctcttattgggagaccacaattgtaggataccttaggagcagtttaacatgaacaatatgttctgttttttgtttttttaaaaactgatgttcctggaaattttgccatttaataaacttgacaatataaaaattaagattgtattacagtgattttcttgagatacctacttttgcgcaagatacaaaatattttgtgcaatccaatttattttgtttagttttaccattaagatttacaatcattattttagtctataaattgctttgaggacacttttcagttttaactgtcatatcagattaaaagtgagttgttttcatttttaattgtcatatcagatttagagtgagtagttagcatatcaacaataatgattagcactgttgttctgcatatcaagattatgttgtggaagaagcactgtacttattttgactacacaaaaacaaaagagtaactttttggcttaatttgtaagttggcatcaatttaattcatacttatggaatgagaagtgattacaaaatataaaatacctcctacatataataaatatataattaatgggccttggaatgtaagttgagtcccggttattaaaaaatcaatctgatttgaaacaaagtttataaatgtaagtaataaaaggttctgatgtcatttttcccctgtactctttgctgaatgctgatctaaaggagatcttacatatagctgatgtcttggttcattacaattctttagtattctcacaaggtgttaactttgaattttagaaaaaccttagaggctctttgtaaaagccaaatgttctccttacttctaagtttccaagttggtcttggagttaactgaaaatacaggctttttaatacaattggtaatacaacctgattcttaaagttcattgccaagaaatgatacacaattgtgtgtttctgctgatttcattaggccttcaaaccccattatagttgataatttcatttcctgaagcaaaataagtatattttaacactagagtagtaattttaagtactattcagtcaatcatatttctaatttaattctcttggccaattttatgctttagtatgtcattgagtaaagtgttggttgaacagtgtactcactttcctagtcagttaactacctgggaaagatagaataagaattacattctactgcttattgctgcatatactatgaaagtattttctttgcatagtagtctatagaatctgcatgctttaagcattgattttaatttcaggatgatagatctctttacactaaaggatgccatcatgaactgacagagttcatgtcaggcagttataaacctggacaacctggtactccagatattattctgcttctctctcagaaataaaattgtatctgtatgtaccggagtagagtacacaaatctattgaaaacatttcctttactctcttctgtcaagagggagcagaataggcacttaatttttgaatggttcatcatttttaattttcaaattagaaatgatgtgttactttttactataataataatattcagcgcttactgtgtttcaggcactatcctaatcctttttttgtttgttttttggttttggggttttttttttttttttgtagagagggtttccccatgttggccaggtggtctcgaactcctggcctcaagtgatcctcccgcctcagcctccctaaaatgttgtggttacaggcgtaagccacctcgcccagcgcttatcctaatccttttacatatatttttcacagctatcatgtcagtggtattttctattttatagataaaaaaacagagggatcagacttaccctatgccatgcacctaggcctaggaagaagtcaggtggcctcactccaaatcaatgttcttaaccatttcatgattggttttcagatatggctgtgcttcaggtgcacgtgggagctttaccccccacctccctaccccaaggcagtgcttggctcctccccagactaattaaatcagaatatttcaggaatgaggtctagacattgatctttttaaaacatctgataagtctaatgtgaaagaaaactctggttaagaaccactattctattattgcttgttttagaatcaattttacttaatttaataaagtaatgtgatagagataaaacccatctatagacttagggctagaatagaaccatggcagagattttacatactacctgcataaatgaatcaacctttatatatgtgatatatatatttttgagacagggtctcactgtcacccaggctgaagttcaatggtatgctcaaatgtataattttttatacaagaagtgtgggccccacaatataccagatataataaaaatcagaagaatttcagaatactcaagctatacaagtacatgtagtttaatgaatattgtttctatatgaaattccaaacttgaataacttctctaatttttccaaactctaatttattatcatatgtttaaaagtatttcagaagctactcgtattttaatggtaaatatggtacagatgcatatgtgtgatctgttttaaaacagcaatcacatttttccatattcttgattttcagagttgagtgattgttataaatatataaaaatgagacttgtgaatacagaaagatgtgaataactatattcactgcatttaattttattgacattagctatgatgttaaaagtcataaagtaacatttaacctaatctcaactgtatttctagttatgatcctatattattctccggaataccagaatgagaaaacttaccattactggtaaacaagagagactcaattaagattaccatgagacttctcatcttgaatctcctgagcaggcatatttatatttataatgttgttattgaaatgtggctattaaattcaacacagagttttaaatgaatagtaatagtttgtacattcaagtctggaatgagtagcataggttggtcatatgggttgtttttaaagcgtgctgctttgtaaggcaagaaaaaatatatatgtaaaatatgtcttctttgtatgttagaactattaaagaaaaatcacagaattttagagttcatgaatggcaattcctttaattatatagaaatccagagagatgattgtactccaggtaacatagaactatacaacaagagctaaagccacagactagatgtctccattccctgacccctatttacagtctctctgattgcatacttaacctgaagaaaaaactccagatttagcaaatatttgtttatagtctcaaaatttttttcttacaagctttgcctttccagaccatctaacattaaatacatattcaattaaaaaaaatttttattgaaaagatataaaccctgcctgtctaggatagcagtatatttgtttacttaacattaatacccccaaaaaaagcagaataatgtttaagagggtaaaactctgttaaaagatgcacttacagcctctgaaattagaaatattttaagaagaaaaattacttattctagattgttaacaggaagataatcagttttgcagatagattagccaactcacatctagccttcagttatgagaaagtcctttgaaaccatcagtaaaatactgaaagaatgtgataggcctgatgatgtagtaagaaaaagaacacagaagactgtggccaagatgacttttcttacgtgataatagagtggatccttaactactgacatgactgctaatggtatcaagctgatgctaatggtatcaggctgatgctgcttgtgccgtgtaggctaagttatgtccagcagtaatctccatggaggcatctcatgccatatctacttgtatttttttatttttattttaaaaatttctgtggatacataggtgtatatatttatagggtacatgagatgttttgatacacgtatgtagtgtgaaatatgcacatcatgaagaatgggatgtccatcctccctacttacttgtatttttgatctcatatatttcctttgcctggtttgttgctgtttgcatagtaaggtaaggtcaagccatattttttatattacaccaaatttgaggccttattctcatcagatgtttggttttttgtttgtttgtttgtttttattcatggaccagtcttgtctagcctagcttaaatagggcagcaaattcagacctccaatcaggctaattatgctttgtatcaacctgagacaatcctattcctcctccttcctcccatttgttcatgcaagatgtaggataaatattaaacttaagaaaattctcaaatctgaatggtatatgaagaaaccaaatttcattctaagacttaattttttccaagaggctctttggtgcctactctgtaggatcatacataataatgatagagaaactgtgtggttttctagctttcccaatagtataacgttattattttgcagacagtggtttcccagccaaagttatagccatgttcaaatataagcataaatctgcattcacaagactctaacaagcattagtgtgcatcaagggtcttcttcctaagcatgtgttataacttcattaatgatgataaaacattcttattagtcagattttaaatattggactgtgttctatattctaaactaaagcaacttatcaaaattgtgatgaacataattatgatactgttgctatcttcccaatagatgaaaataatacatttcaatagatcatgtgcttagtattttagcagtggggataggtttgcattaagtcagaatttgtttaaataggactattgtatacaaacatgtcactgactttacaacttggcctcttataaaaataatgacacattttagtggatttgaatttccaaaatctcttgccaggtaggaaagggagaaattgcatatgggttttatggcttttcatgaatagaccattttctttttggccaaaaatatgaggaaaacgtgttaggtagagatgtttggagattttgcatgtcttctagtagcaaaaatacaaattctgctgaaaaagcccttttattataaacattttaaaggtaaaattctgagcaaattgttttttatgttgggtaggtagaaagagacattttataaacttgtttttttcccctgcgtacgtgttattcatgatatttagcaaaaataacatttctgctaagaacttttgtaatgaacattattcattttcgttaaattggttgggcagtgagaaggcatgtagagaaccctgtatcattataatctgttttattcttctgtgtgacttaagcacattgccccatcatttgcattcttgaaatacgtaataaataacatatttgttttcaggattacagctctgttgtattcaaaatgcagttttctggaccaaaatgtcctttttatgttctatggtgtggcagatgactgttgcattgcagtttttatttagaagaaatgtgctacacagggtataagaaatagctttgcaataaaggagactggtcaaagcataggggcagtagtggataaattgtgcaaaaggctgtttgtttggaaatcaaatttaaaagagctttcaatcactagttaatataactgctttaaatttacagacagtgggagtagctcaccgttacccaagtatgcttcatctcccaaaccaaacaacagctacatgttcaaacgggagcccccagagggatgtgagcgagtgaaggtctttgaggaaatggcgtaagtaatgtcttttttgtcagctgggatctgcaaagctgtaaagctttttactgagaccagttgattacatatgaatcaactactctatccagctgataatgtgtttcaagagcaaattatgtaaagagaattgaataggcaagagagatcttactgaaggagaactggagtctgtatgttggaaatgtataagccagtacaaagacacgtggaaacttattcttactacctgaaaaatctatttttaatcattaagaattgtcatttcaggaactcttagtttagatggtaacaaagagactttaggagcaaagttaatatccgtgtgtgactagcttaaagacagtgtactccacaagccagaagattagtctccttccctgtagcctcatctagcttacttattcagactttctgttcacaaggggtttgttatcttcatgaaattttaatatgtgtaagttagaaatgaaattagaaaaagaggttcttgctgtaaacactgggcagagtagctcagaagaagactgtggttcttggatgccctcatgcctttgttccagtgcaggtgcctagtggagggtgcagtgctcttgcaacatagaaggacccatcttgcaggagctgatggcttagctcctgggaacgggaggagaggaagggcttgtggacccaacctctgttgaattgactggctttttgagagaccactgaaactcccctccccactccaccccccatctgtgctagcggaagtctatctagaaagaaaaaaggagaaagtgtttaaatacgtgatggacgaatgccccctgcctctggtatactttttcttaacagaaaaggtcattctaactttgcataatcttcaattataatgtagaagacttttccaccttcctaaataattaaaagcaaactaatgatctctaaatatttgccttcctggttcttttgaaaatccttttgtctcaaataccacttcagtgctgtgtgcatgaatagtctgccagctgacttgtgctatggaagatgtttacccctctgtatacacttaacccatctcctgccatttacattttagctgttttagagaactccagttaattcagaaaatgcttaactttttctgtgttcatgattataaatctaattttgttttatggttttaggtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccaccaccaccaataatacttatcagcatcataaagtatctcttaaacactgatcttggcagggacggaactcctattcagcagtttttgtggaaagcagtaatgcttgcaaaacgtgtgtgtcattcagcattttaagtggagactatgcatttcatagtatatttgacagattagtactgtgtcctgtgttttgttccagattcttcagtataaataagctctatatcaaaaagttgcctgtctaaatagaaaatgtcttgctgtgttttgtcctatggaaaatactgtaattcaggattatgtttacaattgatccaggtgtttgtttctaacttctgtaatacatacaatgcaaaaaaaaaaaaaaaaaaatggccacaacagttgcacagtgcccaccctatggcctagcttcaggtacttcagttgaagtctaaactcaggtaacttggaatgtatatcatattgggatattaaatatttcacagctaaaaagctaaagagggaacatcactcttttgcctttccttattttatgcatttccctttcctcattacattccacattcttagaataagaagtgcattcaatcctaggagaatgataatcctggacatgggtgaacatgaggagaaccagcaaaatctgtggtgtttgacatcactttgtcatgtggttacaagtaaaacaactgttgcattcactgtttcaacatgtgtacatgtggcttttttaaaagttcaggtgttgctcagtaaaggactgtgacaatgttgcaaataaagtgttcagtactggactgtacataaacattccacattgtgtgtgatgaaatttaaagacaagaatgtctagagttaatttcaaaataagtgaagtgtttgacggaatggttgagatttttttgtttatgttagccatcagggtcataactgttaccattttatctaaagacatatttatatttagtttctcccttggaaattctttattttgcaggtgaaaaagtgacatactttttgttattgtcttcctcaagcagtttaggtgcatgatcttcatttacatagaatacttgggtctcagaattgatgcaacataagcaggtttttttggtgacttacaagagcaatagtttgaagctatctcatttaagcctctcataatgcataatcatgagtagttttgaaatttgcaacctgtgaggtagagcataaactcaagaaaatagccttgaacttgcagacttttgacacaagttctccacaaagtgtgaagagagccccaggcattcctgattggtcaatgggagagcctaactttcattgttttcttcagtacaaagagtatccaaaagctaagtttttgtattccactactttcagttcaataaaacctagagttgtttcatctgcgcctaaagtgtatggcacaattttcttaagaattaggggaaccaggtgcctacagttaaaggaacgtttcagttcctttcattcattcctgggtttttcttttattttctaagaaggttgaagaaggatgagtgatagagaagaaagcaacaccattgatttttttttttaagaaatgatatatatatgtatatgtttgtgtgtgtgtgtgtgtgtgtgtgtgtgtgtattctgtgcattattttgtcatgatctcaattctcttctttccaccaaagtttgtcgtaatattttctcctgaaggtgcattctggctcctttaaattagtcagtgttatattgtaggagactgtcatggaaaaaaggactcagtttactttcgtcattttcacaggggaaccttttaaaacaatcttttcagcagcagatacctttaaccctaataatctcaggccttgatgaaaatactatattttgtagattatggttaaagggggaaaattactagttccgtaagataaatatgagctccatttgacttctgatgtctggtttagcattacataatatgttgatcttacactctgcttttgtccaaataaaatgcaatagtatcaatatcaatttcagaaaaatggactgaatatgcttttttggtgatgaaatctcatgtacgatatttatagtgatgtgcttttattttctcatgagatactaaatattaattgtgttgtacatttgttcttagcatatattaaagttttgaaccaaatgtgttaaagcttacgctttgccatgtaaatttcccagaagttgttgagctcaaatgtatcctacatccagctgtagaaatttgtcagaaattgtttaaattttgtatataattgtactgtttaattctagccattgcgctgaacagtatttgagttaccatataatatggctttacacaaggaaatgtgtggcttttgttttgtattttttcagtatagaagttcctgtgtcttatttaaataaagttattagtaaaactgaaatagttcacacatgtttttggaaagactggggttgttggctcgttacccgacagagagaaattcagctcaggttaatggtagttttctgtactcattgagttcctggcctgcatgtctggaggtgtggggtgtctaactggatcagatttctacaacctggcttcctcttggcatttaacttacacactctccatcacaaggtgagaagctagaggtcttaagttccaagtcttggtactgttcccaggtatgatcacattaaatagagaaaacattgttctcacatcactttatacctcagaatttatagaaatgagtttaaattcaatgaaatcatttcagaggaagttgcatatttcttgcaagcaaagctgcagcaataaaatttaattttttacttttttatttgtttagattcagaataaggtggagaaaagctttacaaaacaaaggagggttgacatcatgcccagttatccagacatggatatggtctggtaggccatatggtagcgtgaaagcaagaacaaaacgctctgagaaataatttatcagcagactgttgttcacttccaaagcgcatctcaaagggataagatttgatctttaaattgaacttagaagtgaccagtagctgtggttttggctgagaaaaataaaacgtaactttttaaatggtgggatgtatcagctgtgttaatgttatttaggcaggaaattttctactttatacaactttaaatttccattgcaagtgaattcatgtgaaggaaagtggaattcctagccccatctcttcttgactcgatcatataataagtaatataaacagccctgagaagttaatacagtatttgcaaaatcagacctcaggaacaaggaggggaatattagtcctaagaacttgcgtgttgtaaccctatgctaaccaaaaataatcacttgaagtttatttatgaatattgcaaactgaggggttacccccatccctcatcctccatcccacagtgtaaggtcgcatctagctctgaagtttcattgtcccctatatattctctacctctctctgggaagcttctaacatctaccctgctctctgatatgcacaagtctcgatttccccctgtacactcactcttttggtgaactcatggttctttggagctgtaggagccttatgaagatggatcccctaattcacatgttgattcaaaatcccactgctgtagtctagaccaacagttccaattgttgagagaacatctcctctcagacttcttgccttatctcaaccttagtgattcagtggaataaagacactgtcttaccccctgttggaccaagccagctctcctttacattcttatttccaaagataaggactgtttcttaaatctctcagatttgcttttctgtcttcctgttatctcaccactgaattttgaggtacagcgacatataatggtggcagatcagagagccatgacaacttagatgaatttctgtgaagactgtaatagcaaggaaccaaagtcactgcgtatgttagacttccactaacctctgtagctataagaccagggccaaacaactgttcctgggccaaatccagcctgctgactgtgtaaataaagtgttcctgaacaaagccacactcatttgcttatggagtgcctatggctatcttgcagcacaatggcacggttaaatagttgcaacagagaatctggcccacaatgcctaaaatatttactctctggttctttgctgacctctactgtacaccaaagagcagactggagactaggtataggtaacttgtatcatatatgtagttgggttttgttttgttttgttttgttttagtcagagtctcactctgtcgcccaggctggagtgcagtggcacagtctcggctcgctgcaacctccatctcccgggttcaaatgattctcctgcctcagcctcccgtgtagctgggattacaggcacctgccaccatgccgggctaattttttgtatttttagtagagacgaggtttcaccatgttggccaggctggtctcgaactcctgacctcgtgatctgcccacctcagcctcccaaagtgctgggattacaggtataagccaccgcacctggcctatgtagacgttttaaaattttttccataaattattttatactcctcccttcaaaaggtagagcttaattttcctctcaagtgtgggttgatttgcttcttatcaacagaatatggcagaagtaatgggaagtcacttctaagaacaggttataaaaagactggttttgtcttggtatttgttctgttggatcacttagtttgggagaagctatattgggaggatactgagaaagtttatggcaggaccctatggtgagattatggaggccccgacctcctgccaaaaaccacaaggaagcagatccttcagctccagccaagccatgagacaccttgagccagaaaccacccagatcaactggatacctgctccaacgcccctggatacctgaccctcagaaactgtgtcaaataataaatttttgttattttaaggtgacaagttttggggtaacttgttacatagggttagagaactaatacaacagccctctctttcccccatacacatcccattatttccaccatcacctagagccttgccatataagtctgtcctctgggtccagaaaatgaagcttgctcttttggaatggatatggcttggcaaagcccttttggagtaggtctaagacaaagctttttcaacacaaaattttgttttttgaacagtttgcatgttagaaaaggatttcctatggaaaatgatgcaagaagaagcaggataggtgatcagtttttagagctgaaaagaataaaaggcagaatttcacaagaaaaggaggaatatctccacctcatatgtcttttagttaacaggaggctggtaacccactggttctaaaatgacctatctcattccatatgcatctctcaaagaggagagtaaaaataattttttttcccaaaggctttagatcagtttggtgatgggctctctcctgcataacagccattttcttaacactaagaatttgaacaattagatcatttttcctccaaaagatttcctgataacaaagagtagatcccctttcgcacaccacaaattctactcaagtcttggcatctgctttaagcatgacattgatgacattcctttagtcagaactgggcatgactctgcaggcaatggatgttatttcaaaccactgtctggaagcaagatggataaaggtgggtacagggctccacaaggacctgccaagtgaggagaagcgttcatgctggaaaagcaaaccttttcttaggttttcttttccactttgtaaaccaaacaggttacactcaagggacaggacttaacaaaggacactgctcatgtactgcaataaacagcctgccatttttcatacggactggaactgaggcagacagggtaatcttagctgactctctgttcacctgcccatttgattccagacaaacacctggtgtggtttctctctcctgcttcccttcccagtgaccactctgcagcaagccccgggagctttgtatgaagaagctattccttttcaaatccctaaccctttctcctgattgctcctccaaatctgtggccagtgcagcaagtcctgtgaagacagtaaggaggtagcaggaggaggctaaaaatggtgacatcaaggaatagaaactggtgagtgagggaagtagagtgttgaggtgagctttcataatattcatacaccttttgaaatatttgatttttttttcttaaaatgagcatgtattctttttgtaatgtttggtaacattacaatgtaaaagacaaggaaacaacatgaccattctgcagaactgtgaacggccctgttccctctgctggttccaacttctacccatcaatttatcatcaaatttgcagcagaaaggggatacaacttagctgactgctttatatatgactaatatgaaagaaaggtgaaattcaaaggaagtgattaacatgaaaataaatgtttaacctcactagtaatcaaagcaacgcaaattaaaacaacaatttggcagggcgcggtggctcatgcctgtaatcccaacactttgggaggccaaggtgggcaaaccacttgaggtcaggagttcgagatcagtctggccaacatggtgaaaccccttctctactaagaataccaaaattagctggatgtggtggctcacgcctgtagtcccagctactcgggaggccaaggcagaagaactgcttgaacccgggaggtggaggttgcagtgagccgagattatgccattgcactccagcctgagcaaaagagtgagactccctctcaagaaaacaaacaaaaaccaacaatttattgcttttaaattggcaaagaacaaaaaaggaaggataatagtgctaaaggaggctggagatatactcttacatctgctattagaaggatacgctggcacatgctttctgaacaagtggggcagcatttatgccaagtgacaaaacagcaggtcacaaaccagtgtgatccgtttgttttataaaaatacatatatgtgtggggaaaaaaaggatgaatgtaaacaaaaatagtagtgttagtagtggttacgggccaagtgcagtagctcactccaggagttctagctacttgggaggcggaggcaggaggaccgcttgagctgaatttaaggctacactccagcttgggtaacagagtgagaccgtgtctcaaaaaaaaaaaaaaaaaagtgcttatcctgggtagataattttttaacatttgcttttctggttttctaagtattctctagcagcacccgttaaccttgtaatttgagagaacatgcatgttaatctctaaatatcaaaggacagaaaaagtagggagggaaaaaaaggaaatggcagcaagacaattttgttttaatgaaaatgactgacatctcttaaaatccaggtggcttaagagaaggcttggtagagtgaactttggctcggtgggagaatcctaacatggcatagtttcaagctttatctcccttcccagaaagaaaacggtcccaacatcctcacactgtaaggtaagcaggattaaattatgtaagcctggaatggggttgaaagtgtctttgggaaaggctgcagttttagttcaaaggacagagcattttctggagtgtggcccatactgacagccttccactcagttgagatgggtttgtgaagtgggcaccagggagtccagaaatctgtcctctcatttatgcttcttgaactgcctcatctagaaaattaaaagggactccttgccgcaagcaaactgtagatgcctgaaaatggccaagagatcattcttgactgtgattcatatttctaagcacactttttattgcaggttgtttggtctggttttacagagattgcctaatgtaggtacatgtgagatggacattgatcctttggtcatagaggtggttaccttagaatttgtattaggaagattgggaataccagcattgaacaggctgcacaggatactttgagaattaccagtgtacaagaccttgggccccttttattaatctttgcatctgtagctggcataagccaggggcacggaaagcaacttggggattcagacatttgcttatttctccttcttggcaagtttctgccccttattcactaggtctctaagaactaggtctcagcacagtgccatctgtgattttggtcagctggcaggccgcacatatgtccctcccacattctggaacccacaggcagtgtggcataagaagaaatggtccagacgttggcatcagacaagggtgagggatggctctgtgagcgtgggagtctttatttataaaatggagataattattccattccttaattagaataataaaatggaaagggtcggcaagctctctggtgtcttccacacagacactaattcttttgtatcaggactccatctttatgacttccttgtaccttaattacctcccaaaggccctatttgcaaatacaatcacacggcagtggggggtggggggctggggggtgggggggttgggggtgggttatggcttcaacatatgaatttggtgggggtggggtggggtaaacaatttagtccatagcaaataggtacttccattaggtagatgcaaattaaaaccacaatgagatatcacttcacacccactaggaaggccataatcaaaaagacagataattacaagtgttggtgaggacgtggagaaattggagccctcgtgcatttctggtggaagtgtaaaatggtgtacttgctttggaaaactgtctggcaattctgcaaaaggttaaatgtagagtaaccatatgaccaagcaattcaattcctaggtgtatactcaagaaagtaaaaagacttaaagatggttgagggcagattcaagatggccaaataggaacagctccagtctgcagctcccagccagatcgacaacagaaggcaggtgatttctgcatttccaactgaggtacccagtccatctcatagggactggttggacagtgggtgcagcccatggaaggtgagccaaagcagggtgaggtgtcacctcaccttggaagcagaaggggttggggaattttctcttctacccaagggaagccatgagggtctgagcctgaggaactccggcacagataccgcacctgtcccacagtcttcacaacccacaaaccaggagatcccctccagtgtttacactaccagggccctgggttttaagcacaaaactgggtggccaactgggcagacaccgaactagctgcaggagctcttttttttttttgagatggagtcttgctcttgtctcccaggctggagtacaatggcacgatctcagctcactacaacctctgcctcccgggttcaagcaattctcctgcctcagcctcccaagtagctgggaatacaggtgcccaccaccacacctggctaatttttgtatttttagtagagacagggttttgccatgttggccaggctcgttttcaactcctgacctcaggagatccacccgcatcagcctcccaaagtgctgggatcacaggcgtgagccaccatgcccagcctcttttttttttttctataccccagtggcgcctggaatgccagtgagacagaactattcactcccctggaaaggggtgctgaagccagggagccaagtggtctgcacctcagcgggtcccacccccatggaacccaggaaactaagatccactggcttgaaattctcactgccagcacagcagcaatctgagattcacctgggacttttgagcttggtgcaaggaggggtgtccaccattgctaaggcttgagtaggtagtttttaaggttacagtgtaaacaaagctgctgggaagttcaaactgggtggagcccactgcagctcagcaaggctgctatggccagtctgccagatttctcctctctagacaggacatctctgtgaaaaaggcagcagccccagtcaggggcttatagcagacttaaacgtccctgcctgaagtctctgaagagagaagcagacctcccagcacagcattcgagctctgctaagggtcagactgcctcctcaagtgggtccctgacccccgtgtatactaactgggagacccctcgtacaggagagctctggctggcattgggcaggtgcccctctgggttgaagcttccagaggaaagaacagtcagcaatctttgctgctttgcagcctccgctgatgatacccaggcaagcaggatggggagtggacctccagcaaactccagcagactggcagcagaggggcctgactgttagaaggaaaagaaacaaacagaaaggactagcacatccactgaaagaccccatccaaaggtcaccaacatcaaagaccaaaggtagataaatccacaaagatggggaaaaatcagtgcaaaaagcctaaaaattccaaaaaccagaatgcctctcctcctccaaaggctcacaactccctgccagcaagggaacaaaactggatggagaatgagtgtgatgaactgacagaagtaggcttcagaaggtgggtaataacaaactcctccaagctaaaggagcatgttctaacccaatgcaaggaagctaagaaccttgaagaaaggttagttgaattgctaactagaataaccaatgtagagaagaacataaatgacctgatggagctgaaaaacacagcacaataacttcgtgaagaatacacaagtatcaacagccaaatcgatcaagcagaagaaaggataaaagtgagtgaagatcaacttaatgaaataaagagcgaagaaaagattagagaaaaaagaataaaaaggaacgaacaaagcctccaagaaatatgagactatgtgaaaagaccaaatgtacatttgactggtgtatctgaaagtgacagggagaatggaaccaagttggaaaacattcttcaggatattatccaggagaacttccccaagctagcaagacaggccaacattcaaattcaggaaatacagagaacaccacaaagatactccttgagaagagcgaccccaagacacataattgtcagattcaccaaggttgaaatgaaggaaaaaatgttaagggcagccagagagaaaggtcaggttacccacaaagggaagcccatcagactaacagcagatctctctgcagaaatcctacaagccagaagagtgagggccaatattcaatgttctcaaagaaaagaattttcaacccagaatttcatatccagccaaactaagcttcataagtgaaggagaaataaagtcctttacagacaaacaaatgctgagagattttgtcaccaccagacatgccttacaagagctcctgaaggaagcactaaacatggaaaggaacaatcagtaccagccactgcaaaaacataccaaattgtaaagaacatcaacattatgaagaaactgcattaactaatgggcaaaacaaccagctagcatcaaaatgacagaatcaaattcacacataacaatattaaccttaaatgtaaacaggctaaatgccccaattaaaagacacagactggcaaattggatagagtcaagacccatcagtgtgctgtattcaggagacccatctcacatgcaaagacacacataggctcaaaataaagggatggaggaatatttaccaagcaaatggaaagaaaaaaaaaaaacaggagttgcaataagaaacagactttaaaccaacaaagatcaaaagagacaaagaagggcattacgtaatagtaaagggatcaatacaatgagaaaagttaactattttaaatatatatgcaccctatacaggagcacccagattcataaagttcttagagacctacaaagagagttggactcccacacaataatagtgggagactttgacacccaactgtcaatattagacagatcaacaagccagaaaattagcaaggatattcaggacttgaactcagctctggcccaagcagacctaacagacatctacagaactctccaccccaaacaaacagaataatacattcttctcagcacctcatcacacttattctaaaattggccacataattggaagtaaaacactcatcagcaaatgcagaagaatggaaatcataacaaacactctctcagaccacaagagtaatcaaattagaactcaggattaagaaactcattcaaaatcgcacagctacatggaaactgaacaacctgctcctgaatgactactgggtaaataatgaaatgaaggcagaaataaagatgttctttgaaaccaataaaattgaagacacaatgtaccagaatctgtgggatgcatttaaagcagtgtttagagggacatttatagcactaaatgcccacaagagaaaggaggaaagatctaaaattgacaccctaacatcaaaatgaaaacaactagagaagcaacagcaaacaaattcaaaagctagcagaagacatgaaataacttagatcagagcagaactgaaggagatagagacatgaaaaacccttcaaaaaaaaaaaatcaataaatccaggacctgctttttgaaaaaagtcaacaaaatagacagtctgctagccagaccaataaagaagaaaagatctaagacccaaatagaatagaatgaaatacacacaataaaaagtgatatagggaatatcatccctgatcccacagaaatacaaactaccatctataagcacctctatgcaaataaactagaaaatctagaagaaatagataaatttctggacacatacaccccccacgtctaagccaggaagaagtcgaatccctgaataaaccaaaaacaagttctgaaattgaggcagttattaatagcctaacaaccaaaaaaagtccagggccagatggattcacagccaaattctaccagaggtacaaagaagagctggtaccattccttctgaaaggattccaatcaatagaaaaagagggactcctccctaactcattttatgaagccagcatcatcctgataccaaaacctggcagagatacaacaaaaaaagaaaatttcaggccaatatccctgttgaacatcgatgtgaaaatcctcaataaaagactggcaaactaaatccagcagcacatcaaaaagtttatctatccatcactatcaagttggcttcatccctgggatgcaagtctggttcaacatatgcaaatcaattaatgtaattcatcacataaacagaaccaatgacaaaaaccacatgattatctcaatagatacagaaaaggtatttgataaaatgtaacagcccttcatgctaaaaactctcaataaactaggtattgatgggatgtatctcaaaataataagagctatttatgacagacccacagccattatactgaatgggcaaaaactggaagcattccctttgaaaactggcacaagacagggatgccctctcaccacacctactcaacatagcattggaagttctggccagggcaatcaggcaagatatatataaagcaataaagggtattcaaataggaagagaggatgtcaaattgtctctgtttgcagatgacatgattgtatgtttagaaaaccccatcgtttcaacccaaaatctccttaagctgataagcaagttcagcaaagtctcaggatacaaaatcaatgtgcaaaattacaagcattcctatgcactaattacagacagagagccaaatcatgagtgaactcccattcacgattgctactaagagaataaaatacctaggaatccaacttacaagagaagtgaaggacctcttcaaggagaactacaaaccactgctcaaggaaataagagaggacacaaacaaatggaaaatcattccatgctcatggatcagcagaatcaatatcatgaaaatggccatactgcccaaagtaatttatagattcaatgctatccccatcaaccaaccactgactttcttcacagaactggaaaaaaactactttaaacttcatatggaaccaaaaaagagcccgcataaccaagacaatcctgggcaagaagaacaaagctggaggcatcacactacctgacttcaaactatactacaaggctagagcaaccaaaacagcatggtactactaccaaaacggatatatagaccaatggaacagaacagaggcctcagaaataacaccacacatctacaaccatctgatctttgacaaacctgacacacacaagcaacggggaaaagattccctatttaataaaaggtgttggaaaaaactggatagccatatgcagaaaactgaaacttccttacaccttatacaaaaatcaactcaagatggatcaaagacttaaacataagacctagggccataaaaatcctagaagaaaacctgggcaataccattcaggacataggcatgggcaaggacttcatgtcaaaaacaccaaaagcaatggcaacaaaagccaaaattgacaaatgggatctaattaaactaaagagcttctgcacagcaaaagaaactatcatcagagtgaacaggtaacctacagaatgggagaaaatttttgcaatctatccatctgacaaagggctaatatctagaatctacaaataacttaaacaaatttacaagaaaaaaacaacccaccccatcaaaaaatgggcaaaggatatgaacagacacttctcaaaacaagacatttatgcaaccaacagacatatgaaaaaatgctcatcaacacgggtcattagagaaatgcatatcaaaaccacaatgagatactatctcctgccagttagaatggcgatcattaaaaagtcaggaaacaacagatgctggagaggttgtagaaaaatacgaacgcttttacactgctggtgggagtgtcaatgagttcaaccacttcagaagacagtgtggtggttcctcaaggatctggaactagaaataccgtttgactcagcactcccattactgggcatatacccaaggattataaatcattctacgataaagacacatgcacacgtatgtttattgcatcactattcacaatagcaaagacttggaaccaacctaaatgtccatcaatgatagactggataaagaaaatgtggcacatatacaccatgcaatactatgcagtcataaaaaaggatgagttcatgtcctttgaagggacatggatgaagctggaaactatcgaactatcacaggatcagaaaaccaaataccgcacgttatcactcataagtaggagctgaacaatgagaacacatgtacacagggaggggagcatcacacaccaaggcctgtcggcgggtggggggctaggagagggatagcattaggagaaatacctaatgtaggtgacgggttgatgggtgcagctaaccaacatggcacgtgtgtaactgtgtaacaaagctgcccattctgtacatgtaacccagaacttaaagtataataaaaaaaattttaaggaagaaaaaaaaatccactttttttttttttttttgagacggctggagtgcagtggtacaatctcggctcactgcaatctccgcctcctggtttcacgccattctcctgcctcagcctcccgagtagctgggactacaggcacccgccaccatgcccggctatttttttttgtatttttattagagatggggtttcaccatgttagccaggatggtctggatctcctgacctcgtgatctgcccgcctcagccttccaaagtgctgggattacaggcgtgagccaccacgcctggcccatctacattgtttttttacaaaaaatttaaacatcattcttatcagttctgagaatagtgggagccctcaaaaaaaaaaaaaaaaaaaaaaagaaaaagaaaagaaaagaaaaacatgtctacatgaaaaccaagtacacaaacgttcatagcagcattgttcataagagtccaaaactggaaacaatccaaatgttcatcagttgatgactgcataaatcaaacgtgtcctatccatacaattgttattcaggaataaaaaggaatgaagtactgatacctgctccacatgaacaagcctttaaaacattatgctaagtgaaagaggccagtcacaaaagactgcatactctataatcccattgatatgaaatgtccattataggaaaatttgcagagacagaaagtagtagtggttgccagggtctggggtaggccgaaatagggagtcactactactaagtacaggctttcttttgggagtaataaaaaatgttctggaattagataatggtaatcgttgcgtgaccttgtaaatgtactaaaagctactgaatcatatatttaaaatggtaaattgtatggtatgtgacatgtattttaatttaaaaattcacgtatgcaaagaacctatgccatagtatagttaagaggatgaaatgggcttatgtgcacatagcacagtgcctggcatagagtgactactccatggacgatagctatttttatttttcatagtccatgtagggtcagagtgaagagaataaacacacaaaggtggttcatagctcaaggccattcatccaacaggagggtggcctacttccttcctctgttgtcttctgttttcctgggtttcagtacgtgaagcagtcaggcgcccgaccacactgatagcctgtggaagaggccagagtacgcgcactcgttctccaccgtcttccctgctcatcgtgatcctgtgtgcccagttctcctcaccctgcccagacctgaaaagcaaggccaggacaccaggggacttcaggcttcagccttggcccattcctgtcttttcaaggtgctttctctttaaccacacacctggtttgtagggcagaacaactaggctgcttggctctgggcttctcaccacaggttcaccgtataagcccaagatcaagaagcaagggctcccttcagggctgcttctgagggcaggtaacagatgggtggcaaactacaggtagccagagcttaggctagtgtgttgtcaggatttgttctctccctgctagtttcttcctttctagctggagccaaagtcacagcttacccaggatggcagctcctattggcaagacaaaaatacacctcagtttgactgctgaggcccacacatggccaactcaaccattaagggcaaagagagaggaccaagaacaaaatggctgttacttccctgtggtgggaaaagggaccagaggaacctccagcttgcctacacgtttgctgtgggctgttagcgctcacgagaggtttcaagcactttggtgccctctgcatcagcacgaatcctatgatgagcacaacttttctgacttgttttgttcatccacccctttgagaatatatggaagctctagaccatttcatcaagttaaatatccacacaggtgcattttcacaaaaacttacatatctcagaggatgtacagaaccattgaggccaagggctccataaatctctggaccagaatagattttattggaacagatcagaaagagtttataacccagccatcagaaatagcagtgaatttctggaagagaatagaagcaagggtgttgacctgtcaagtgctgtgtatgtcctaggaatgccttctgtttgtgccatggacggaagacagcggaggaaactctcagtgcagaacagatccttggggtgccacagttcagggccagatatatcagcaagaagacacctcataccaaaatgaataaacagttccctgtgaagtagctggggaaggaagccccagagggctgatagataacccagcctgggctgaggaggcattcctaaaattagttgcctcctcactggctggcagaggggggcctgggtgtaagaccctgtcttagtctgttgtcacatttctataaggaaatacccaagactgggtaatttataaagaaatgaggtttaattgactcacagttcctcatggctggggaggcctcaggaaacttacaatcacggggtaaggcaccccttctcacaaggcagcaggagagagaatgagtgccagcaggggaaatgccagatgcttataaaaccctcagatcttgtgagcactcactatcacgagaacagcatggggggaactgccccatgattcaattagctcttactaggtccctcccaccacatgtggggattatggggattagaactcaagatgagatttgggtggggacacagccaaaccatatcagaccctatctggttttagaggtttcctgaacagttccaatcagctctctactaggacaaatcatgaagaagttgcccccgctaataatgaagccagtacttacccaacactgagatggtgtcagcagctgcatcccaacaatagaagaagggacatccagtggtctggatattctactgaaatgctccaagagtgacaggcaataggagcagggtgggggatggggaggaagacattgatagagagagcttgaggggctccagaatttgactgagtttaatcatgttgtcaaggagaatgcctgctggttcaatgactgtggctaaatgcttgagaactctagagcaagcactgggacatgttgagaacagtggggccctcagatcagtttcttaccaattatctgaggataggacataggtgtttattttgtattaaggccaaagattctattttcagaggagagtacaaagaggtgcaactgatcaaagaaacttagaaaaacagctgaagtggagccatgctcagtcctcacggggcagtccttacagagattcagtaccctgggctggttgcatggtccacccactctagctgtgcacccctctgctgcgtgtcttttctgtgcccctctgccctggttgctcagagtttcctattactcaagactcctattgctctatagtaactgtgcattgcttttgcttgtattggtatctcttgcttttataattgacaaactgtttcatattatcaccagctaagaatcaaatgagagtgaatatgataaactctgagtcttctcttggtgaaaagtgattccgcaaggcctaccacattggcttcctgagctagtcagctgaatgcaggaggtcctgtggctcacagcatgacttccttgcccaagactgtttctcctggcaaaatgggagccaggattgcttagaagtgggggacgtggaaatgacagtcatcttgaattttggtctttttgatacattcacttggaatgtttccaacctcctgtaagaagacaactgccagtattacaagacccttgtctactaaaagcaaaactgcacacaaagaaaaccctactgtaaagcatgttttcttatgtcctttgaacaaagtagactttattgttgcaaagtttgcaacccattttaaagaccaacaaactttataagagacgatagtgctaaagaaatagtccatctatctgatcccacttcccaggcccttgcaattaggcagggccatgtgactggttctgggtactggagggaagagaagtgtgccctttctaggatgaaggataaaacagccaatgcgtgactctcagctcagcttttccttgtggctgtgatggagagattcctgtgttttatgtgatcagctgtaggccagtgatgcctttgtcagcttgagcacctgaggatttgtggggcaaagcccactgagctacattggaaatagagcacaaaagggaaaggaagcaaacttcctcgttttaaatcacagggatgttgtggtgattttgcaaaacataacctggcctgtcctgactttacacagaaggatgctggcagatccccgcaggaggacaccggtgtgagtagcactgtctaccttggagctggaggccaatgagactccctaatctacaactcaggctgagtctctcagcttcaggtaacgtctcagaggtttgtcttccccgtactgctggcatccctctgtggaggacccagaatccaatttcttttttcttttttttagcatcatacttattgaggcataatttacacacagtacaatttcctctttttagtgtacacctgtatgggttttgacagatgcatacagtcatggaaccaccaacacaatcagtctacaaagagttccattatccccccgccaaattctcttgtgtccctttggaatgaactcttcctctaacctcagacttgggcaaccactgatctgatatctgtccttataaggttttttccaaaatgtcatacatatggaatcacacaatatgaaggttttttttttttttttttttttttttttttttgagacggagtctcgctctgttgcccaggctggagtgcagtgacgcgatctcggctcactgcaagctccgcctcccgggttcacgccattctcctgcctcagcctcccaagtagctgggactacaggcaccggccaccatgcccggccatttttttgtatttttagtagagacagggtttcaccgtgttagccaggatggtctccatctcctgacctcgtgatccacctgcctcggcctcccaaagtgccgggattacaggcgtgagccaccacgcctggccgccattttttttttaatcagctttttattttagaatactttgagacttacggagaagttgcaaagatagcacaaagttcccatatgccctttaccctgcttcccatattgttcacgttacatagcttgtcaaaattaagaaattaacatttctacaatactattatactatatctactattatactatactatactatataaagcatagactttatttggattcaccagtttttccaatgacgtcctttttctgttttgggatctaatccagggtcccccaacttagcattaagttgctgtggctctttagtttcctcccatctgtggtttctcagtgttttcttgtttttcatgacctggacacttttgaaagatacgtatcaggtattttgtggaatgcctctcaatttgggtttgtttgatatgttctgacaccaagcttggggttatgaatttggggagagaatagcacagaggctaagtgcccgtcccactgcatcatggcaggggggcacatgatattgctgtggattatcatggtgttgtatcaatattcatatttgccactaaataatattccattgtatgcacataccacatcaattgaaggacatttgcgtgctctcagtttgggagattatgaataaagccgatacacacattcacatacaggtttttgtgtggatatccctttttctttctttcccttcagggtgaattcctacgtgtgggattgctgggttgtatggtaagcatgtgtttcactttctgtgacactgccaaactgtttccccaagtggcttccatgttaacattcccatcaacaatgcatgagaattttaattgctctgcatcctgatttctgttcatcagtgttccaattagtgatttgttctcaagatacctttaagattggtgagttttgtaatgtgtcccttttgtctgtggacacaagaatccacttcatatctcctagtcttaccacagaattttgtccagctttatggaaaaatcaggggcaacttattcaatagactttctagtcctgtcctcctccctccattcccataatatttatgaatgaggtaataaatgatgggaacagaaaagagagcctggcatgtcttatgcaaggtaattcattaggagagggtaggaattttttttttttttttttttttagatggagtctcactcttgtttcctaggctggagtgcaatggtgcagtctcagctcactgcaacctctgcctcctgggctcgagcgattctcctgcctcagcctcccaagtagctgggattacaggtacacaccaccacacttaaataatttttttgtatttttagtagagacggggtttcaccatgttgggcagctggtcttgaactcctgacctcaggtgatccactcacctcagcctcccaaagtgctgggattacaggagtgagccaccatgcccagccacatttttaaaatttagttaaaatttcaaaaattgacaaatagctgtatatattcatgggctacatagtgatgtttctatccgtataatgtatagtgactacatcagggtaatcagcatatccatcatctcaaacatgtatcatttctttgtattgggaacattcaatatcctccctctaactattttaaagtatatgttattgttaactacagtcagccttcagtgctatagaataccagaacttattctatctagctataattttgtgccctttaactaatctctcccttcccccttccaacattttaccaagagagtgaactttggtggcacatttctccacacttgagtgttgctgtgtgcaagtacaatgctaaagtctttggggacatcaactcaatccttgtaatgactccaagtggcaggaaatgttactattcctattttatggatgagaaaacaagcttgagagggtatatgacttagagcaggcggagcccagttggccacagatttgtctggcttcagagcaaacttaccaactgtcctaaatgcttctcctggatgctatccccaaaggatgtacttaataactaacttctgaaaaatgaaaataaaagcagtcatgaaggacaggagttttccctgtttttgcatttgaattgctttctacaacttttaatttctagcaaacacttaagaagcattggcctgggagtcagtcctggaaaaccaagactagtaaccacaggaatgtgattactcgtcttgggtttccttaactttaaacctagttctccacgtccctttggtctcctcagtttcttcacatagatatgagcaggttggaagcaaaaagctctaggactccttttgtgattccatgaagtcagcaggaaggtcagtattctcaatgggccactaagagctccaagcttccagccccagtgcctgctggggagtggcctcatggcacaggtgggaggcgcctaataggggggtttttggaaaccactgcagttctttaacaaccctgtttcatagccctctggaaagactggaaaagcatttcctgaaagtcctccactggaaactagagtggctgtcttgtattttcctgcctaacatccatttttttttctttctctagtaacagcatcccaattctgccttaaggaactttctctattcttggtccttgagggtgagactccagtgcctgaaaagctgggcacacagcccatttcccaccatgactactatggtttgaatatatcccccaaagttcatgtgttggaaatttaattgccattgcaacagtattaagaggtgaggctttaaagaggtgattagtccaaaaaggagaatctccacccctttcccagaaaactcatgaataatccaccccttgtttagcatataatcaggaaataactgtaagtatactcagtcaagcggcccatgccactactctgcctatgactcgagtagccattccttattcctttactttctttttttttttttttcttttgagatgcagttttgctctttcacccagactggagtgcagtggagcaatcatggctgactgcaacctgcgcctctcagattcaagcaattttcctgccttagcctcctaagtagctgggattacaggtgcccgccaccacgcccaactaatttcttttagtagagacgggatttcaccacgttggccaggctggtctcaaactcctgatctcaggtgatctgcccacctcagcctcccaaagtgctgggattacaggcgtgagccactgcgcctggcctcctttactttattaataaacttgttctcactttactctatggactcgccccaaattctttcttgtgcatgaggtccaagaaccctctcttggggtctggatcaggacccctgcctggtaataatagcaccatgcataagtcctgcctacaggcccaccgacgcctcgggccgcctctgagtagatcacgtctttttgggaaaaaccactgacaaaaagtgctggttcgtcctaagttggtgcatttctaattctgaagctgacgggtgcttttctcactttcccagagctcaaaaatcaacttgatatttctaaaattacattttgaaggaaatgaatctataaggtacaccaaaagcccaagccagctggggaaagaagaaagaaggaaaaagaattttctctggctccctcccttaaatttgtatattctttaaatcttggctgggggacagggaagggagcctggcagaccaccccacctggattggcaggaaagctttccaggaataggtgctctctaaatcgccccaaagggttcagtgcaactgtgattcagaccaggctctcatcatgaaatgaaaatgagggacatgtgggagtgtacaggaagagggtacaggaagtgtacaggaagagggtagcgtacctttgtcttcttcataccagggccagtccttgggtggctgaggagggtccgggaggtgcgtcctggaagaagccctttggccccgcaggcacgcaggccacttaaaaagagaatcaggcagcagctgctgctgtttaaactgaaaaggtggtccaccggctttgcatgagcccggatcaaaacacgcatatcaaaagggatcaagatgctggccaagtggattgcagttagaaaagggaattgaatcttttgttttttttaaggtcaagaaaatatggagagaaaatgcctccatgtgcaattctttccttgtccttgtagtgaagcttgtccagctaccacaatcctctcccctccacccaaagagcaacttttaaatgccacctgttagtatttaaagtaatccattcaaaatagatgaaccccaccccctttgctgtcccaccctttcccccaccaagctctctgggcctctagcctggacggagcgagtcagtgcctcgtccctcatcttcttactgtggttgcagggttttcacagctgcaaatgtgacccaggatgaaaccaggactgagtccacattccatgaagggcagcttgactcccccaatcattaatccattgctgacgaggtgactgcagggtgctgactgccggagagacagagatttggagaaacagggagactgttctttggggtcatagcacctagtggtagaggcagatacataaagcacagtccttgtgaggccagggcaagcaccatcctagtgtcgctgtatgagatgggagagaggcaggaagggagggcaggagctgatgaagtgtcacggagaggtgagggctggttcctcacaggagacctgggggatgcacttggagaggtccttgtggagcacgtcggctctacagaggctctggaagggtaggtggggttgtgatggcatcccagcagacgtgcacagcaaacacacaggcccagggtggggagcagaggctgagggtacagcaaggcctcctgtgtgagtgcgggaaggctcacaaggtgaggctctggtactgaactcttcatatcctcaaagcccaccaatgccgggttgaggaatctgctaaatgagattctaacaaaggagaccccctggatagctgatggtaggcccggatgttagtggggttccgtgagctccctaacatgccccatttcacctgcagtgcactttcctgtgcagagaaagaacacctcaacagtcccccatctccagtcctccaaggtgtcttgtagggatggaggtgattgctgtggccaggtccttccatgagccgttcctgtatgtgtgtgtgtgtgtgtgttacaggaagtggcctcaggaagccctttcagagctgggcactgaagctgcaggagtccaggagagacctcctggcccaaccaagcatgtggaaccatctcctggggcagtattagattccacccctactctgggcctctagctcattgaaaggggtatacatgggcttccacagatctgtgtgggccctcggcaggtcacctgtgacatgtgtggcagggagaggtgccagctctggggtctctaatagtggcagagtatccgagctgcccaaatgtaaaactgtggctcccacccctgcctgatccttcaagccccatgttgtccttcctgctgctgccttatctgggtggtacatggggtcaaatcaacagcttcaaggctgcagttgggacccatccttctcctctgtcccactcccacacccacacccagagcactttcctcagcacatcactgagtccccacaacagactccataaacttgactttgcatgtcaaatatcttttctgtttaattaaaaaaaaaaaaaaaacaatgtcacaagaggcttcagaaatacatgcttttgaattccagccacgaagaggacaaaaggagacagtggtatctgcaaatatggctgctttccatagtaaggtttgtgccttggacagaagcccagctcctccaccagtgtgagaacacgtggcccaccaggcacctgctgtggggacagtgtctttggttggccagagcttcatccagagctcactggaaggtggcttggcaggaagagggaatcttcctacagccctcctccaagggggacagaggctgggggcagagaaggaggcatttaagctttgctagcctcctgctgcctctgaggctgtaggacacgtcattcaaacctaccatcaaagtaggcttctgatttcaacttggatctcacggtagcccagtgacaccgcagcagccatgatgggatgtaggcaggagagcggtggcctggaaaccgcttctagacaatcctgtattatttagatccacatagagatacacgaaaaccctttataccaaataagagtaaataattataccaatataaacagggccgttgaccctttcattttattaaaatggcacataattattaaaacagcatactgatcactttatacttctgctagcccccaggggagctgctgggggcggcatgtgagtgccctcccgaagggtacagattcatgcattgagcaattcgtgttctttatcggttttcccaacagcatcaggatttgagagtgggtcgaggtcagcgaagaggctgaaccaggcagtcaggtctgaggcagccttagcaggttctggggagagaagaggaaacatgagcaaacgcaccttccaaatgtccacctctgccatgcgggatgcaggcaggtccaggtcatcttcaaatgcagattgttcaatcagacaaatccctttgcactctctctgacaatagttagggaattccaactcccgtggctggttggccagttaacatttccaaaccagggcctgaagctccgagaataacaagctcttgtgttaacaaactcccacctgcaccccaaccccactaatggccatagcccatgaaaagctgatcaaaccctcgggccctgccacttcaccacaaccaggaaatagcatagttatttcagaaatcagactgaatggctgaggaagcaaggggctttccactgtctgctggaggaatcttttcaaatctgctgggtcaggagaaatattatggccactctttctacccttcaaagcaacaggcccaaaagtgtttggcgcccaggcctggcttctcctcttctctcagggtcactgccttcttcaatcctttcctgttaaaaggagggccctgacatgccttcccttctcccagggggtcaattcccctcactcttcagcctcattggaatactcccttctgctcttccacctaaacacctgccctaacttcctgaataccacgattatacagccaaattattttccagatgaggagaacattttcaaaagagtgcctcatgcaagtgatttctaaataagatgaaggctttgtttaaaatacataaatcattccacatgagaatctaagttcattggcttggatgacctgtgtttttttcttctccaacaggtgggagtgtcagaaacatgaagaaaacgtctctgatgggtgatccttctagctgagagcagctaggaatgtgcttgccatctggctgaaaagagtctcaggaagtgttggtaggacaagttgctaaaagtggttagtgaggggatagaggcaatgggattatatcagtataaacagggcctttgatcctttcatcaaaatggcactgaaatgctaagatagtgtaccgatcactttatacttcggattcccctccctctttttgtaaaaaaagtcttttgtagatattaatgtatctacatgtaaaaatcagtgtatctatgatggtgagaaaactatatcaagactagtgggtaatatgcaagttattactatgtaacattgaattccatgtgcaattagccctggaatcatctggtttatcttgatatgagtatcagagacaagagagctcactgtagcttagttggagggggagtgggcagggtattgcctaaaaaaaggcaatactgatttcgctggattagcctatctctattcttgctagaggatatcaaaatatcttaaagacgactctagtgaaaagatgctacatgcttgtttccccttccttctaacctcctcaagggtcttaggaggtcttctgagcgttctcatggccttgccgtgaggagccagtgattgtgctttgggacaatcctcacattccccaggcagccactgttggagacaaagcaggtgcaacttatttgcataacacttaaaagagcatcatgggaacattttttgatgataatggagtacacacttccttcaacttcctgtggccaacaagagaaagtcagtgataccaaagaaacagagctagagctgcaaacacagatgatatcttcagtcgagcagaggctcccttgggggacctgtcccaaaagagaacagatctcatgaacttgaaatgacctcttttgacaactatgaaacctggccctttctgaggtgcacaaattaaatgccctatttggtggtggcaatggtatttctggctaaaaatagcaaacctcagaggcctttcataccttggtatttccaaccaaacttggggaccacccaaccacatgtagatatttgactcatccacattaggtacaatttgataaagggaattatgaatgaggacattaagccagaaaaagaagtcagaatgtaatttctgggattatgcgaaattctccatctcatagccctgtcttgagccctagatgttcaaatggaaattagcaaagtagtacagaaaacaggttaggccactggaaaggaaggcagctgtcatttcagagagacaaaatgctgttattacctttcactgcagggctgttgtcatttggactgcttgtctttggtactggccatggagtaggagggggattgacattgctctctgaccagtctaatattcaaaaccagagcatatcagatctagtgaagaagtcacatggacccaccagttgatggccacatccgtggttgcctccgaataaaaataagacatttctcccatgttcctcatactggaatacatttgaggagataggagatatgcatcatcgaacccaatccaaaaatatgaaaaatgaaggaaaaggttagattctgaaaagcaaataaactattgctatggataaggcatctttgctttttagctttatttatgcccatttttcttctcaagcacaatcgtttcatgatcataccaaagattatcagtggtgctctaaggaaagcaggtgccttgtttttctgtcacaaatggggaaaagcttaaaaaagagaacaccattaaatgaagcaataggactagtaactgcacatcttctcgacttccaatatgatccagtccttttattttctacacagctaatttaaattgggagatttaattaatacagataagtaaataacagtccagtccaaatatatgagggggaaagaaatccctcgttaactttatgccccccattacaatggtatttggcttgtgatatggttaggctttgtgtccccacccaaatctcaccttgaactgtaatccccatgatccccatatgtcaagggagagactaggtggaggtaactgaatcatggggatggtttcccccatgctgttctcctgatagtgaattctcgcgagatctgatggttttataaggagctcttccccatttgctccacacttctccttcctggctccttgtgaagaacatactttgcttccccttcatctttgccatgattgtaagtttcctgaggcctccccagtcatgctgaactgtgagtcacttaaacccctttcctttataaattatccagtcttgggcagttctttatattaatagcagtgtgaaaacggcctaatacacgttgtataacccaagcacatgttctataatgcctcttgtgccctgcctgccccagaatggttaagaggcattcagcactcctgttttagggacagcaaacctagttccacacagcatttactgtctgtcctggaggttttcacatgactcatatttaaagcagaactttaccataagcttctttgcacctctgctttcattgtatatatgcaagtcttaccttctcaatgagacaaggaattttttgtttttcaatttgctccaaaatacttaacacagcacaggtagatgtttgctgattaaatggattgttgattctcactataaaatgtagaccatcagaggatgcatcactgttgggatcattgtgcttaaaactgtatccttttattggcatactctcgtcacagtgttttttaaggaaaagatttgtatctgataaggccctcaagagagatcatgtttggaaggcgagttcagatggggcagtgaaaccaatgtccagagcaagaatgccactcagtatatggcacaaaaagtataggatttaatgccacttgttcactctgccattctaagctttacactttccagtggacttcattacagaattacactctatttcttagtttacactttcatctcatttcctagagtcctgagcccctggaagccagggacaatgtattattcatctttatatcctttagtgcactgaatgctacacaatgggtgttcaaatatatgactattgcattaacataaacagagtactcttttaaaccgtgagtatacttctaaagcattattttaagagatggcaaagcagtacctggcacatattcattattacaataatactcactggttgaagtatttcattttaggcaaatggcacaaacctcacgaacttatttatcaagactaacttaatgaaacaggtggcctgcgacctatttactcaatctagaacaatgaaaaaatacgaagagttctaaaaggcattgttattcattggaaaggtgtttgaacatatacataacagaattcacaaacaatcaaaagtactaggcttggagggagctatctgggaccgtggaaatgttctaacactggactgtggtgaaggctgcacaatataaagttacccgaaatccttgagctgttctcttacagtgggtgaagttttggcatataaattatactgcaataaaacgattttttttaatgaccagtatttggtgtaatccaggaataacataacctccctggttcctagaaaattggcccctgaccattttccttctagacccaaatcacataaaacagtggtaaatgtggaaagttaaagttgtggtttctgtgtgtgccaaataatgctgatcatagaaaagctgagaagtattgaatctaactggtaactgtcaccctttccttcaatccttctccaacactaagtgtacccaagacccacctgtccccagagcccatgccacctttcccctaacccctgcagcttgccctcagtctctcagaaccatggttctcacaatgtgggccctcaacagaggcatgggcatcacctatgtgctggttagaaattcaagctcacgagccaatgctgacctactgaatcagaatccctgcaggtagagcccgggaagattttagcaaactctgagtgattgttatgtaagtaaaagtttgggaagcacttcctcagttggtctctgaggctgcctaggtcaccatttctattagaatcacaggatgccttttgggccagtgtgaggacgagagaggttctcctaagaatcagaggggcccacttcaggaccccacactcccaggcagctgactccaaatcttgcagctttatgctcttcgatcctatggtcctctgacagagttcctggagggccaggagcttccagagagaacttgaactgactcagtaaagccaggtgaggagtagaaacccctccctgatctctgtatgctatgtgacacaatgggaactcaaacaagatcattcttcccatttcaaaaacatgcacgacactcagctgcagagaacactggaaaaaagaggcagactcgaagcattatatttttcaaagtatgacatgaacgcattcctaagaggaggcagaaatcaatttatatgtcaaaatggaactcacttcccatcatgtaatgtgcgtgttcttggaaagctataaataagtgaaacatctgtgtatcaagtcatactttaaaagaagccagaggccgggtgtggtggctcacgtctgtaatcccagcactttgggaagccaaagcaggcggatcacttgaggtcaggagttcaagaccagcccggccaacatggtgaaaccctgtctctactaaaaagacaaaaattagccgggtgtggtggcgggcacctgtaatcctagctactcaggaggttgaggcaggagattcgcttgaacccgggaggcggaggttgcagtgagccgagatcgtgccactgtactccagcctgagtgacagagtaagaatgcatctcaaagataaaagataaataagaggacccaggaatacaaattatattttcaaacatgtgatttaaaagatgataatggcagattcctttatagacaaaacagatatcttctacttgaattc

SEQ ID NO: 193 - DNA, 1924 bp, Homo sapiens
tctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatggaaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcctctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattactgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctccaaaaaaaaaaaaaaaa

SEQ ID NO: 194 - DNA, 722 bp, Homo sapiens
gtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatcccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaaaaaaaaaaaaaaaaaaaaaa

SEQ ID NO: 195 - DNA, 657 bp, Homo sapiens
ggcacgagggaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagctccgcagaaatgattccaaaacccagggagcaaccactggccctaccgtgggacttactccctcctctcctttgagaggcccatgtgtcgctggggaggaagtgaccctttgtgtaactgtaaccgaaagttttttcaaaaatcctagatgctgttgtttgaatgttacatacttctatttgtgccacatctcccctccactcccctgcttaataaactctaaaaatccacttgtatttaaaaaaaaaaaaaaaaaaaaaaa

SEQ ID NO: 196 - DNA, 823 bp, Homo sapiens
gggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctctt

SEQ ID NO: 197 - DNA, 511 bp, Homo sapiens
gtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagcaaaaaaaaaaaaaaaaaaaaaaaaaa

SEQ ID NO: 198 - DNA, 1668 bp, Homo sapiens
aggggttacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtcaaaaaaaaaaaaaaaaaa

SEQ ID NO: 199 - DNA, 579 bp, Homo sapiens
acgaggggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaaaaaaaaaaaaaaaaaaaaa

SEQ ID NO: 200 - DNA, 540 bp, Homo sapiens
aactggtaatagaatttattcaaatgtgccttaatataggcgctggggcttgcccatggtgctcttgatatataaggcccggacattctgccagtttttcttgagcaatgacaccaagaagttgacagccaggtgaatgttatacacaagctcatcgtctgtcatcttcacgtgaccaacagctacagccagacataacacctgggaggagggaagagaggatcaagtcaggttggtggacgaatagcagatggcctgtccttcctcccccagtggcctggtgagcaggtacttggacccgggccaagaccagggttactccaaaagtttcaatcctggtgggtgctcttactggcatatttagagacttggataagatttagaccctgccaacaccttcacccatagcaacccgccagacccactcaccttcttcattgggaaattgattgtggacttcacctcatccactttggccaccatgttttcgttgtgtgtgagcggggaagggaactttcctgccttatttaaacctgggcc

SEQ ID NO: 201 - DNA, 2705 bp, Homo sapiens
accgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaaaaaaaaaaaaaaaaaaaaaaaaaaaa

SEQ ID NO: 202 - DNA, 629 bp, Homo sapiens
ccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgtgatgctttgttcccaagtgtgaccctaaacttaagcttgtaggagtgacattctttcatgtcccttccctttactcatgccgaaactatcaactgggacatttgtgctttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagcctggttataccattgtcatggacccctgtcataaagccatttcttggttgttgggaaagaggcatatggggatttatacgagattcacttgtaaaattgtcggattgcggattttcgtgtaaattttctcaaataaaggctagcagaaa

SEQ ID NO: 203 - DNA, 1146 bp, Homo sapiens
  misc_feature 303: n = A,T,C or G
caaatatttgyrttttctcagcggcsgcgggtcctgggtggctccggcacgccaggmccgggaaggrcccggcaccctcccctgaacttcctggctactcatttccagcgaagtttaatctatttttaataatcgttcagttttcaaggaaatggaggagctgttttttcccacggagcggcggccctgggaggggccgggcccagaggttccggccgcgatgccgtcagcgccttcggcagagtgactgaagcgagatttcgttctcagaagtgagatgccacggtttcgaggggccggggngggggcggcgccgcggggccgcagccccgccccgcgccccgaccgcgtcacagccaaagccccgccggggtgcgcgctgcagaggggacacgccgctcatcaactggggccgccgcgcgtcggtcggccggtggcgggcggcaggggagaggtggggtccgggacagccgcggcgcccggtgtcacccgcgaggccgccccggtggtgcgtggggggcggcgcggggcgcggccgggcgctcaaaactcctcgtgcacgctgcgcgcgttgtccaccagcttgctgcccgtgaagaactcgctgtwcttgagcacctcctcgggctccaggtggtggttctggttctcgtcggcgacggcgatcatctgcttggcctcgttcagcgcgttgtactcgttcatggggtccatgttgctctmcagcwcctcggcggtcacgatgccgtcgtggttggagthaatgagctcctcaaactccttttttctgtctttcacccagttgtcgtcaatgtcctggccctgctggttctccacggtgcccacgggcagggagatgaactcgggcacagararctgcttgtcaccgtcctggtccaggtcccggacgatctccttcaccatgaacctgagcattccccggctgtgctcggggtggagggacgamagggactcctcctccgtcaacagccggtctgcaggggggctgtccgcctggtamcagcggtccttcaggttctccaggacttcctgtgtttctcgttcactttgagttctcgttgagcctgaagggkcggcaactcttctcgcwwggcctttctcgcaaaaacttmhcttatmtcktcc

SEQ ID NO: 204 - DNA, 833 bp, Homo sapiens
gtggggccgggcggccgtgtggcgcggctgctcgccccactaatgtggcgcagggcggtttcctcggtggcggggtccgcggttggagccgagcccgggcttcggctgctggccgtgcagcggcttcccgtaggagcagcgttctgccgggcttgccagaccccaaactttgtccgcggcctgcacagcgagcctgggctggaggagcgggcggaggggacggtcaacgagggacgcccagaatcggacgcggcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatgtacaaacacctgaaatgtaaacgtgaccctcatgttaagatagaagggaaggacactgatgactggctgtgcgtggattttggcagcatggtgattcatttgatgcttccagaaaccagagaaatctatgaattagagaaattatggaccctacgttcttatgatgaccagttagctcagatagcacctgagacagtacctgaagacttcattctttggaatagaagatgatacttcatctgtgactccagtggagttaaaatgtgaactaccatattttatgcactgggttagtcaaaaaaaaaaaaaaaacagagaaaaagaaaaaaatgggggggataataggggggggggaaaaaaggggaagaaagggcctggggcaaaggggtttcgggaca

SEQ ID NO: 205 - DNA, 372 bp, Homo sapiens
gctttcgctcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaaaaaaaa

SEQ ID NO: 206 - DNA, 564 bp, Homo sapiens
agctattatttattgctttattagagcagagggaagtgacactcattgccttcacagagctctgcagaaatatatgcacagagtggtcaatgaccaacatctgagtaagtcttccaaattatcacattaaaataacctttcaaatttgagtgcctctcctttgcaaacaactgcaacctcataatgaataattttatatattatcaaaaagaaccagaagcccaggtgcttttttccccaaaatccacttactaaggacttgagtgaaaatccactctaagcagatcactgttactatttccctttcaaaacagttggaaatcctaaggtacgggtactaagaagatagcaatatccttcttaagctggtaagaatctagccccacagggacaatttggcaatcctgtttctggaagccaggactccagagatttgtcttagtgatggacagatactcctctaaccttaaggcatgagggctgtcaaaacaaggctctgaatagtgccttcctgctcatcaatgtcatcacaatgaaggagagaacaggttttcgtattcctga

SEQ ID NO: 207 - DNA, 360 bp, Homo sapiens
ttttttttttttttttttttttggaggccttttttggtttattttagcatatccccaagaaatttaaaatatttaggaggcctgcttaaagggcaatcttgaactttaccagattaaaacatgaagccaaagaaagctgccacctttccgtgcactattcccaacctccatgtacctaccataggattgctttttatgagtggagtaatatggcttaattttattttaatatactggaatgctttgtccagtcacaagtcccaagagcttctcatcccagtctatccaaatgaactgccaaagcccatcaacataatctccattcaaattttaagtttcccaatctgcattgaacaaatg

SEQ ID NO: 208 - DNA, 2045 bp, Homo sapiens
gggacctttagagagttagcaataaggctggagaaggaaaagccggcgcgcccgcggcccgcgcgatttcccgccgagcccgcgtccccggcggcgggcgggctccgggggcgcccgggccgcggcggcggcggcggcgcgagctgcgcctccgggccggtgaatcatcccggcagacaccaagagccgcggcagcagagaggagcgctgaaacatggctgaagcggccacgggctttctggagcagctcaagtcctgcatagtttggtcttggacgtatctgtggaccgtgtggttcttcatcgtgctattcctggtctacatcctgcgggtgcctttgaaaatcaacgacaacttgagcacagtgagcatgtttttgaacacattaacaccgaagttctacgtggccctaacaggcacttcctcactaatatcagggcttattttgatatttgaatggtggtattttcgcaaatacggaacttcattcattgaacaagtctcagtaagccacttgcgcccccttctgggaggggttgacaacaactcttccaacaattctaattccagtaacggggactcagattccaataggcaaagtgtctcagaatgcaaagtatggcgaaatccactaaatttatttaggggtgctgaatacaatcggtatacttgggtgacaggacgagagcctcttacttactatgacatgaatctctctgcccaagaccaccagacattctttacttgtgactcggaccatctgcgtcccgcagatgcaataatgcagaaagcctggagagagagaaacccccaagctaggatttctgcagctcatgaagccttggagataaatgagtgtgcaactgcttatattctcttggctgaagaggaagcaacaaccattgctgaagcagaaaaattatttaagcaggccctgaaggctggagatggctgttaccgacgctctcagcagctacaacatcatggatcccagtatgaagcccaacatagacgagacaccaatgtcttggtgtacatcaaaagaaggctagcaatgtgtgccagaagactcgggaggaccagggaagcagtgaaaatgatgagagatttaatgaaggagttcccccttctgagtatgttcaatatccatgaaaaccttttagaagcccttctggaactacaagcatatgctgatgttcaggcagtcttagcaaagtatgatgatataagcttaccaaagtcagcaacaatatgctacacagctgctttgctcaaagcaagagctgtctctgacaaattctctcctgaggctgcatctcggcgggggctgagcacagcagagatgaatgcagtagaggccattcatagagctgtggaattcaatcctcatgtgccaaaatacctactagaaatgaaaagcttaatcctacccccagaacatatcctgaagagaggagacagtgaagcaatagcatatgcattctttcatcttgcacactggaagagagtggaaggggctttgaatcttttgcattgtacgtgggaaggcacttttcggatgatcccttatcccttggaaaaggggcacctattttatccttacccaatctgtacagaaacagcagaccgagagctgcttccatctttccatgaagtctcagtttacccaaagaaggagcttcccttctttattctctttactgctggattatgttccttcacagccatgctggccctcctgacacatcagttcccggaacttatgggggtcttcgcaaaagctttcctcagcactttgtttgcccccttaaactttgtcatggagaaagtggagagcatcctcccatccagtctgtggcaccagctaacacggatctgagagaagccctgtcctccactcacctcacccgccgctgccaccatctcctctgtgccaactccttgtggaccgcaagaaagcatgactttgaaaaagggaagccattccgagattttaaaatgttcatggactattccatattaaaagctgtttttgttgtacaaaa

SEQ ID NO: 209 - DNA, 633 bp, Homo sapiens
  misc_feature 516: n = A,T,C or G
ttttgatgaaaaactaaagtttaatagtcattgaatgggtaacaaccacttgtagtctacatttaaaaattttaatcatagctaagaaaaactaaaaacaaataattctattaagaaacaacaaaaatgataaacatttaatacctaaatgtagatacttaaaatcctaaacaaaaatattaaagttaaaagggccttgaaatttgtttctaacaaatcatcttatataatcaattcctaaatagctcatatcctttgctttggtgttttatctgctatcatctaaacattagtacagtagaaaatcactcaggttcttttcaaatgcttggcattataatgtgatctcatatctttcctcaaattaaattttgctccacatattccacatgtatacagatgaacatccatgtgctgctccaactgttcattatttgggaatatctgaaagcagacctggcatatagtctcaccagcagataaatgagaaatcatatgccgtacatggtcatgttntctgaagtttccttgatcacaaatggaacagacatacctggccatgcctttgtgcatatcattgtgcagtcgcaactgacgctctcttaaaaactgctttccacatgtttgacaaac

SEQ ID NO: 210 - DNA, 3285 bp, Homo sapiens
ctagaattcagcggccgctgaattctagacccggatgaagagtaacgccattaccgcccgagccgccgagagccttagccgacggaaactggacactggaccggcagcgccatgagactcctcccccgcttgctgctgcttctcttactcgtgttccctgccactgtcttgttccgaggcggccccagaggctcgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggaccaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccagtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtaattgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcattttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgtaaaaaaaaaaaaaaaaaaaaa

SEQ ID NO: 211 - DNA, 2307 bp, Homo sapiens
ctcgggtcaaatgcgcgcctcggaccctagtgcgcgtgcgcgctggtggctccgcccctttggagctacttcctcatgctgcccgctcgcctaccgttcaggctgctgagccttttccttcgtggatccgctcccacggcagcgcgccatggcctccgggagccgctcctggagaggaggtgcgctgccgcctcctccttccagcactcatcgagtctgggacgcgagcttccttatgaccccgtggacacggagggctttggagaaggtggtgacatgcaggagcgttttctgttcccggagtacatcctggatccggagccgcaacccacccgcgaaaagcagctgcaggagctccagcaacagcaggaggaggaggagcgacagaggcagcagcggcgggaggagcggcgacagcaaaacctacgggccaggtcccgggagcacccggtcgtggggcacccggacccggcattgccgcccagcggcgtgaactgctcgggctgcggggcagagctgcactgccaggacgccggagtgcccggctacctgccccgagagaagttcctccgcacggcggaggcagacggcgggctggcacggaccgtgtgccagcgctgctggctgctgtcgcaccaccggcgcgctctacgcctgcaggtgagccgcgagcagtacctggagctggtgagcgccgcgttgcggcggcccggcccctccctggtgctctacatggtggacctgctggacctgcccgacgccctgctgcccgacttgcccgcgctggtgggccccaagcagctgatcgtgctgggaaacaaagtggacctcctgccccaggatgctcctggctaccggcagaggctgcgggagcgactgtgggaggactgtgcccgcgccgggctcctgctggcccctggccaccaagggccacagcgccccgtcaaggacgagccacaggacggggagaatccgaatccgccgaactggtcccgcacagtggtcagggacgtgcggctgatcagcgccaagaccggctatggagtggaagagttgatctctgcccttcagcgctcctggcgctaccgtggggacgtctacttagtgggcgccaccaacgccggcaaatccactctctttaacacgctcctggagtccgattactgcactgccaagggctccgaggccatcgacagagccaccatctccccttggccaggtactacattaaaccttctgaagtttcctatttgcaacccaactccttacagaatgtttaaaaggcatcaaagacttaaaaaagattcaactcaagctgaagaagatcttagtgagcaagaacaaaatcagcttaatgtcctcaaaaagcatggttatgtcgtaggaagagttggaaggacattcttgtattcagaagaacagaaggataacattccctttgagtttgatgctgattcacttgcctttgacatggaaaatgaccctgttatgggtacacacaaatccaccaaacaagtagaattgactgcacaagatgtgaaagatgcccactggttttatgacacccctggaattacaaaagaaaattgtattttaaatcttctaacagaaaaagaagtaaatattgttttgccaacacagtccattgttccaagaacttttgtgcttaaaccaggaatggttctgtttttgggtgctataggccgcatagatttcctgcagggaaatcagtcagcttggtttacagtcgtggcttccaacatcctccctgtgcatatcacctccttggacagggcagacgctctgtatcagaagcatgcaggtcatacgttactccagattccaatgggtggaaaagaacgaatggcaggatttcctcctcttgttgctgaagacattatgttaaaagaaggactgggggcatctgaagcagtggccgacatcaagttttcctctgcaggttgggtttcagtaacacctaattttaaggacagactgcatctccgaggctatacacctgaaggaacagttttgaccgtccggccccctctcttgccatatattgttaacatcaaaggacagcgcatcaagaaaagtgtggcctataaaaccaagaagcctccttcccttatgtacaacgtgaggaagaagaaaggaaagataaatgtatgagaccgaccttgttcactccagatattaactgtattgaacacaacaaaatacattgaatttgtattaaacatataacgcataaataaagctcccattcttaaaaaaaaaaaaaaaaaaaaaaaaaaaaaaaaaaaa

SEQ ID NO: 212 - DNA, 541 bp, Homo sapiens
ttttactatttgaaagttttatttttataaaattaacataaaagattgtttaaaaatctgcagttatttacagcagtattgcacaagtaaagtggcaattaccctgtcaaaattcatcagtgcaaaacacaagtaagccagggaaactgcaatacaaatgctacatacgctgggtcctagaaaacaggttagtgatggatcagtatacagccagatcagtgctatttataagtgggtacctgatgagttctgatacagtaactagtggtcacagaatctggacataaaacataagagagcttctatagtctgaaattcccaaataaaagtagtcaagttacttaactgggagcttgaggatgcttcttacacacaatgctgtttagagtagaccccaactgatttagcgtcatctgtagacacgtttcccccaccccacgtgtacgtgagtggacacacacaggcaccaggctaaatcagcagggatggcagaaccacctgcatggaaccaccatgaagtctccttaaagctcccataagc

SEQ ID NO: 213 - DNA, 575 bp, Homo sapiens
  misc_feature 575: n = A,T,C or G
tttttttttttttttacaaatgaggcaatttattaacccagcatggtttgttctaatgctggcttgtttggcagctgccacctgtccggcgattctgtccaaatctctttgtccctgaggtgtcagtttgcggccgccatcttggtccttttccaccattttcagcccctccagggcttggaggacccgtggtgggcacacactcttgggagcctcggatgaagtggctgggcatgacgccgtttctctgacgtcccccatagatcttggtcatggagccaaccccagcgccaccccggaggtacagtgtgcctgcgctgtggaacgcagctcgcgtgtaaaaccagttctcatcgtagggagcaagctcttggtgcttggccagcttgacggtttccacccattcgggggactttacagatttcccggaacttattggaggaaggtctgccagaagctctgacgaactcctgctgggtacacgtcttataacagtaaccccaggcaatcagtgcgggcatagactttgaggcatttgcatttcttgatcaaccagattgttaacctttgtttan

SEQ ID NO: 214 - DNA, 439 bp, Homo sapiens
tcgataagtttttttttttttttttttgacattgctttcttttaattggagtgaggacaaaacctgatcccgttcagagatgaacagaatcatctaggtcgttaagaacagtcttatctttctggttaaccaggtcctaaattcaagggatttccacgtgttctttaaaaccacctgaaactgtcctgcgcaggctcacactgcggctctgtaccaagggcttggccccgcctgcagccagagggcatctcactggatgtcatcatcatcaaaaagatcttcaaaatcgttaaaaaagtctgcatgaacggccttttcattggctgccaagtccatcaagagcccggtgctgcctcccgcctcgtccaggtccacgtagggcccggcgccctcggggaacatctcgtccaccgccggcttcatctcggggccgcggccc

SEQ ID NO: 215 - DNA, 1057 bp, Homo sapiens
aacaatacaaagagtgaaaggattttaaccaagtttacatttctttttgctataatttttaacaacaattcgtctcatcataacttaatgcaatgtgcaaatgcagcacccattacaatcattaaactaaatttaaggaagtacattgttaatagtgaccctcggaggaaatggatttctcttctattaaaaactctatggtatataagcattacataataatgctacttaaccaccttttgtctcaagaattatcaccaaagttttctggaaataagtccacataagaattaaatatttaaaaggtgaaatgttccttattttaactttagcaagatcttttctttttcattaagaaacactttaataattttaaagcaaaagctgttagagtctagatagctaaaactgtactcctgagttcaagcttacagataaatcttttgttaagtagttctcaataaaatatcttccctccccatacccctacccgaaatcttatattgttctttacaaaactttggtcaagagtagaaatatatccaggcagatgtatatgccatacaatagcaagaacagtaaagcccaactaatgattttgagttttaaaaatagaaggcaattaaaatgtactcaaagttacattaagaaaagctttcacggggggtaatattgaaacagtcacaaaggttaagaaaatactgatatcaaagtacaaattgactacaatgttaaaatagacaaaaatgatatacaagagcctctttgaaattaacataagaaccaaacatgagtcaggagattcccgtaatacacagaaatttaagactttaataaaggtgggatatgatgaccatctggaagagtttctatttcacatctgaaaggtcatcattcagcattagtagggggggttttccacaggaacacggaatactggtgtccaataggacaagaacgacataacagaggggacacatcagttatatctggtgtgaatagtacaagaaagttaaacgcaagagaaagatgaaagaaggagaggaaaaaagaagaa

SEQ ID NO: 216 - DNA, 550 bp, Homo sapiens
ctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcactt

SEQ ID NO: 217 - DNA, 557 bp, Homo sapiens
gtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaaaaa

SEQ ID NO: 218 - DNA, 645 bp, Homo sapiens
tttttttttctgcttcaagacttttatttaggtgtcgggactgctctgccacagctgcccacctggggcgcgtccctgctggccgccccgtcacggcccgaaccagctggggatgccgccccgccgcgggtcgctgctctgccacagctgcccacctggggcgcgtccctgctggccaccccgtcacagcccgaaccagctggggacgccgccccgccgcgggtcgctgctctgcctctgctgcctctcctccttgagcatgctgtaaaggtcgtcggcagtgctgccttcagggctctcgtctttctcgggaaacagatctgggaacgtgaaggtctgtccatgggccagctgcacgtaggcgaccttgtagtccggcttcttgatcctcacgtttctgtgatctcttctcttgttagagccatgctgcacccgtgtccgcacagcagccacgggcacgttatagatgccctcgaggtaattcctgaggtccacccttgtcatatccatggggatccggaactgcacggtgtcctcgggctgtgccacaccaggccgcaccagctgaatgaagatattgtatcggaacacatgtaggtgtgggccacccagccgggacagggggtacaccacattccgcgccat

SEQ ID NO: 219 - DNA, 760 bp, Homo sapiens
gattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgccgaagagtttacaaagaaatatggggaaaaagcgacctgtggactaaaatctgccacgatttggttccagcaagtgttgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtacacgcaaccggattaccaatttaagatattctataaaaaaacacaaaaaaaactttttgggccctgcgccccgaaatttttaacc

SEQ ID NO: 220 - DNA, 3366 bp, Homo sapiens
ggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatctttggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaacaaaatctagggctgtattttatatatatatatatatatatatatatatatat

SEQ ID NO: 221 - DNA, 555 bp, Homo sapiens
ctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatg

SEQ ID NO: 222 - DNA, 528 bp, Homo sapiens
ttttttttttttcaaacagacacaaaatttatttctggacgcattctgcaggctggaggtcccggcaggcacagggctcacaccttgggttttgcaaacacctcccagccctccagccggcccatcttgaccagggaggccgttatgccaaagtacacgcaggaggcggcgccaatcccgtagttgtgcgctgtgggagtggggaggtgatgtcaggcccgggtggggctcggccggaccaaaaagcttcacgccctggccggtgcccaccctgggagccagactgagacccctgacaggacactctcttcagggattaagtcactcaggaagagggccctaaactctggagatgtggaaactgatgcacagagggaggccggagtccaggttgcttcccagcaggaacccaggctgtgggtcctcatcccgccccacactgacttccccctgcgaggacaccgtgctgcccccagctggggctggggcaaggctgggcaccgggccatggtgacacatcggtgtgtc

SEQ ID NO: 223 - DNA, 1149 bp, Homo sapiens
ttaccatttatttgcagaattaacagtataataaactgctctacaagattttctatcaaggagtatttagaagagagatataaactgtaagcttataaaagtggtttctagagaaagtaagcaataataaaccctctcatataagttaggcatgtatttaaatttataagatacatttcttttgcttgatacaaatctcatcttaaatatacggctaaggaacagaaaaaaattcaaactgagacactcctgtaactctgggaaaattacacttatcaaattttacatataaatttagaatgactaatgaatgtttcagaaatacattaattaccaagatgctctgaaaagtacattactgtacatacagcctgaagttaacctttctatgttaaatgaaaaaactttgtcattcatcaggtcacagaaaccaaaaactaaacaatgcaaaaaaaaaaaaaatctaaaaataaaagaattttatatttgaagttattctggatattcgcaccattttagcttctgaaaaaaatgcaactatgaaatgaagacctcatatattttcatttatcaatataatgttaaaagtttcattccacccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaaaaaaaaaaaaaaaaa

SEQ ID NO: 224 - DNA, 1130 bp, Homo sapiens
gcacgagggtgctgactggcttgcgtctctgccactttctttcagcttagtggcgcgcggcgcgcgacgaccgccgggagcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatgcccgagtgctacatccgcggcagcaccatcaagtacctgcgcatccccgacgagatcatcgacatggtcaaggaggaggtggtggccaagggccgcggccgcggaggcttgcagcagcagaagcagcagaaaggccgcggcatgggcggcgctggccgaggtgtgtttggtggccggggccgaggtgggatcccgggcacaggcagaggccagccagagaagaagcctggcagacaggcgggcaaacagtgagcgcccacccagaccggctgctgcgccccctcctgccagggtggcgattccgctccacagtctcggacggatctgctcagaaaggaagaggcaggcgccagggggaacccccttcgtgttttgtgaccctcccttttaggtgaagcccctttttcttgctaaaaccggcaattctccggttagaaatgttacttggtgttttttggttttgtgaaacggccgtcccaaagctggctggattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaaccgtgcaggggatgcctcgggccctggcccttcgcttcctctcttgtgttatggaaataaaaacaaataaaactacacactgcacaaaaaaaaaaaaaaaaaaaa

SEQ ID NO: 225 - DNA, 537 bp, Homo sapiens
taacagtctttattgggctcagaccaggagtccgtgggtcttgaggacctctgtgtatttgtcaattttcttctccacgttcttctcggcctgtttccgtagcctcatgagctgtttcttcttccggtagtggatcttggctttctctttcctcttctcctccagggtggctgtcactgcctggtacttccagccaacctcgtgagccatgcgccccagataggcaaactttcttgtaggctccatacgcacgaccttgagggcagcaggaaccaccatccgctttttcttgtcgtagggcggtgggatgccgtcaaacaccttgagacggtccagagctgcctggcctcgcttggttttgtggggcagtatacctcgcacggtccgtcataagatgcggctgtgggccctgaagtggtaggggcctctggaagggctggtcgtcatccgcttgcggatgaaagcctagtacttcatctagtttctcgcgaaagtgccagacatgttgatgtctttccagcgtacgaccaccatctt

SEQ ID NO: 226 - DNA, 533 bp, Homo sapiens
tttttacatcaaaaaccatactttattttatgtatagcaatacaatttacatattaaataacactataatagaatgatttgatatagtttaaacagaagaaaaagggaaaaatttcaggttacaaaacccctccccctgaacaaatttaaaaaaaaaaaaaaagcacactttttccaaatgggtcaatgtgacgaatgttttcagtgactaattatgtctaattcctattgcacaaatggtcaatggaattaaaaagaaaacccaactttcacaatcactgcctcaaagaaataacacatgttggattcttttggaatgtaaagatggtttttgctacttcaatacacagaaagttgaattcacatatccaccacaaaaaggaaaaaaaactatgacggagttgaaactagaaaaaaattagctttatatgaaaatataaaattctatgattatataccatagatacaaagttcccagaagatgcttacccaagcaacaaaatatttacagttttaatgatttttagctattt

SEQ ID NO: 227 - DNA, 2262 bp, Homo sapiens
gctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccaatcatcacttctacgatgagtccaagcctttcacctgcctggacggttcggccaccatcccatttgatcaggtcaacgatgactattgcgactgcaaagatggctctgacgagccaggcacggctgcctgtcctaatggcagcttccactgcaccaacactggctataagcccctgtatatcccctccaaccgggtcaacgatggtgtttgtgactgctgcgatggaacagacgagtacaacagcggcgtcatctgtgagaacacctgcaaagagaagggccgtaaggagagagagtccctgcagcagatggccgaggtcacccgcgaagggttccgtctgaagaagatccttattgaggactggaagaaggcacgggaggagaagcagaaaaagctcattgagctacaggctgggaagaagtctctggaagaccaggtggagatgctgcggacagtgaaggaggaagctgagaagccagagagagaggccaaagagcagcaccagaagctgtgggaagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaa

SEQ ID NO: 228 - DNA, 674 bp, Homo sapiens
tgtcagctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcaacagcacctgtgagtctgggcgcttagagcccctaagccagatggccc

SEQ ID NO: 229 - DNA, 710 bp, Homo sapiens
ggtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttcctttttttttttttaaataaaaatactattaactgggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaaacaatgttggccacgtatattttacacctcgaaataaaaaatgtgaatactgctccaaaaaaaaaaaaagtggcgagctttccctaggggggt

SEQ ID NO: 230 - DNA, 846 bp, Homo sapiens
ggctgtttcctggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgaaaaaaaaaaaaaaaaaaaa

SEQ ID NO: 231 - DNA, 985 bp, Homo sapiens
gcctttccgtcaattcctgtcctgggcgtacgtcaagatggcggcgtctgtattaaacaccgtgctgaggcggcttcctatgctatctctcttccgaggttctcacagagttcaggttcccctccagactctttgcaccaaagctccctctgaggaagattctttgtcctcagttcccatttctccttataaggatgagccctggaaatatctggaatcagaagaataccaggagcgatatggttctcgccccgtctgggctgactaccgccgcaaccacaagggtggtgtacccccacagcggactcggaagacatgtattcgtcggaataaagttgttgggaatccctgccccatctgtcgagatcacaagttgcatgttgactttaggaacgtgaagctcttggagcaatttgtctgcgcccacacgggtatcatcttctatgctccatacacaggagtctgtgtgaagcagcacaagcggttgacccaggccatccagaaagccagggatcatggtctcctcatttaccacatcccccaggttgaaccacgggaccttgacttcagtacctctcatggggctgtgagtgctactccgccagcccccaccctggtctcaagtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaaaaaaaaaaaaaaaaaaaaaaaaaa

SEQ ID NO: 232 - DNA, 2544 bp, Homo sapiens
ggactgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaaaaaaaaaaaaaaaaaa

SEQ ID NO: 233 - DNA, 536 bp, Homo sapiens
ggtttctttttcttcagcgaggcggccgagctgacgcaaacatgcagatctttgtgaagaccctcactggcaaaaccatcacccttgaggtcgagcccagtgacaccattgagaatgtcaaagccaaaattcaagacaaggagggtatcccacctgaccagcagcgtctgatatttgccggcaaacagctggaggatggccgcactctctcagactacaacatccagaaagagtccaccctgcacctggtgttgcgcctgcgaggtggcattattgagccttctctccgccagcttgcccagaaatacaactgcgacaagatgatctgccgcaagtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactgcagcaggaaaaaaaaaaaaaaaaaaa

SEQ ID NO: 234 - DNA, 316 bp, Homo sapiens
  misc_feature 81, 125, 239, 277: n = A,T,C or G
ggctgtaagtttattcaatgcaaaagaatcctctccaattttactgaggtggctgaccacgtccacgaccaaatccgcctntaaactggaattcggttgctgacccagccccagcctcggctttnttgtcggcaccaggtggcacagcactccgtctgtaggtatctctgtcagcttcccctcttgtgagtctcgcaggtcgctcaccctccagacctttaggccgaggcctgccagtntctggacggctacggcgtagggtggcaggcacaatctncgggggcagatgaaggtaatcacggagatactggatacc

SEQ ID NO: 235 - DNA, 580 bp, Homo sapiens
ggcacgaggcgctcctctgggcccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggcta

SEQ ID NO: 236 - DNA, 812 bp, Homo sapiens
gaccggaagtcccgcctctgccgtgggcctgcgagaatcgaggcactcgctggcgtacccatgtatcgaaatgagttcacggctggtaccggcggatgtcggtggtctacgggatcggcacctggtctgtgtggggctcactgctttactatagccggacaatggcgaagtcgtcagtagaccaaaaggatggctcagcaagtgaagtacccagtgaactctctgaacgcccaaaaggattttatgtggaaacagttgtcaccatataaagaagatttggttccaaatacagaaaagatcctcaactattggaaatcatggactggtggccctggtacagaaccatgactggctgctgaattctgaaaaccaggacttgggttcaacatttaaatttgatagttgccctgattcccatttttgggttgtgtgaaaagtgtatgtatttaaatttgctgtaaaacataatcactaataatatgcaataaatattttcttgaaggaacaaaccacccacacccccacccccacatcactacgcaacaccgccccagacaaaacgaacagaccaaccacaaagattcgtcgcgccggccgcgcgaagaaagagatcaaacaacatggggggcggggcgccccagtgaacaacacagaccccggtgctccacaagaccgcgccgaagggtggctcccaaaaaagagggcgagcacgctcaacccacggcggcgcctgctgcacgccggctaccccggggcggcacaaccaacgacaacgcaactacaggagacaacgacacgcgacgcgtgacacg

SEQ ID NO: 237 - DNA, 612 bp, Homo sapiens
tccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaaaaaaaaaaaaaaaaaaaaaaaaaaaaaaa

SEQ ID NO: 238 - DNA, 725 bp, Homo sapiens
  misc_feature 467: n = A,T,C or G
gtttctcactgcctgtataatcaggtctttattcaaaagaagctgtccaaaatgatttgacctttatggaataatcaaatttaagagtttatgcagcaggcttcttctcctctgtagtaggtttcttctctgcaggcttcttttcaggggctggtttcttggtagctgctgccttttttcccaccagaggcttcttctgcttcttaacaccaacagcagccttctttcctttcttacctaccacaggcttcttgcctgcaaccgccgccttctcatctgatttggcttgtagtgccgctgctgcagcagctgccttatccacccggagcttgtgattcctggcctggcgaagaatggtgttccggcgcatggtctttgcatatgggtttagcttcaacatgattctcaagtttttcagtgggttcttctttaggactctgcgatggatcttctgcgtgtgctcgaanggctccttgatctctggctttcaaattctgctagatctgattatcatttggcatgggaagatgagtactcttgaggagcgcttacgcaagtgcgacatcatctaacttcgaagacactcatcaatgcagacgtcactgccaccagagcagctcaatgtcactgctacttaacaagatcccccgtgtctagcctgagacatatcctattttatagccgccctcctgtacggcggacgtttttctgcgcccttcctgggg

SEQ ID NO: 239 - DNA, 855 bp, Homo sapiens
gaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaaaaaaa

SEQ ID NO: 240 - DNA, 1882 bp, Homo sapiens
cttttctcgggacgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtaaaaaaaaaaaaaaaaaaaaaaaaaaa

SEQ ID NO: 241 - DNA, 970 bp, Homo sapiens
gaactggtcgaatgaggcacctaaaaattgtataccgcagattcaggcatggattccgtgaaggaacaacacctaaacccaagagggcagctgttgcagcatccagttcatcttaagaatgtcaacgattagtccatgcaataaatgttctggttttaaaaaaaaaaaaaaaaaaaaaaaaaaaaaaacccttgggtcggggggcgcgcctgggccttcggaagaaggtttttataaacccaatctggttggggcgcgcggggggccccatgtggttattgtgacaccttgggccataaacgggtgtgtcccaaaggaaaccctgggccaagacataatgtggtgttgggttttccccccccaaataaaaaaaacgcgcccgggggcaaaccgggggcgggtccgtgggacacaaatcccaggaggggagtgtcccggagggccatacggggtctcaaaccaacgaggaggtgtccaacggaaaggcccaggaaataaaataaggccccgccgcgggaggaaaaaacgaaagacaagagcaaacacacagacaacacaaaacacagaaaaaacacaaacaagacgaacacagaagaggcacaaaaacaacctaaaagacaacacgacagagacaagacaaagagacacacaaacgagagggacacaggcgacaagaagaagacaaacagcagagaccgaggacaagaaaagagaggaaaggcgaaaaggaaacaagcgacgaccagaaagacagaacaacgaccgagaaaggagcaagaacaagacgaaacagaggaacgaagacaacagagacaaagagaagagaagaagaaagcgcgaagaagaagcaagagggaggagaaaggaaaggacagagaggacagaaaggaagagaacacaaagggagagaagaggaaaagaagcagaggaacgacggagcacagaagaggaggcgggagagcgaaagaca

SEQ ID NO: 242 - DNA, 1142 bp, Homo sapiens
cttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaaaaaaaaaaaaaaaa

SEQ ID NO: 243 - DNA, 1120 bp, Homo sapiens
gggcgctagggccggagcccccgccggcccttcctccagcgccctgcgaccccgcagaaggcgctcgctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtcctctgtccgacagtgcgacacttggcgctccatgcttgcgggtgccgggacgataggcctccgccagggccgccacctctgctggttgctctgtgctttcaccttaaagctctgccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtaaaaaaaaaaaaaaaaaaaaaaaaaaaaaaaaa

SEQ ID NO: 244 - DNA, 531 bp, Homo sapiens
ggcagtctcgcgataactgcgcaggcgcggaccaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcc

SEQ ID NO: 245 - DNA, 549 bp, Homo sapiens
ctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacaaaaaaa

SEQ ID NO: 246 - DNA, 1105 bp, Homo sapiens
ggggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacgcaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcat

SEQ ID NO: 247 - DNA, 1627 bp, Homo sapiens
cttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaaaaaaaaaaaaaaaaaaaaaaaa

SEQ ID NO: 248 - DNA, 1563 bp, Homo sapiens
ctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaagcggctatgtgactacgtttgtgacctcctcttagaagagtcaaatgttcagccagtatcaacaccagtaacagtgtgtggagatatccatggacagttttatgacctttgtgaactgttcagaactggaggtcaggttcctgacacaaactacatatttatgggtgattttgtagacagaggttactatagtttggagaccttcacttaccttcttgcattaaaggctaaatggcctgatcgtattacacttttgcgaggaaatcatgagagtagacagataacacaggtctatggattttatgatgagtgccaaaccaaatatggaaatgctaatgcctggagatactgtaccaaagtttttgacatgctcacagtagcagctttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgccttttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttccttttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaaggacaaaaaaaaaaaaaaaaaaaaaaaaaaaaaa

SEQ ID NO: 249 - DNA, 1101 bp, Homo sapiens
ccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctc

SEQ ID NO: 250 - DNA, 1717 bp, Homo sapiens
gctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtgggacacaatgcccccaaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctacctgctggatctgcgaaacactagtacgcctttcaagggtgtacgcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaaaccaaaaaaaaaaaaaaaaaaaa

SEQ ID NO: 251 - DNA, 1687 bp, Homo sapiens
cgggcgcgcggggagggggcgcaggaagcgggcgaggccgggcgcgggaggcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcgggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaa

SEQ ID NO: 252 - DNA, 1951 bp, Homo sapiens
tcggcacgagccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacattccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagccggcaaataaacagtgcagctcagaaattgta

SEQ ID NO: 253 - DNA, 1304 bp, Homo sapiens
cttcgccacattcgcttcctgctttcggtgtgtctgttgtgtcttgttgcgggcaccgcagtcgccgtgaagatggcgtctaccagccgtttggatgctcttccaagagtcacatgtccaaaccatccagatgcgattttagtggaggactacagagccggtgatatgatctgtcctgaatgtggcttggttgtaggtgaccgggttattgatgtgggatctgaatggcgaactttcagcaatgacaaagcaacaaaagatccatctcgagttggagattctcagaatcctcttctgagtgatggagatttgtctaccatgattggcaagggcacaggagctgcaagttttgacgaatttggcaattctaagtaccagaatcggagaacaatgagcagttctgatcgggcaatgatgaatgcattcaaagaaatcactaccatggcagacagaatcaatctacctcgaaatatagttgatcgaacaaataatttattcaagcaagtatatgaacagaagagcctgaagggaagagctaatgatgctatagcttctgcttgtctctatattgcctgtagacaagaaggggttcctaggacatttaaagaaatatgtgccgtatcacgaatttctaagaaagaaattggtcggtgttttaaacttattttgaaagcgctagaaaccagtgtggatttgattacaactggggacttcatgtccaggttctgttccaacctttgtcttcctaaacaagtacagatggcagctacacatatagcccgtaaagctgtggaactggacttggttcctgggaggagccccatctctgtggcagcggcagctatttacatggcctcacaggcatcagctgaaaagaggacccaaaaagaaattggagatattgctggtgttgctgatgttacaatcagacagtcctatagactgatctatcctcgagccccagatctgtttcctacagacttcaaatttgacaccccagtggacaaactaccacagctataaattgaggcagctaacgtcaaattcttgaatacaaaactttgcctgttgtacatagcctatacaaaatgctgggttgagcctttcatgaggaaaaacaaaagacatggtacgcattccagggctgaatactattgcttggcattctgtatgtatatactagtgaaacatatttaatgatttaaatttcttatcaaatttcttttgtagcaatctaggaaactgtattttggaagatatttgaaattatgtaattcttgaataaaacatttttcaaaactcaa

SEQ ID NO: 254 - DNA, 675 bp, Homo sapiens
gcacgcgcaagattaggtggggcgccagagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtgtatggagagattcaagaaataattttaaaaccgcatacataataaaagacattgttgcatggctt

SEQ ID NO: 255 - DNA, 1459 bp, Homo sapiens
agaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtcccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttacgccagtatctgccagcagaatggcattgtgcccatcgtggagcctgagatcctccctgatggggaccatgacttgaagcgctgcctgtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgccgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaaaaaaaaaaaaaaaaaaaaaaaaaaaaaaaaaa

SEQ ID NO: 256 - DNA, 1025 bp, Homo sapiens
ggcgcttcgggagccgcggcttatggtgcagacatggccaagtccaagaaccacaccacacacaaccagtcccgaaaatggcacagaaatggtggaccccaagttcctgaggaacatgcgcttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaacccccaaccccgaccctgggctaccatctgcatggggctggggtcctcctgtgctatttgtacaaataaacctgaggcaggaaaaaaaaaaaaaaaacaaagaagaaaaaaaaacatcaaaaacccgcagagaaatcaaggacagcgctgcgaacacaaagggaaatagaagatcacaaggagacaaccgaaacaggacaaccacgcatcttatgacacagaggtagacacaccgccgatacccacaagagagcaataaaatcaacgacaccacgcggtaaacgcgaatactacaaacgcggaaaaaagacacgaacaagcaaacgaacatgaacaccgaaacaaaaggacaacaccacacagacacaactcaggagaacagcaaacaaacacacaacacaaaacacacaccacaacacccaaaacccgaagcaacaagacaagaaactacaaagaaaccacaaaaacgaatcaaaaagacaacaaacaacaacaaaacagcaagaaagcaaaaaaga

SEQ ID NO: 257 - DNA, 1453 bp, Homo sapiens
ggccacgaaggccggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaaattcctgcaaccctcttgatcttctcttttataattaaagtcagcacttgaagcggg

SEQ ID NO: 258 - DNA, 709 bp, Homo sapiens
gcgtctgcctcagaggggcccgagccacccggtccgccgcgtccccgccgccgccgccgcgtcccccgccggggccgaccgagccgagccgggccggagcggcgggcgcggccgggccgccatggaccacaagccgctgctgcaggagcggccgcccgcctacaacctggaggccggccagggcgactacgcgtgcggcccgcacggctacggcgccatccccgccgcgcccccgccgccgccctacccctacctcgtcacagggatacccacccaccatcccagggtctacaacatccacagccggaccgtcacccgctatcctgccaactctatcgtggtcgtaggaggctgtcctgtctgcagggttggggtgctggaggactgcttcaccttcctgggcatcttcctggccatcatcctcttcccctttgggttcatttgctgttttgccttgaggaagcgacgatgccccaactgtggagccaccttcgcttaaagggaacaccaggcccggctttcctacacccagctctctttttctaatgtaaatgttgtgtacaatagttttatttgattaagcttcaggactgttttgtaaagcgaggtgggaccgatgtggcacacgccagctgcggtttcccggagcgtggagaggcagtgctgctgctcccgcccgaggctcatgacaactcaataaagcactgct

SEQ ID NO: 259 - DNA, 962 bp, Homo sapiens
cttcttttccgacaaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgaaaaaaaaaaaaaaaaaaaa

SEQ ID NO: 260 - DNA, 621 bp, Homo sapiens
tttttttttttttttttacagtttaaagaaagttttatatatatatttatatatattttattataacaaaataggcagctattgtgggtaaaatattcagtaaaatctgactcctaagaatacatttgaagttttaggctatgaattggactcctttccattgccatgatggttactacgtcaccactgtaacgtctgatttatctgtatttatatctaggaaattttctcaatcttctgtgtaaaaggcgaacttccttagcacctgaacatggcctcaattcacgaaatgtgatgatcatttacatatgaacaacttttgtaagacacgatagtgttgctcaagtagattaaaaacattgaaacgttgttattcctagcaaatgtcctgggaaaaaagaacgtcaaatactaaaaggctttaagaatgttgaggaaaaaatgaaatcccttatgaaagtcaactcagacatgaatttttaaattaaaaaatgtccttatttatctataatgaaacaattgctttgatgatagaagttgattgagaaaaggattgagagtaatacactggccaaacatgctattaaactgaagcgtgcacattgctcaaatctactaaat

SEQ ID NO: 261 - DNA, 1328 bp, Homo sapiens
ggcacgaggttgcggccttcctcgcgtcaccgccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccacttttttttaaggcaggcggatcacctgaggtcaggagtttaagaccagcctgaccaacatggagaaactcgtctctactaaaaatacaaaaatacaaaaattagccaggcatggtggcacacgcctatagtcccagctactcaggaggctgaggcaggagaatcacttgaacccaggaggcataggttgcagtgagctgagatcacgtcattgcactccatcctgagccacaagagcaaaactccgtctcaaaaaaaaaaaa

SEQ ID NO: 262 - DNA, 573 bp, Homo sapiens
  misc_feature 256: n = A,T,C or G
ttttcagttttactaataactttatttaaataagacacaggaacttctatactgaaaaaatacaaaacaaaagccacacatttccttgtgtaaagccatattatatggtaactcaaatactgttcagcgcaatggctagaattaaacagtacaattatatacaaaatttaaacaatttctgacaaatttctacagctggatgtaggatacatttgagctcaacaacttctgggaaatttacatggcaaagcgtaanttttaacacatttggttcaaaactttaatatatgctaagaacaaatgtacaacacaattaatatttagtatctcatgagaaaataaaagcacatcactataaatatcgtacatgagatttcatcaccaaaaaagcatattcagtccatttttctgaaattgatattgatactattgcattttatttggacaaaagcagagtgtaagatcaacatattatgtaatgctaaccagacatcagaagtcaaatggagctcatatttatcttcgggactagtaatttccccctttaaccataatctacaaatatagtatttc

SEQ ID NO: 263 - DNA, 1704 bp, Homo sapiens
gcatttgactgcaactcttgtcgtcttatgtgggtgttgaattgatctgtctctgcaggccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggcaaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcaaaaaaaaatggcttgtttgttttgatttctgctgtgcttataaatcactttcggtgggcaagggagagaggggaaaatgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttagtgcctggctgtgctctcttttatgccccctctattctcctctctcccccaggggattttcatctcaacaacagagtg

SEQ ID NO: 264 - DNA, 1872 bp, Homo sapiens
tcgccaacattccttcgttcccctaaatcagcctcttgccccattgctctttgcaggggtagaagaaggaagtgtagcggggtaaggaatgcaccgtcagggtctctcacaaccctttcccagctctcctccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttatgacttcctgccttccagccctcagattcatcgctaccccgaggctaagcgccatgcctcatattgacaacgatgtgaaactggacttcaaggatgtccttttgaggcccaaacgcagtacccttaagtctcgaagtgaggtggatctcacaagatccttttcatttcggaactcaaagcagacatactctggggttcccatcattgctgccaatatggatactgtgggcacctttgagatggccaaggttctctgtaagttctctctcttcactgctgtccataagcactatagcctcgttcagtggcaagagtttgctggccagaatcctgactgtcttgagcatctggctgccagctcaggcacaggctcttctgactttgagcagctggaacagatcctggaagctattccccaggtgaagtatatatgcctggatgtggcaaatggctactctgaacactttgttgaatttgtaaaagatgtacggaagcgcttcccccagcacaccatcatggcagggaatgtggtaacaggagagatggtagaagagctcatcctttctggggctgacatcatcaaagtgggaattgggccaggctctgtgtgtactactcggaagaaaactggagtggggtatccacagctcagcgcagtgatggagtgtgcagatgctgctcatggcctcaaaggccacatcatttcagatggaggttgcagctgtcctggggatgtggccaaggcttttggggcaggagctgacttcgtgatgctgggtggcatgctggctgggcacagtgagtcaggtggtgagctcatcgagagggatggcaagaagtacaagctcttctatggaatgagttctgaaatggccatgaagaagtatgctgggggcgtggctgagtacagagcctcagagggaaagacagtggaagttccttttaaaggagatgtggaacataccatccgagacatcctaggagggatccgctctacgtgtacctatgtgggagcagctaagctcaaagagttgagcaggagaactaccttcatccgagtcacccagcaggtgaatccaatcttcagtgaggcgtgctagacctgagcagttctaccctcccaaggcaccagtactctaccatggggcatcccaagtggggtcctcacccatcccagctactgcagctctgtattactttgtcatttcctgttgtctcactcctgagggctcctgcagtaactctgtacttctctatctgcacacacaaaatgcccaaggcactcactggggaggaagcaaggaagcaaacagtctgagaaaatgatgcaagaaaatcaaatgggaatctggggacccaacacaacatcctgaagattattaaaaggaaaagatgctgattggtacataaatcttttacatggccttggtctagaggaggcaggcttttagaatcatgttttgttaatccgcttcactaaattggaccttcacatatctaaaaagctctgaagtgtttgtatatttgaaatacctcaataaagagagagctcattgactgtaaaaaaa

SEQ ID NO: 265 - DNA, 650 bp, Homo sapiens
  misc_feature 446, 525, 604: n = A,T,C or G
ttcatatccatcagctcgttcaactttagcacctgtctcgtccccagtggcttttccagaactactgccttcaccatgaagctccatgagctttcccaattcaaacttgggcttcttcagcatttttacttttctaacgaagacatcatggagaggataaatagattggcaagccttttctatgtcttttccaatgctgtctggaatcaatttattgaccacttctttcaagtcatttgtctgcacctctcgggtcatgatttccatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctgccatctcttgaccatggaacacattntggcacgggtaagatccatgccatggaagttagtcaggcagcttttaccctgaacatcttcagtaatcagcttgaattntctaaatgcatcttcatcattctgcagatcagcaagactcactttaaacacacgaccctggagaccatcagatgcaatnttgtttcctgggtcctggtgacgagcgtcttcccatattcctatat

SEQ ID NO: 266 - DNA, 2974 bp, Homo sapiens
gcccctgcctcggccagaggtttcatttttaactgaatatttacgaaagctggaagcgtgcgaggggggtggggtggggtggaaatagcggctgcttcttttccagggatttatttaatggggatgtgttcaaggcaagagcgaattcagaaggatatcgacgtcgtgatccagaagtccagagctgagaaggactgcctgtttgcagatttcagatactctgactccacctttacttttacctacgttggcggccccagaagtgtatcctactcagtacatgtatctgaagattacccagataatacatatgtgtcaagttcagagaatgatgaagatgtgctagttactacagagccaataccagtaatttttcatagaatagcaacagaattaagaaaaacaaatgacattaactgttgcttatccataaaatccaaattacaaaaggaaaatggggaggaatcaagacagaatagtacagtggaggaagattctgaaggtgacaatgattccgaagaattttattacggaggacaggtgaactatgatggggaactgcacaagcacccacaactggaagctgatttgtcagcagttagagagatatatgggccacatgcagtttctctcagggaatatggagccattgatgatgtagatattgatctgcatatcgatgttagctttcttgatgaggagattgctgtggcttgggaagtaattcgaacagaacctataattgttcgactacactgttcacttacacagtatttaaatggcccagtgcccactgttgatgtctttcagatttccacaaaagagcgatttggattgggacatcagctgaaaaaaatcatgcagacatttgttacacagcagtggaaacagagcaaagaaaaatccaattgcctgcacaataaaaagttgtcagagaagaaagtgaagtctcccctgcatttattttctactttgcgcaggtcgccaagttatcctccccctggttgtggcaaaagcaaatccaaactgaaatctgagcaggacggaatctccaaaacgcataagctgctgcggaggacttgttccagcacagtcaagactgatgatgtgtgtgtcacaaagtcacacaggacctttggccgctccttgtccagcgatcccagggcggagcaggctatgacagcaattaaatcgcacaaacttttgaaccgtccttgccctgcagctgttaagtcagaggaatgcctaactctaaagtcgcatagactattgactcgatcttgttctggagatccacgatgtgagcacaacacaaacttgaagccccataaactgttaagcaggtcttactctagtaatctcagaatggaagaattatatggactgaaaaatcacaaattgctcagcaagtcctactccagtgcccccaagtcatccaaaactgagcttttcaaggaacctaacgcagagggcaggaggctctctcttacctcagggcttattggtatcctaacaccatcttcatcttcatcttctcagcttgctccaaatggtgcaaaatgcattccagtacgagaccgtggcttcctggtgcagacaattgagtttgctgaacagcggatccctgtattaaatgaatattgtgtggtttgtgatgagccacatgtgtttcaaaatggccctatgcttaggcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaaaggaccaccatttaattaacatgattcgaaagccttcctcgggttcaaagctggattttgaactgaagaagattataaaattatttattgttattataaacaaaattaaccctttgaatactgattttttttcttagtatttctaagtatctcattaaatacctaaaatggtataagatttatcaattgtagggttatggaatctagtaataaaatttcaacagcacttaaactgaagtttgggttgctcatacaataaacagattgaaaaaacaaaaaaaaaaaaaaaaag

SEQ ID NO: 267 - DNA, 565 bp, Homo sapiens
ggccgatacctcgcgagacttggcgaaggccttcctttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttcaaaaaaaaaaaaaaaaaaaa

SEQ ID NO: 268 - DNA, 1145 bp, Homo sapiens
cccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgtgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaaaaaaaaaaaaaaa

SEQ ID NO: 269 - DNA, 1081 bp, Homo sapiens
  misc_feature 7, 11, 23, 27, 29, 78, 90, 96, 99, 107, 110, 139, 153, 157,159, 162, 165, 220, 221, 222, 235, 246, 284, 313, 315, 323,332, 342, 350, 367, 376, 378, 379, 397, 399, 412, 413, 424,429, 431, 433, 436, 439, 449, 450, 463, 479, 492, 500: n = A,T,C or G
  misc_feature 502, 506, 507, 508, 511, 513, 514, 527, 529, 532, 536, 537,538, 542, 548, 552, 553, 557, 559, 560, 565, 568, 570, 573,576, 578, 579, 583, 585, 592, 600, 601, 602, 611, 612, 615,620, 624, 633, 637, 642, 644, 645, 659, 663, 666, 667: n = A,T,C or G
  misc_feature 675, 676, 680, 683, 685, 687, 696, 716, 720, 730, 732, 733,740, 749, 750, 751, 756, 761, 775, 778, 780, 781, 795, 797,799, 804, 809, 812, 813, 817, 818, 832, 837, 845, 848, 849,855, 871, 878, 879, 887, 891, 892, 893, 897, 903, 914: n = A,T,C or G
  misc_feature 916, 925, 931, 932, 933, 935, 946, 947, 955, 959, 963, 968,970, 973, 977, 978, 981, 982, 983, 985, 987, 989, 997, 1001,1019, 1022, 1024, 1027, 1029, 1037, 1043, 1050, 1058, 1059,1061, 1064, 1068, 1079, 1081: n = A,T,C or G
agcatgnttcncttaaccttttncatntnttttttatatcccagccctccctgtaagactggtcattttttaaaatcntcagccatatcnaggatncanaaggggtntangatagagaccaatgaagaaatttctttgnagaattgttaagangctnanttnagncttcttggacaaaggagttactaccttctactttgaaaccagtgaaaggaacttnnnggaagcccttcanagagctttganatgtgtttcgtacaaccatttatctggggagcccaganagggctgctgccatgctatctccctgaantntgcttttncacggctcngggatgtganaatgtttnctgaggaccagatgtgngacactcangnnagagccggcataatatancnctccataggtaannaaaaccttcangactnangntgnatnctacgggttnngaaagaaatacanacttttcttgacacanggtcttagtcatncaagctgnantgcnnntgntnncaattcatatgtncnctncaannnttgnacctcntcannctanannaattnctntnaanctntnntttncnttgagcnatctgggnnnctacaggcnnccntaccnaccnttgccctgngctnatttntnngtattttcttacangggnaannaacgtttnntctntgntntncccacgggnatggtcctctactacctctntgcntttcaattcncnnttggccnccttcttgnnnccctnctcanaaatgtcctgcggnatngnncctcccatggaacncntncgganatctnttnnaganncgtaattttttatnaattnataaacgnctnncccttntcatttccctatggcnatacctnncccatcgntggnnntacntcctcntctagggtctntntcaattttntccctnnnanctcataataannatgtcacntttnaacntatantngcnggcnnccnnnangntnaatccttngaangccctgactctatcctcntantntananttaccccntatgtntcctaantctcttcnnantantttnttcctctctcncn

SEQ ID NO: 270 - DNA, 1438 bp, Homo sapiens
ccggacgccgcacggctcctgttccggtgtcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatga

SEQ ID NO: 271 - DNA, 883 bp, Homo sapiens
gcacgtcggccctgcctcccggaccaccctgcggggcgcaccaccgatctggggtgcggggctcggcctccctgcgctcctggctgacggtgtgaccttgggaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggcgatcccagcactggccttctcatccgggccaaccagggccattccctgcaggtacctaagttggagctgatgcccctggagacaccgcaggccctgcccccgatgctagtccatggtacattctggaagcactggccatccatcctactcaaaggcctgtcctgccagggaaggacgcacattcacctggccccaggactgcctggagaccccggtatcatcagtggcatgcggtcccattgtgaaatagctgtgttcatcgatggacccctggctctggcagatggaatacccttcttccgctctgccaatggggtgattctgactccagggaatactgatggcttcctccttcccaagtacttcaaggaggccctgcagctacgccctacccgaaagcccctttccttggctggtgatgaagagacagagtgtcagagtagccccaagcacagctccagagaaaggaggaggatccaacaataaaatattaatttataaaaaagaaattttaaaaagtaacaagaaagaactcgtttgaaaccatgtttcatcatcctgtaaaaaaaaaaaaaaaaaaa

SEQ ID NO: 272 - DNA, 779 bp, Homo sapiens
cccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcctgcagcccctgctgcccaataaaaccactccgaccccacgg

SEQ ID NO: 273 - DNA, 815 bp, Homo sapiens
agagaacctagcggttacgccaacgcgcgcgtgcgcccttgcgcgtttctctcttcccactcgggtttgacctacagccgcccgggagaagatggctgccccagcagtgtccgggctctcccggcaggtgcgatgcttcagtacctctgtggtcagaccatttgccaagcttgtgaggcctcctgttcaggtatacggtattgaaggtcgctatgccacagctctttattctgctgcatcaaaacagaataagctggagcaagtagaaaaggagttgttgagagtagcacaaatcctgaaggaacccaaagtggctgcttctgttttgaatccctatgtgaagcgttccattaaagtgaaaagcctaaatgacatcacagcaaaagagaggttctctcccctcactaccaatctgatcaatttgcttgctgaaaatggtcgattaagcaatacccaaggagtcgtttctgccttttctaccatgatgagtgtccatcgcggagaggtaccttgcacagtgacctctgcatctcctttagaagaagccacactctctgaattaaaaactgtcctcaagagcttcctaagtcaaggccaagtattgaaattggaggctaagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatcaaaaaaaaaa

SEQ ID NO: 274 - DNA, 5283 bp, Homo sapiens
tggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatataggacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccg

SEQ ID NO: 275 - DNA, 1113 bp, Homo sapiens
atggagaatcaggtgttgacgccgcatgtctactgggctcagcgacaccgcgagctatatctgcgcgtggagctgagtgacgtacagaaccctgccatcagcatcactgaaaacgtgctgcatttcaaagctcaaggacatggtgccaaaggagacaatgtctatgaatttcacctggagttcttagaccttgtgaaaccagagcctgtttacaaactgacccagaggcaggtaaacattacagtacagaagaaagtgagtcagtggtgggagagactcacaaagcaggaaaagcgaccactgtttttggctcctgactttgatcgttggctggatgaatctgatgcggaaatggagctcagagctaaggaagaagagcgcctaaataaactccgactggaaagcgaaggctctcctgaaactcttacaaacttaaggaaaggatacctgtttatgtataatcttgtgcaattcttgggattctcctggatctttgtcaacctgactgtgcgattctgtatcttgggaaaagagtccttttatgacacattccatactgtggctgacatgatgtatttctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgttttatttgtggagtgcaattgaaattttcaggtactctttctacatgctgacgtgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaaaatcaaagttagattttccttttttcttcagatttatcttataatgatatttttaggtttatacataaattttcgtcacctttataaacagcgcagactgaaaatgagggcaggcgcagtggctcatgcctgtgatcccagcgctttgggaggctga

SEQ ID NO: 276 - DNA, 965 bp, Homo sapiens
cagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcaaaaaaaaaaaaaaaaaaaaaaaaaaaa

SEQ ID NO: 277 - DNA, 906 bp, Homo sapiens
ggtgccagatggtgttacctggagcttaaaaagctgcacgcaagtggttaaacttctgacaatggccaagaacaaattaagagggccgaagtccaggaatgtatttcacatagccagccaaaaaaaactttaaggctaaaaacaaagcaaaaccagttaccactaatcttaagaagataaacattatgaatgaggaacaagttaacagagtaaataaagctttggtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgtttgtaatatactggtgatgcatctaattctccacaaagaccaataaatgtgaatgttttatacaaaaaaaaaaacaaaaaatataaaaaaaaatttgttgggggcggcccagggcccaaaaaagttttttaaacacctcttggttggggcgcgggcccccagtgggttagttgaacagtggcgctactaaggcggttccccagaggcaaaccgcggggcgagaaagaagggccgggggtttccccccataaaaaagcgcggggcgacccgagcggttttgacaccaaactccgagggaagttcgggggcaagatcgggagttttaacacggggcgtccagggagactgatgcatgcgcgcagagcgggtgatggtaacacacagaacagtcaaaagaactagtgctgaccaacacaacgaagagagagcaaaataagaaagatgacataaacaacatcaatatcactagttgactactgtaacaccacagtcaaatgaacaaacaaaccatcacacaccaaccgtataacagaacagcaactaatt

SEQ ID NO: 278 - DNA, 838 bp, Homo sapiens
cttcccactccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctcatctctaaggcttaccagaagctctgatttgaagagaataaatggattttgcacaaaaccacaggaaagtcccggagctccatcccgcacttacaacagagtgcctttacacaaacctacggattggcagaaaaagatcctcatatggtcaggtcgcttcaaaaaggaagatgaaatcccagagactgtctcgttggagatgcttgatgctgcaaagaacaagatgcgagtgaagatcagctatctaatgattgccctgacggtggtaggatgcatcttcatggttattgagggcaagaaggctgcccaaagacacgagactttaacaagcttgaacttagaaaagaaagctcgtctgaaagaggaagcagctatgaaggccaaaacagagtagcagaggtatccgtgttggctggattttgaaaatccaggaattatgttataacgtgcctgtattaaaaaggatgtggtatgaggatccatttcataaagtatgatttgcccaaacctgtaccatttccgtatttctgctgtagaagtagaaataaattttcttaaataatgactgtgttttattgttttgatccaagtcaagtgtagcctctcagccttttggagaaaaatgaaacaatttatttcaacttgaataccaactcttcagagaagcaggtaccata

SEQ ID NO: 279 - DNA, 640 bp, Homo sapiens
atttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatatttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaaaaaaacaaaaaaagacaaaaaaaaaaaacaaaaaaaaaaaaacaaaaaaataaaaaaaacaaaaataaaaaaaagagggacagagaaaaaaactacgggggaaaaaaagggaggggggggacgaataaattgaagggggggaaagaaggggcaaa

SEQ ID NO: 280 - DNA, 949 bp, Homo sapiens
ggtgaaaatggttcgctattcacttgacccggagaacgccaggaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccatgccgacgttacaatggtggagttggcaggtgtgcgcaggccaagcaatggggctggacacaaggtcggtggcccaaaaagagtgctgaattttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagatgttcctaaaccagaagaggaggttgcccagaagaaaaagatatcccagaagaaactgaagaaacaaaaacttatggcacgggagtaaattcagcattaaaataaatgtaattaaccagggacaacacgacgacgcagtcacaacaacaaaaccaacgaaagattgataaaggacaatacaacaaacaagcatagcaggagcgggcgcgcggcgagaaagaaggtatcccgggcgagggggcgcccacaatatagtcgagtacgacccacgtcgtcgcgtgtaacacaggggggcccacactaaggagaggccgcataatcagacacaagggcagcccggccagcgttaccatacacgctggcacggggaaaacacgacgcatggcaaactgtgtcgaggcaccaaagtcgcggaggggagacaatcggcaacacccacagagaatgtacacccaggcgacacaaaccaagggtaag

SEQ ID NO: 281 - DNA, 597 bp, Homo sapiens
gcgccgaccgctctgagggttcgtggcccaccgctccttcgcggtccctgccgccaccgtccacgctcagcgtgtagagaagatggtgggtcggaacagcgccatcgccgccggtgtatgcggggcccttttcatgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagctggtgaagagttactagctcaaggtgaatatgagaagggcgtagaccatctgacaaatgcaattgctgtgtgtggacagccacagcagttactgaggtcttacagcaaactcttccaccaccagtgttccagatgcttctgactaagctcccaacaattagtcagagaatttgtaagtgtcagagctggggctgaagatgatgtggaatgagaaacaaatgtcaacataataaaatctcagttaaaaataaaaaaaaaaagaaagaagaaaaggaggggggggaggggga

SEQ ID NO: 282 - DNA, 688 bp, Homo sapiens
ttcggcacgaggaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagcgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagtaaaaaaaaa

SEQ ID NO: 283 - DNA, 1060 bp, Homo sapiens
tttatttagtggcamatggaatgaatgaattagctcttacttgcggcatacttaacaagtctgatcttgcttatagaaattggatcttaatacttcattctcagaatacttcaaaacgtaagccacagtttttctttcaaggatgtgggaagcattcctcattcaaatctgattaatggttttataaagtatgtacctcatttttattagccattatcttcatgctggattctaatattctttttaatggtgatctgttcaatgacagaaacttatagagagaaaattccttctcaatttataaacaaaaattttaaaagcagcatttttgatgtggtaggaagatatttatgacaaaagcagctactgccctaaactggcaaaaacaacaaaagaacaaattgttatttaacctttaaataacgagtctctatttgctataaatctacaaatattttaaatatatttcctcctactgcaataaaaattaagataactctctgtttaacagcttttgaagagttaattttataaggraataaaaaagattgacttgcctcctgaatgtccagtgataaactgaaccctaatttccctacctcaacaacataaaaatgatgtaaagtggatcaaagtatgtaacaagttaatattaaaaatgcttcttcatatggtctttcactaaaataatcaacgtaaaaataatgtaaaaatktgtttttgcttgaagatttagtgaacgttcaaggaatcacaatttttgagcttttacatccagagtactatactatgtgaaaatactacagtgcctcatataaaaaagcacagtgataaaattccaaatgtaaaattgccaaaaatcaataacaactacattctccataatctttccttatctaaacctcaaagctatccatctgttttagtggkttgagtgagcactgaaaacaaacatgtttattcaggktgwaaactaaattactccycttggaatctgggggcaaagrtagtagrgacacttaagggaactcygkccacctctctagsccmtgtgagggaa

SEQ ID NO: 284 - DNA, 977 bp, Homo sapiens
gggcggagcagctgaaaatccggcgcgcgcagtctccagccccaatttctacgcgcaccggaagacggaggtcctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagcaaaaaaaaaaaaaaaaaaaaaa

SEQ ID NO: 285 - DNA, 597 bp, Homo sapiens
  misc_feature 585: n = A,T,C or G
caacttcagcattcaattttattatagtcccatctccctcaacaaacaagatcagcagccagtgtgggatggtgctcaatggggctccacttcccactagagtgtaagctgcttccacgcatgctactgcgtgctccgagccatcgcagcggagtctcttctcacccagctttgatggtggggcgactcccgtgtctgcagctgtggtccaaagggtgtctgtgctggattccgaagttggcggggacattgggcacataccatctgcagcatctctttcttcttgcagccctcttttgagcaacggtatgtaaaaatcttctctttcttcttcccagggtgagagtcacagtctctgtcaatgtgatcaccaaccaccacgtctggtatctggcccttttttactgggatgggggtattacagagtgggcatactgggacgtgaacatccttctggaatgcaaacggacacttatgtgcagcgtatggaaaatgatctttacagaaatcttgtttacatgcatcacattttactggaagaaaatctagctgctttgcagtcttttctgaaacatgcttccccanatcaggaaactc

SEQ ID NO: 286 - DNA, 641 bp, Homo sapiens
acttcctctccagcccctgcgtaatcgataaggaaacccggacgctgctgcccctttctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccaaaaaaaaaaaaaaaaaaaaaaaaaaaaaaaa

SEQ ID NO: 287 - DNA, 753 bp, Homo sapiens
ctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaaaaaaaaaaaaaaaaaaaaaaaaaaaaaaaa

SEQ ID NO: 288 - DNA, 1094 bp, Homo sapiens
gtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgtgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaaaaaaaaaaaaaaaaaaaaaa

SEQ ID NO: 289 - DNA, 3598 bp, Homo sapiens
gcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtaaaaaaaaaaaaaaa

SEQ ID NO: 290 - DNA, 153382 bp, Homo sapiens
gatcttggtacccctaagcttaggttgccagaaaagtacaaaaatctgactgctgataattgcggagcagggacaagtacagcactagatttggaatatggtagtaataaaccaaagggaagggcttatccagaggtcgactagatttaaatcaataagagaatggaattttcattttaaaaatgtattatttatttattattttttgagacggagtcttgctctcttgcccaggctgaaatgcaatggtgcgatctctgcttactgcaacctctgccttccaggttcaagtgatcctcctgtctcagcctcctaagtagctgagattacaggcatgcaccaccatgcccgactaatttttgtatttttagtagagactgggtttcaccatgatggccaggctggtctcgaactcctgactttaggtgatccaccctccttggcctcccagagttctgggattacaggtgtgagccaccgcgcctggccagatggaatcttctaactcgttcttggagagggaaacagaagagacatagcccagcctcaatgtgtttagtcaagatcccagaaataacacacagtggccacttgtttgttttttgagacgcagtcttgctctgtctcaggctggagtgcagtggcacaatcttggctcactgcaacctccacctcccaggttcaagcaattctcctgtctcagccttctgagtagctgggattacaggcacatgccaccacatctggctaatttttgtatttttagcagaaacagggtttcaccatgatggccaggctggtccccaactcctgacctcaagcaatccaccagcctcggcctcccaaagtgctgggattacaggtgtgagccaccgtgcccggccacattgaccatttgattgtaaaatgtaccatacatataaaatacagtatgaatgtatttgtgcaattaaaagaatgaaataaaacgtatgtttatatcctcgcagctacattaaaaattagaatcttagtattcacaggaacctcttcatgccctcttagatggtgtctcccctccccaccaacacacaccagagataatcaccactctgagctgtgttttattcatttgcttgccttctttataattttacaacttctacatatacatccctaaaatcatgtgaagttttgcttttttttttttttgaatgttacataaacagaagcatacattatatagcttcagtgatttgggtttttccccaacactctgtttaatgttgatattaaattaattgtgttacatttgcacagtggggtttcttcattctcattgttgtatagtattccactgtgtgaatataccacgagtgactactccttactactatgaatgcacatttgtgttctgcctttctctgtctctctctttttagtaattctgaacaatgctgctatgagaatctgtaatgcatgcctcctggagtacatatgcaagaatttttctagcatataaacccaggagcagaattgactttcctactgaattttactatcaatctgtttctctaaatggttgtattaatttacactcccaccagaaggtagtaagagttattattgctccccatccttgtcaacacttactattgacttacttttaaatttttcttattcagatgggaacaatatctctgtggttttaatttgcatttctctgattactaacaagatcaagcatttttcaggtatctgtgagccatttgtgttttctcttttgtaaaatacttgtttgtgacttttgcccatttttccattgtattgtttatctttttcttttttcttttcattttctttttttttttttttttctgagagtcagggttttactctgttacctaggctggagtgcagtggtacaatcacagctcaatgcagcctcaaacgcctgagttcatgtgaacctctggccttagcctcacaaatatctagaatacgggcacctggcaccacacttagtttatttatttacttaagagatggggtcttggccaggtgcagtacttcacgcctgtaatcccaacactttgggaggccaaggtgggtggatcacttgaggccaggagttcgagaccagcctggccaacatagcgaaaccccgtctctactaaaaatacaaaaattagctgggcatgatggcgcatgcttgtaatctcagctactcagaaggctgaggcatgagaatcacttgaatccaggaggcagaggttgcagtgagccaagatcatgccactgcaccccagcccgagtgacagcgtgagactgtctcaaaaaaaaaaaaaaaggggggggagagagagagagagagagagatggggtcctgctatgttagcaggcttgttttttcttctccctttgattcataggagttttaaaacatatattttggatattaatcctttgtctcaattatatatttggcaaattccattccaaaccattccccaaccacccccaccccccatccatttagtggttatcttttcctctcttttaaatgtcttttggtgaagcaaagctttaattttacgcggtagaatttatcaacattttccttcatgagtggatatttttgtctcttgttttagaaaaacttaccctttattggattgtaatggtattctcttaaactgttttctaaaagttttatagctttattttccacatctaagtgcttaatacaactaaaattgatttttgtgtatggtttgagtagggttccaatttaattttttgcagttgtttaataaattttcctgcctgggtgcagtagctcacgcctgtaatcccagcactttgggaggctgaggcaggtggatcacatgaggtcaggagtttgagaccagcctagccaacatggtgaaacctatgtctactaaaaatacaaaaattagccgggcatggtggcacgcctgtaatcccagctcctcaggaggctgaggcaggaaaatctcttgaacccaggaggcacaggttgcagtgagccaagatggtgccactgcactccaggctgggtgacagagtgagaccctgtatcaaaaaataaaaataaataaaaaaatcaaacttcctagtactattgattgactttttttttttcttttttgagatgggagtctcgctctgtctcccaggctggagtgcaggagcgcagtggtgcgatctcggctcactgtaatctctgcctcccgggttcaagcaattctcctgcctcagcctcccgagtaactggaactacaggtgcctgccaccacgcccagctaattttttgtatgtttagtagagacggggtttcaccgtgttagccaggatggtctcgatctcctgcccttgggatccacccacctcggcctcccaaagtgctgggattacaggcgtgagccgccgcacctggcccattgattgactctttactcatctctggagcccactctgttataaaatcaagtctccatatatgcattggtttgtttccaggttccctatcatcttccattgtcccctttgtgagatacctctgctaatatcacactgtcttatttacttagcttatatagtaagtattgctatctgggagggcaagtccccttaccttattctttttcttaggggcacttagctaattttgaccttttgctattccctttaaatttttgaattagcttgtcaagtgtggtgaaaagtattgttgatattttcactggaattggatttaatcagtttggggagaattaacatcttcacgctattgataaagctttctactaacaacttgctatttttccatttatttaagtaatttaaaaatgtcttttcagcctggtacagtggctcatgcctgtattcccagcactttgggaggccaaggtgggaggattgcttgaacccaggagttgaaaccagcctgggctacatagggaaaccccatctctacaaaaaataagacagattagctgggtgtggtggtttgtatctgtagtctcctacttaggaggctgaggtgggaggattacttgagctcaggaggtcgaggctgcagtgagttatgattctgccactgcactccatcctaggtgacagagcaagactgtctcaaaaaaaaaaaagagtacatgatttttggtgcatataagcgtagaattaattggtctatgttcttcgtgaattaggtagcaatccttttcatttctagtaatgctttgtccatagtctcttttttatattaatatagacagccccatcagatttattctattaatatttgttttcttgtcctttgactttcaacatttctatgactttatgttttaaaaatctcatgtaaacagtatattgctgattttcaaaaatgtagtctgacaatcttcatcatttaagtggagtctttattacatttatcttattgtgagtactgatatattcaatttgttactaccatctttttggtgctttatatttccatgttttacctcttcctttttgccttcttttgcattgactgagaatttttttcccctctcagtccagttcttctcattcttgtttggaagttatattctttgtgcatctattcttttagtggttatctgttttaatattttcagttaacaaagttaatatctttctgcctcttgaacaatatgaaaaccttagaaatctttatatattatcatctgtttctagtactgggatccagttctagcttaatttttccccccacaaattagatattattattgttcatacaatcacatagatttatatagggttgcctacatatttacctatatctttgctgattatttcttcttctcaaaccttccatctgggaaggtttctattgcttttttttttttttaatttaaaaaaatttggccgggcatggtggctcacatctgtaatcccagccctttggggtttttttttttagacagagttttgctgtgtcgcccagactggagtgcagtggcgtgatctcagctcactgcaacctctgcctgtcgggttcaagcaattctcctacctcagcctcctgagtagctgggattgcaggtgtatgccaccacatccagctaatttttgtatttttagtagagaagaggttttgctatgttggctagtctggtctcgaactcctgtcctcaggtgagctgtccaccttagcctcccaaagtgcgggtattacaggtgtgagccactgtgcccagcccattgcttctttatgaagcataacctttataattttctttggtgagggtctgccagtgggaaagtctctcaatttttggttaagtgaaaatatctatattttaccttcattctggaaagatatttcactgggaatattatcttattattttttatttttagagataaggtctcactctgtcacccaggctggagtgcagtggtttgatcatagctcactgcagccttcaactcctgggctcaagtgatccccctgcctcagcctcctgagtatctgggactacaggtgggatataattttagattcatggttattttctttcagcacattgatgatgtgatttcactatcttttggttttattgttgttattgttgctgttggaaagtcagtattcagtctaaggctccatcttcaaaagtaacctgtcagacagagcatggtacctgtaatccagcactttgggaggttgaggcagaaggatcacttgagcccaggagtttgagaccagcctgggcaacacagtaggaccccgtctctacaaaaaaattaaaaaaaatcagctgggcttggtggcatgtgcctgtagtcccggctacacaggaggctgaggcaggaggaccacttgagcccaggaggttgaggctgtaataagccatgatcacaccactgcactacagcctgggccacagagctcaagaccctgtctcaagaaaacaaaacaaaaaagtgacttttccccctctgtctacctttatggttttatctcccctttggagttctgcctttttaatttttaatttttgtaagagacacagtcttgctctgttgcccaggctggagtgtagtgatatgatcacagctcactgcaacctggaactctgcagctcaagtgatcctcctgcctcagcttcccaagtagctgtgaccacaagcatgcgccaccatgcccagcttggagtgctgcatttttacaatcatagttctacatgtggatttctttttatttattctgctggagatgcacttggctccttgaatctgaaggttggtgtcatttacaattttggaaaattctccgttattatctctttggaaattttatcttccctactctattatttccttcacgaaccctgattgtgaattataactctcatctctttcatattttccatctctttgattctggatgtattctggaaaatgtctgtgccagttttccagttcactaattctctcttctgctgggtctaaccagctgtttaaggccctcctccctaatttaaaaaatggatcattggctgggcccggtggctcacacctgtaatctcagcactttgggaggcagaggcaggcacatcacttgaggccaggagtttgataccagcttggccaacatagcgaaaccctatttctactaaaaatacaaaaattagccgggcgtggtggcatacgtctgtggtcccagctacttggaagggtgaggtaggaggattgctggagcctgggaagttgaggctgcagtgagcagagattgtaccaatgcactccagcctgggtgacagagtgagactctctcaaaaaaagacaaaacaaaactgaatcattgtatttttcattttctaaagtattgtttgtttctgtttcagacctgtttggattttctttatagtctcagttccttgctaatattttaagctcctctgttatttaattaacatgtaatatttgtatttggtaactaaaaatgccaatatttgatgtcccggagggactacttttgttgtctgctgcttgcctcttctagttcacttcctggtgccatgttttctcctaggttttgccttggcactctatctgaggattcttggagtttaaggttaaagatgaacttgtgtgaagatttgcatttgctctttctagttggcactctatctgaggattcttggagtttaaggttaaagatgaacttgtgtgaagatttgcatttgctctttctagtcaagtcacctggttgtactactaatgtggagtccttttatattgaaatactgtattattagggtttttttggactacataaatggtggatctagatagaaaatctgtgtgagatctccttgtattaatagtttcaaattcttagaggagatcttttttcgtgtccttcctttcctgtcaacaagatagacaaatgtcctggctaatagcactgctctttggggcagggtttatttatttatttatttaattttttttttaagatggagttttgctcttgttgcccaggctggagtgcaatggcgtgatctcggctcactgcaacctctgcctcctgggttcaagcaattctcctgtatcagcttcccgagtagctgggattacaggcgcatgccaccaaacccagctaatttttttttttttgtatttttagtagagacggggtttcatcatattgatcaggctggtctcaaactcctgacctcaggtgatccagctgccttggcctcccaaagtgctgggattacaggtgtgagccactacgcccggcttatttatctttatactgaggatgtaaccctttgtggtttcagctttatgcaaggattctcctgacaggttccccaccttgggcaatacctaaacatcatctcagagttgagattcagggtctccagaatctgacagaaactttcagggtgaaagctggaagtgctttttggaaaatgcatttggaaaatgcttacctaccacggttcctgctttcatttatttttgggatatgaaaatccctcccttttgtgccagctcagtgatgcattttaaaagatatcttaaaaatattttacccagcattttagttatgtccgttgagattgtcattcagtatgtctgtattagttagagttctccaaagaaacagaacctatagaatatatagataaagaggatagatacgtatgtaagatatatgtatatcttctatttatcacatatatgtatgtgtgtctgtgtatgtgtgtgtatatatatatacacatatatatgtgtgtgtgtatatatatatgtatatacacacacacacacacacagagacagaaagacagagacatttattttaaggaattgacccatgaaattgtgggggctggcaagtccaaaatttatagagcaaggcaggaaggatggaaatttcacatgaagctaatattgcagtttgagtctggaggcagaattccttcctcttctagggacctcagtcttttaaggccttcaactgtgtggatgaggcccacccacattgtggagagcaatctgctctattcaaagtctactttaaatgttaaccatatgcagccaggcacagtggctcatgcatgtaatcccaacaactcgggaggctgaggtgagaggatcacttgaaccctggtgtttgagatcagtctgggcaatatattgagaccctgtctgtaaaatacataaataaataaataaataaaataagccaagatggtggtgtgagcttgtggtctcagctccttgggaggctgaggtgggaggatcacttgagcccaggagtttaggctgcagtaagtcatgatcgcaccactgcactccagcctgggtgacagactgagatcatgactctaaaaataaaaataaatgttaaccacttctaaaaaataccttcacaacagtatctagactggtgtttggccaaacaactgggcaccataaactagccaaattgacacataaaattaaccatcatagtacctaatccaccagagcgctggaaacagaaggcagagctataattatctcatgataaagtgttagtatgatcaagaagcccagcactgtcatgcttagagacttcagtaaaaagaggcccaaggcgatattgagcatcctcttaggaggctgacagactgttctgtttgcgtagcctagtgcgcactataggtactacaggtcatgtgttcttcctctgcggaattacaggaaaaggaggatacatgtaattgtctcacgttctaggccacagtgatgcaagctactctggaaactgggttatttactcaaacttgcaaaaatcctaaaaatatgaagaaggcttaatgcagagtgataactagatggccaggaggtcagaataatggtcatcttcgtgttagaatgtaaaatatgttttcaggggactgaaaaaaatcatttggggaaaaaagatattcatgatttcttagaagcctaaaaacacgtcgtgatagaaatgcaaacatccagaaattacctagccatcatatacattgatattttcctcacaaggaataatagtagactggctcgtgatgctttttgggtctggaacagcttttttgttctatttgaaggtttggggaatgcctccaggggaagaaggtgtaggggggcagtatcagcagtcaaggggaaaggaggcgagaggatctggctgcctgcctcttctttctttcttttaccaatccttcaagacatttgaatctttctggttcttgatctctctctctctatctcctcctttattatgaaaattgagccatgcctcagcatgaaacattattgattgctttaaaacaggacagtgaaaatctttaaaagaaatttcaaaatatatgcataaccaagggactgggagaaaatacgagcagtagttatctggatggtagaattatccatgatgttcttcttcttttgttttttgtttattttgagacggagtcttgccctgccacccaggctgtagtgtagtggcgcgatctcgactcactgcaacctctgcctcccaggttcaagcaattctctgcctcagccttccgagtagctgggattacaggcgcctgccaccacgtctgccaccatgcctggctaatttttgcatttttagtagagacagggttttaccatcttggccaggctggtcttgaactcctgaccttgtgatccacccgtccaggcctcccaaagtgctgggattacagttgtgagccactgtgcccagctccatttgtgtttaaaataaaaattccaggccaggtgcggtggctcatgctgtaatcccaacactttgggaggccgaggcagaaggatcacctgaggtcaggagtttgagaccagcctgggtggcatggtaaaaccccgtctctactaaaaatacaaaaattagttgggcgtgctggcacatgcctataatcccagctacttgggacgctgaggcaggagaatcgcttgaacctgggagatggaggttgaagttagctgagatcatgccactgcactccagctggggaaacagaggaagactccatctcaaaaacaaacaaacaaacaaacaaagggtttttctcatgcaccgtataatttattttattttattttttatttttagagacgcagtgtcttgctctgtcgcccaggctgagtgcagtggcacaaggcctggctaatttaatttaaaattttttttgtaaagacaggggtctcactatgttgctcaggctggtcttgaactcctggcctcactcaatcctcccattttggcctcccaaagtgttgggattacaagagtgagccaccacacctggccagatgcacagtatataaaactaagcttttatatgctacaaaatcgtatccaaataagatattttagtttcaaaaaacttattttcatgccagcaaaattaaaacttaccaaatagtaacaaattcacataattttataaacttatggaaagttttaatattttagctcttctccagaatttattaattttacatttacatttttgctaaaacaaaaatatttttttccagctgggcatggtggttcatgcctgtaatcccagcattttgggacactggggcaggaggactgcttgagcccaggagtttgagaccaccctgggtaacagagaaagacccaatctctaccaaaaaaaaaaaaaaaattagctggatatggtgcacacctgtgatcccagctacttgggaggctgaggtgggagggtcgcttgagtctgggaggtcaatgctacagtgagccaagatcataccactgcactccagcctgggcaacagagtgagaggcctttctctctctctctctctctctctcacacacacacacacacacacacacacacacacacacacacccagctttcaattcaagctggtattttgcttgtcaacaatgtagcttaaaaggctgcagtcttctttcaaacccctatcgtctatagacagtttagctctagttagagctcttagaagtccacatcaggaggcaaattcatctgtaaaagctgtgattctttggactacataattatggaaaggccagaaagatcagtttaggggcacagaagctcaaggtagttccttctagagagtaattacatagataggaaatgtgtaaatctgtgaacagatacacttgtaagtttctctggggagggtaactattgactgagctggggagaaattagtattagtgataagacctcctaggacttgactggcttttcttgaaaagaaaaaagaatactaaatggttagtagaaaaaaaaaaaaggttctgcactggcatgtcattgttttctggagggttattgggatggtgctcagtgacctctctaatgtcacaaagagcagaggcatctggattagcagagaaattaacatgcagaagagacttcaaaggtttctaccacatccagaaaattctttaatatgtatgtacacgtaaattacatgtattctgaattaagctccacaaaatatctctagatagacatagggcttccttgtttggtggctgatatgagaaggaatgctggaccacttgcagttcttaatgttaaacccatcttttatccagcagagcagttagggtttcagaagcaggactttctcactttggtgagaaacattaaatatacgactaaagattgatgtgatgaaagagaagggaagaatagataagagaaataaaaatagaggtgcaaaataggaggaaggaggggagaaaagaagagagaaaccagaaacggtaaaggaggaagaaaaaatgtgaattgaatgaaaggattaaattgggggtaatggggaataacacttctccacagggtccttcttcccatgaacttttaaaatagagactccaacccataaacaagatgtaacctttcagcagagaaaacatccaaccttctcagttgttaggaagttttttcacactgggaggaaatcttgccccttgtgagtgggtcttactgatattgagaacaaagaaaaaggaactgataccagggatgttgtgcaatggtggggttgccatccattatttctggcccagtttggtgatatctcaccccattcatgcctggaattagaagactcttctttttttttttttttttttttttccagtagagacaggatttcgccatattagccagactggtctctaactcctgacctcaggtgagaagactcttctttccatcctgccctctgctctctctatttttgtcaggtgggtggtttggtgtgaatacatggaattgattctagcagagattgtctaatctctccagcaaaacacttcctcgctcatcgttcccctgcttttccctagccattgtatcttcctcacaaaagcaaacaagaaggctaattgaagcatattgatctaatgaaaacttgtgaccagataaatgatcaaaacctgcattgaaactttgaagaacttccttgaaaatcttgcgcttttccccattgtgcttgtctcttctaatacttgccatcatggctgctgggagatggtttgcagggggtgcttgttgtcccttgtttgtctgtgtgttatatgatagaggagctttatgtgttgtagtaataggaaaaaaaagtggcttgtcctgagttttcctttcaaagtccctttaccaagttatatgattttgggtaaatcacttacctacgcttgcttttctctgtgtgagatggaaggaccaaagtctggcctctaacacacccctacctaccccaaacagttgtcaactcaatttgtgtcctatcagtatgtgttaaacttcatgcaaagtgaaaagcattgaactcaaataaggcacatcttatagcctgatgattgagggatacaagggttggggagaaggagggacatccctcaaacacttgtaagcagcacaggccgaaagctcaccatttaacaaaaacgcctttggtatttaaacttcatggagtaactgaaaaaaaacagtagaaatttagaaaactatttcagactaaatcatttataggaattcaaatctatattttagatttttttcacatactcacagacttgtaaaatcttacgattgttgaattccaatttccaatttttttgtttcaaaatctgaaaattgctaattcctttttcttccattttgtaataataatgactatatattctaaaaataatcactcaagatttgctcacaccagctgataggaaatttcttatctcttgtgatgagttgacacaaagtcccaaaatacaatcatcataatagctacataataaaatggcaataactacctcttactgactcttactatatgccaggaactacgtaaagctttagctccattctcttatttaattctcacatctgtcctgtaaggtagttactgctttaacctcattttacagataaataaacagaggcctaaattttagaggctaagcccacaagtgctcattaagaagatacaccaagatccattcatttgtatgtgtaatccatttggacatgctggcacaaagacacataggtggatcctgtcttcatgaaacttatagtctgctgggagatagaatcttcactgattttgcttaaatgactacaaaaatccaaatctaattagagaaaaaatagtctttctattaaactggttatatttaattttgaaagttggctcttagttgtatggtaattttgggatcttttaaataattataagaggcatttattttcttaattttttataacagtttgttgttgttgttttgttgttgttgttgttgtttgagacagagtcttgctctgtcaccaaggctagagtgcagtggcgtgatcttggctcactgcagcctctgcctcccgggttcaagcaattctcctgcctcagcctcccgggtagttgggattacaggaacacgccactacacctggctattttttgtatttttagtagagatggggtttcgccatgttggccaggctagtctcaaactcctgacctcgtggtctgcctgcctcggcctcccaaagtgctgggattacaggcatgagccaccgcggccagcttataacagctttattgagatataattcacatactataaagttcatcttataaagtctacaattctgtagtttttcatacattcagggtggcatatccatcactactctcaaattccagaattttcatcactcaaaacggaaactccatactcattagcagtcacttcccatttccccataccagcccctggcaactactactaatttacttcctattttattttattttattttattttattttattttattttattttattttattttgtgacagggtgtcactctgtctcccaggctggagtgcagtggcgccatcttggttcactgcaacctccacctcccaggtttcagcaatcctcccacctcagcctcctgagtagctgggactacaggtgcacaccaccatgcctggccaattttttaaaaaatgttttgtagagacaggcttttaccatgttgcccaggctgttctcaaactccagagctcaagcaatccacccaccttggcctctcaaagtgctgggattacaggtatgagccactgcacccagcctaatttacttcctatgtctatggattcacctattttggacatttcatataaataaaactatacactatatagccttttgcctcggcttgtttcacttaggataatgtttcaaagtttatcttgtagcatgtgtccgaacttcatttctttttttgttttgtcaaataatattctgttgtgtgaatatgccacattttgctgatctcttcataagttgatagatatttgagttgtttctactctttggctattatgggtaatgctaatatgacattcgtgtgtaagttttcatatggatgtatgtcttcagttctctagggtatatatctaggagcagaaccactggatcatacagtaactctatgtttaacttcttgaggaactgccaaactattttccaatgtggctgcaccattttacattcccaccaacaacgtatgaaggttctgatttctctacattattgacaacatttgctatcgtccatcctttttattatggttatcctagtgggtgtaaagtggtatctcattgtggttttcatttgattttcctaatgactaatgatgttgaggaggcatttatttttatgatttaaaataattttggctgggggtgttggctcacacctgtaatcccagcaatttgggaggctaaggcaggaggatcacttgagctcaggagtttgagacaacatagagcctggacaacatagagaagccctgtctctacaaaaaaataaaaaaaattagctgggtgtggtggtgccccctgtggtcccagctcttcaggaggctgagatgggaggatggcttgagccagggagattgagcctgcagtgagccatgatggcgccactacactctagcctgggtgacagagcaagactctgtttcaaaataaaataaaataatacaataatctcaaccagaggagcacaatagaatcacttgaagagcttttacaaaatactacctgagcctcacactactttatgtggtgaaaatgtataatagaacaccaactcaaaatggcttaaatcataaggaaaattattatttcacacagcaaaagtgcaagtttgggggattacatagttgtttaatataatagcccagtactatcattgcgacccaacttcctttcttctgtgtctcctcagcacgctcattttgtctgtacgcttactgcctttgtagtggtaaggtggccgctggaattctagacctgaaaatatccagtggaagaaaaacctttcccagaaacctctggctgtcttttatgacacctcaagggcctagaactttatcacatgcccaaatctaaacccatcacaggcaaaagaagtcggaattccatttctatgatttagctgaagtgagatttactaccttcctaaatgggaattaaatggaagtactaacagggaaaaagggaaaaacggatgttggacaggcaactaacagtgtctctgctacaggctacaacatcatgatgatgtgaaatattaggttgaatcttaaaattgctgctgttggggctgggcctagtggctcacacctgtaatcccagctgtttgggagctgaaaggagaggatcgcttgaggccaggaattcaagaccagcctgggcaacacagcaatactccctcttttaaaaaaagtagaccaggcccagtgcctcacgcctgtaatctcagcactttgggaggccaaggcaggcggatcacgaggtcagtagatcgagaccatcctggccaacatagtgaaaccctgtccctactaaaaatacaaaaattagctgggtgtggtggtgtgcgcctgtaatcccagctactcgggaggctgaggcatgagaatcacttgaacccaggaggcggaggttgcagtgagccgaaatcgtgccactgcactccagcctggcgacagagcgagactccatctcaaaaaaaaaaaaagaaaaaagaaaagaaaagtaaaacaattagccaggcatgggggcatgtgcctgtagtcctagctgctagggaggctaagaggggaggatcttttgagcctgggagtttgaggttacagggacctataatcacaccactgcattccagcctgacgaagcaagaccctctctctaagaaaaaaaagtgctggtattgaaccactgacacaacactaatttcatatcttcaacctagtaatttccaatcctatttatacagacagcctgggttgaggggtggggagagaataatattggccctaggttttagttcaatcacttaatatagctcatgaagtgtgaatcacttacattgattgatacaagtaaatcagactcctgtgagcaagaagaatttgcataatacaagatcttatttgatttctttatctctttcttggcacatctcaaatgttaggaaatattttcacaattccaaggcccaaagcatttgtcccgatgcacgtgctgatgaagcctgtgaatgttttatttatacagaattaacagtttgttgaattttaattttgaacaattaaatcacagaatgcattattctgtttttgttataaaacatttaaaaatttcaaagagagagtgactgtgtaccttccattttaggggtcttttaacccaggtagacttcgagaagtctaaaatgagctatttagtatacggaaatgaacaaagacacttttaagactgggccacccttgaattgtacagagctatgcagagagcacattggaaaatggcaacccattctcttttaaaaatgtagatgtacgttttaactcatttttttgtttgttttgttttctagaggcggggtcctgctatgttgcccaggctggtctcaaactcctgggctcaagagttaatttattttttgaataggtaatatacacattaaatatttctgatctgaaaatccaaaatctgaaatgctccaaagtccaaaactttctgagcactgacatgatcctcaaaaaaaaaagttcattggaacatttcagatttaaggtttttggattaggaatgcttaaccagtattgacacagtatgaaattctaaagatatgaaagttatagtgaagtgtccctcccacagctattcctcagccactccattgtcttcttgaaaacaactactactaggaaatttctatgtcaaatcccacctttccccaccaatagtgacgtactttacacaatgttctgctccttgttgctgttgtttgtttgcttgctttgttacctaacaggctattttggagactattccaaattggtacataacgagcaccctcatctattttttatggcagcataacagtcctgtcgaggatgtagtatatttctttaaccagttccctactgttgaacagttagattgttttcagtctttcactattataacaatgctgcaaagaataaccttctacatataatattttctacatgtgcaagtatatacttctagggaaaattcccagagaggaattgctacatcaaagcaagattacaaaatttacaaaaattaccaagatagataatgccaaattgcccagagagattgtagcaatttaaatgcctgcggcagtgcccgagagcacttatttccccacaagtgacagagagctttctagaaatagatatcaagttgcccccacctttaatctgggtatgtggacccaaaaggtatcttgttcccatttttacaaaaaaagggaacagaagatgctaatgatggacaagcatggtggcccacacctgtaatcccagggctttggaaggctgaggcaggaggattgcagctgaaggattgcttgaggccaggagttcgagaccagactggtcaacataaccaggtagagcctatctctaaattgaaaaacaatttttttaatgttaaaaaaagaaaaagaaaaacaggctgggtgcggtggctcatggctgtaatcccagcactttgggaggctgaggcgggtggatcatttaatgacaggagtttgagatcagcctggccaacatggtaaaacaccatctctactaaaaatacaaaaaattagctgagcgtggtggcttgcacctataaccccagctactcaggaggctgaggcaggagaatcgctagaacttgagaggcggaggttgcagtgagccaagatcgtgccactacactccagcctgggtgacagagtaagcctccttctcaaaaaaaaaaaaaaaaaaaaaagaaaaatgctaatgatatggtattaaggtattaaagtaacaaaaagtagaatataatctgaactatgtaaaaatttgaggggacatagaaaaatgaatagacacaattaaaatattgcattaaaatattaaatagtagcaattaaatttataaaattataatttaatttataaaattacaatattgacagtatttaaaggtttgtgctttttgataattagctctgattttgtttacaaccagaaaacaatgatcaaatagctgctgttgtccttgggctaggaatcccattcccttgcaagttatctcagaggagtgctcctttagcaaaattatttaaaggattctccatttggttccactttaggccgggcacctgctgtttgttccctcagtatctcctttacattgccctcaaagatgccaaggaactagagcagtgtccacaactcatctgcctagtttggcaaatctaccaaaaataaaactcaattttttttaactttttaaaataaattgctctgctctgtcaatattatgatcacagtggagctttatctcgttttctggcttttccactgcagtttgtttttcactgacaccattaaaatatttctgaaccccaaaagatcactctatccagaaaaagtcctgctcatttgtgaagagtctttaggtccctcaggcagtttacagctcagcttctgcaagggcagtgtattttggagcatttcctcagggagataactccgaggtatacgagttcccggccctgactcggagggatccgagttccttgctctctcagcataaaggctgatagctgttgcagttgcaattttctctctaaacccaactccttttgttgacttgcagaggcttacattccaaaaaaggtaatttgaaagtgctgctgaatttagatgcattttgctaatttgtttttattatgcatagaaatattggtataaaaggtgtttcaattattttctaagggagggacctatgtattctctgcagccacaaagcttttaaatggagttatttttctcggcctatagccgctctcccttttaagtaccccagcagaaaaagtaagtttactgctcctcgcacaatgggcctcttcacttttcaggtttgggagacctgggtgacctacgaaagttaattagaaggttaacaaagacgaagacagagtcgaatccatcgtttctccttcagccaaagatgtcatccattaattagggaaatcgttaaggtggcctttatagaatccatagaaaatctgtcgttggcggtcgacagttttgatcagattttcctctccccaataatgctatccttaatggtacgaaaagcagagggccggggcagggagaggggcgcggggagggggtgggaaggatgtgtttcagcaacagtacagttaaccagccgccggtgctgacggctttgattctcaggctgccccgcatacttgctccatgatgtaatccttattgaacctggaggccgagggagcgggaggagccgtgccaccgcctcgccgccgcaggaggccccgggagttaatagcgccggcctctgggggaagctgcgcctgggtccgcagccgaggctgccactcagctgccgggaggcgactcggccccgcaggccctgggctggggcagctccgtgtgggggcggccctccagccgtgcggtggggcccggctctgtctccgttgctttgaggctttctccctgtctctctagggcttcgctggtttctctctccttttcctttgattgtctggcaccgaaacaccagctgaacgaaggaagagttccagtctgacaagctgtttgcgaatggaaagtctggtgttggtggtggcacagacacgccctgcctgccatgccctcgctcgccttctctcctgcacgtacaagactgtatctttcagtgtgaatatcatgtatttaaagggtttcggtttgaatatcatgtatttaaagatggtgttaactctgagtatgggatgcctttagttttcaatgtggattttttttccttcttattatgttaaccatttgaaagtgtacagttcagtggcacgaggtacgttcgtattgttgtgagaccatcaccacagtcctctccagaattttttcatcttcccaaatggcaactctgtatgcacggtggaacttatttttgaaactacatggcagggttggttccatctttttcaagtgatcatcaatggattctctttaaggaattagcatcttttaatggattggagtttttgcgtagttctctatggcaaaagctggaacaatgtcacatggcccttgtttaccatgcaaaaaatgtcagtgtacttttggcctctcaccagattgatattgaatgaatattgcacaaaaccttgcctcgacggtaaattgccattttggtttgctttacttccctcatggcagagtggataagaggtgctgcccctcagcaaagagggaagtgtcactgtccgctcctagcagcacagaggaaagaaccacagacaaaatcatatctggtgacaccacctacacccaggcccagtggcttcctcagctaggatggagaggaacttctctccctgtcgtcttcccagccccatctcctccccaccctgcaggaggccaaacttagacccagtagccctttagtgggaccattcctcttttcctggctgtgagctgggaaaagcggggaaaatgagggagggtggtacgctcccaacttcccagaagaaaaagtagtaattgtcaaaaatcagcctaatgggctgggcctgggtgcagtggctcacgcctgtaatcctagcactttgggaggccgaggggagtggatcacctgaggtcaggagttcaagaccagcctggccaacatggtgaaaccccgtctctactagaaacacaaaaattagcctgtaatcccagttatttgggaggctgagcaggagaatcacttgaacctgggaggcggaggtttcagtaagccaagatagagccattgcactccagcctgggcaacgagagcgaaactccatctcaaaaacaaaaaacaaacaaacaaaaaaaatcagctaaatgatgataagtgcatggaaacaactacatacattatgaaacataagccagagctctatttgtcaccaacaccatagtttaaacaaaaccccaccattcccatatccaaagaatctctatttcccccgaaagctctgtgcctttgatttcagttttattgcatgtgtacttagcacacctatgttgctaaattgctctatattcctttgcaggtacagctagaagagtataaaggccctcaaccaattgaactaagagactgttagtagtcaattggtgtagctctggggctgagctacataaagtggccccatccagctcctctgtccccctaactttgcttgatgatgtaccatgtctgcccctaaacagcatattagaattacctgatgggctttaaaaaactcccaagacctgagctgcacctcagactgattacataagaatttctggtgggggaaactagagtatggtatgtttattaaagcttcctcaggggactccaatgtgcacttatatatctaaatctaaggtgatttatgtagttgagatttatgagatgagaactatgctagttaatttctttttattttttagagagggtctctctccatcacccaggctagaggatctcggctcactgcaacctctgcctcccaggttcaagccgtcctcccatctcagcctcctgagtagctgggactacaggcacacaccatcgtgcctggctaatttttgtatttttagtagagacggggtttcaccatgttggctaggctgttctccaactcctgccctcaactgatccaccacctcagcctcccaaagtgctgggattactggtatgagccactgtgccccaccaaggctaaagaagttttgaggtgcatgctggaaaatgtctagattgctgaggaggggttgttgatagaaatatggactttatttatttatttttttttgagacagagtcttgctctgttgcccaggctggagtgcaatggcacgatctcggctcactgcaccctccgcctcccaggttcaagcaattctcttgcctcagcctcccaagtagctgggactataggtgcgcaccacccgcccagctatattttgtatttttggtagagatggggtttcgccatgttgcccaggctggtttcgaactcctggtctcaagtgatcagcctgccttggccttccaaagtgctgggattacaggcgtgagccaccacggctggccgaaatatggactttaaagacagttctggtgaagactcggaaagagaagagagttggagagaaagccttcattttcttagagaatacacataaatagcaatgagcagaatgttggtagaaacgtagacctcgccaatctggtaaggtctcagacagaaatgatgaacaattattggaaactagagaaaaggtgctctttgttgtaaagggaaaacgaactttgctgggctgcgttctagtgttttgtggaaggtagaacttgtgagcaataaaattggatatttagcagagaagatttccaagcaaggtattgaaagtgaggcgtgggtctgccttactgcttatagtaaaatgcaagagggcagcgataaattgaagaaggaattgttaaacgaaaagacatcagaacttgaagatgtggaaaattcttagcctattcatattgcaaaaaaatgaggaatcatgttctgaagagaacactaagggtgtggctgagtgactatttaataatgaggttaatgtggatgtgaactacgatctaatcagccatctcagcagaagccaggaatggaggtaggattataccagcaaaacttcactagctgggagaaaactggccagaatgaaggaaggctgtgaacatgagctatcctttaagaaagagaaaagtgacctgaagccagttcagagatcaccaaggctgtcactcccaccacaagcccagaggcaagactattttctcctcagtttcagaaggcagagcccttgaagacagccatatgtgcagggcctttctcaagagctggagaggtggggcaccctctgagctgaagaattattctcaagccttaccatctaatggaagttgcctttccaggttttggactttcttgagacctatcaccctttccttttttgctctttctcccttttagaatgggaatgtcaaccctatgcctgtcccaccattgtagtttggaagcatatgatttttctggttttatgggttgctagctgaagaggaattttgcttcaggatgaatcatacattgagtctcacccatatctgatttaggtgatatttagatgagattttggacctgaaactttgagttgatgctggaattagttaaaactttgggggctattggggtagaatgcatgtatttgcatgtgagaaggatatgaatttggggggaccaggaggcagaatgttatggactggatatgtgtgttccctcaaaactcacttgttaaagccctaaacccccatgtgcctgtatttggagacagggtctgtaagaaggtgataaaggttaaattagctcataagggtggggctgtaattcaataggacttgtgcccttaaaagaagaggaagagacacttgagctctttctgtctctgccatgtgaagacacagagaaggcagccacttgcaagccaggaagagggccctcaccagaaaccaaatcaagcagcactttgattttgtaattctcagactccagaactgtgagaaaatgaatttctgttgtttaactcacctagtctatggtatcttattatggcagcctgagcagactaatataagaatcatacaaaggtgataccaatcactgccccaacccatattcccttttaaaataacccaccctggcccactggtccagctgccctgtgggccacatgctcctggtgccctcagtttattgaccagaggtaagcacctgacccaggtaactcacccccaccctggccatgggcccctgtaacatttcccccatgaaatccacaaattagagcttcctttaggttacgaagaccttcttttgaattgcgtcttctctagtgatcattcatgttagaatgagttaacttggtcagataatcttaatactcaactaaaaagctggttgtgacagtaattttgaagcctgaggcacttccaaaagggacaggcccaggaagtgtgtagtggttacaaactttcaggagcgaaggacagcatgggtaagggagaccacgggagaagtggctaggaagcaggttagggagggcgatgggagattgaaggatgcaagtcaaacctggcctgcattgccatttcccccaggctttctgatcaaacgaaccctccatctttcccatccaagtcatcctgagggtgacctttatcctaactatcctaatcagagcaaattgtattgtaagggagtattagtccattttcctgctgctgataaagacatacctaagactgggctatttacaaaagaaagagggttaatggatttacagttccatgtggctggggaagccttactctcatggcagaaggtgaaaggcatgtctcacgtggcaacatacaagagaaaaaagagcttttgcagagaaactcccatttttaaaccatcagatctcttgagacccactcactatcatgagaacagcacgggaaagacccgcccctgtgattcaatcacctcccaccaggttcctcccatagcacatgggaattgtgggagttacaattcaagatgagatttgggtggggacactgccaaaccatatcaaagggtaagagacctcttctaacttccttatgtattgggataagggatggtggttactgagtggaaacgggaaatatagcagagcgttttgggaaattgtaggtatttctctctctctccctctctctctttcctctctgtggccctgtagcttcttgtgttagcttaccacctgggcagatgtgcccactccctctgcacaatagctctctcagccacaacagtcagggatggacctggcaaggggtttaagttaccaagcatctactgaggaaattcatgctgaaaattcctattcagattgttagaaacagccaaatatacctttttttttttctattttaaatcctaaataactagattcaaatttggattaatgggtacactggggaatgaagtaatctgattcattttattttctgatgaaaccttcaagttaaccagaaaatgcttttttcttaaaaaaagaaaagaaaaacaacagtacccaaaagtgtttctaaaatatttacttttctctctttgtaaacatagtgacaatatttgtgttctcctggtgatgtgtgagtcatgagtttaaacagcagttcccatggaagggatcacaggaagaaattaaaacagaactgggtttatgggtcagagcatgcctcagcccagcggtgacatcagaggagcctcaggcatgtcactgaacctttttgagtcctgctttcctactatggggagggaaaatgaaggtggtcatgcttgtccttttcgtcagggataattactttaaatttatatgtgaaagtaattagtaaattgaaagttatgttgttattttagtctttggcatataccaggggtccccaacccccaggccatggacaagtactggtccatggcctgttaggaactgggccacacagcaggaggtgagcagaaggtgagtgagcattaccacctgagctccgcctcctgtcatatcagcggcagcattcgattctcataaaagtgcaaagcctattgtgaactgcataggcgagggatctaggttgcccgctccttatgagaatctaatgtctggtgatctgaggtggaacagtttcatcccaaaaccatccctccacacctgtctgtggaaaaattgtcttctatgaaattggtccatgccaaaaaggttgccaaaaaggttggggaccactggtacataggacttgctctataaatgtttgttgaatgatttctgcagtgctaatgagctccatgcacaaggtttaggaaattgggctgaatctgtacaaatcccagatcatactttgaaaaactgtgattagttttcttgatactaaattcctcatatgagcttgtcctgttagcactttctttcacaaagtgagatgtagaaaaaaaaaaagtaaattgagcgttcagttcattgagttcaggtttaactgagctgctactatacaatacagtcaagctgctactatacaatacagtcattaataatgtattctacttttttaacttattcaacaaatatttaccaaggagtatgttgttgaacaggaacaaacatggtccctgccctcatggagctgacaatctggtaattgaagcaccctcatacattaaaaaggcactggggagatgcttcacctctccctcatgggttttctcagtcccttccaacatcacttctgaccaggactagaaagaagtggggaaagcaggacaaacacgagggtctggcagtccaaaaaagggctggggactgaacacaaaccccacatcaagattttcagatcactgttcctggctgggagttggaaagcttgttttttcttcttttgtcactgaggctagaatattctcagtgatcctgctttttttttttttttttttctaacagtatccaaatgccatgtcttggtttaacttcaatctgacagtaacaaatatttttgagagcctatgaagggtcaggcactgtgttgggcactttccatattttgtcgttaattctcataacaactttgcaaggtagatactattactattctcaatctgcatttgaagaaattgcagcttgtagaggatgtggccaagatcacaataggtggttacaacagaaataaacccagttctgtcctacttgagtgcctttcctcttcctgcctagccatgcagggcctatagtcaaacagaacagtgggaactttgttttcctatttcttcccacaataggagggaaatgcttttccaacacatcaaagaataatgataacaatagctaatattaactgagcaattactatgtgccagacactattctaagatctttacatatatcaactcatttaatcctcataaacctatgagtggttactcttattatttaatgttatctatctgtcattttatagataagaaatggagaggttaagcaatatggcagaggcagtttgaactcaagttacctgagtctagaactttaaaattgttatttcaggcagggtgcggtagctcatgtctgtaatcccagcactttgggaggccaaggcaggtgggtcacttgaggttaggagtttgagaccagcctggccaacatagtgaaaccctgcccctaacaaaaatacaaaaaattagccaggcgtgatggcaggtgcctgcaatcccagctacttgggaggctgagttgaacccaggaggaagaggttgtagtgagccaatatggtaccattgcagtccaacctgggcaacaagaatgaaactccatctcaaaaaaaaaaaaaagttgttatttcatcccaaataagtacactactttcaacatctatcacagttttcttaagttgctgaaataaaggatgggagtgacccctccgtcctcacctcctacccccatgagcagaagacacaattctgtccacccatagtctgtgtgaatgtttccctccagcacagtgcagtgtggaacctatataactgtaagctgcagccatgaattccatccaccatgaaatggcacatgaccaaaaaatgcatgtactgtattctaaatctgagctatctgcctaatttagtttttgttcccaagtgtaaaacattccaaatgtataacatatcccatagatatgtgagttccctcaaagggttaacagctctccttgagaagaggaattgaagaaacctgagaaacattttctttaccagttcaggcaggtgacagaaaggtaaaaaattaattttaaaaatatgagatgtttgggtctttattcccactggctggctatttgggcaaattgggcagtggcatcactgattgggctccaactgcgggcacagcagaggcagaaggcagcaggaaattatcagggcatcaggctgatgaattctaacctcagtccactaatgtctcacctaagaacacgctccttctttctgcatctcggagacacacatgaaggttctctgaagcaggctgatatcctctaacgtaaaggatgatatcctatagtttatggctggaaccattaagggtgcttgataactgctcattaaataaattaagtgcctaaaatataattactgatgttctacttttcccctgtctttgctgcaccacaggaaaaagtttccacggccattgatttatatgagcaaaaaccaaaattaaattaagaggtcacacaccagtagcaaaaacaaaatgaggaaaacattttctaatgttttactgcaaaggaatcggggcttttacgtaatagcaaaattagggtttagatggtagtattctttcaaccaacttttcacaaatatttcctggaactggcccaaggaatgaatcctaatttagcctaatctttttcagatgtaattgaattcacttgtttaggtttctgcctcctccacctttcatccggtggcaacacacgagtgtggcttagctctcacagggcccacggtttagtctgcaggccatgttgggatccacttctccagggattggccagagatctctgaggctctcagtcctttcttctacagctactgttttccccccacccctgagaaattcctccagaccttgtttgtactcccccatctacttatcaactcccccctccacctctctgcaccccaatcaccaaagtttactatgaaaatgagtgaccccatttgctgagaaagagatagtctctgggagcaattgagtgagagaaaacatgaacaaaaagtctagaacccttgactgaaatcacttaggattgcactagctgccactgagctgaagcaacatgcattcctagtggctaagggatccgtgaagcatgagctcgaatccctagcttttgttgtgtggggctcaggaaaggatttagcactacctacatcaggttggagtgaaaggtttctaaggacgcactcattcccatgatagcctctgagacctcaggcctctggctgggcatctgctcagcccggggacaggaaaccagctccacagggaggacaggcttgccagacaatccccaccccaggcaggcaccccccttgtgctcccggagctctccctggcagggtggtggctcgctgacagttcatcaggttttacaaacattagcttctacatctgctctttgagcttaaaaatctcttcagatgaaggcgctacaagggtaagaagcctgtgtctctctcctttctgtccttgagtggaaatgtagagatagtttttaaagaagaatttgattcggatgtagaaacttaaacaaaaagacttgtttatttcctctttggggattcttttctcccactatgtgtatcagaggctaattgctgtggacacgcacgtgcacacacacacacacacacatacctgcaaacaccagcaccggcagtctctgctcttgtactcacatttcatcctgaggatgcgggtgcctctagaacaagagcccacagtcaatgcggagtagagtttggtgaggagccagcaggccggtgggcccccgtcttgccatgagtggttctttaggctggttctcggcgggaatcagagtctgcgtgatttctgccatggcttcccagaacctagttgtcccgtctccaactgcagccttctacgtgcaacaagggaatgtgggcttctttgaaacaggcttcttagagcaggagtgtaggcagccaagtgtgaagggtgtcagccggggtggcacgccctgggggaagatgtgggaccagctgggtcctgggccaactgcaaaagaggggaagcctgctatgagagacagagcagttctccaaggatcccacttgctccagaactgtcttttgtcattttaaagtggcgctgtcatcactggtcttaccttggctccaggacatgcactgattttcattcattaatgtattccttcaaaatcaagtcattcacatacgaatgctatttagttctcacaatccatgaattaaggggcattgtccccattttattaatgaagaagccaaggcttcagagtagttaggcagtgtgttcccaaggtgaggccatcagttactggcaaggacaagaagtgtcatcagaatctggcctcctgactttgaattcttccccttgcacacctttaatcaatggacaggagaggacagtcagtcctccgtatttgtgggttctgcctctgtatattctaccaattgcagatccagaatatttggaaactttttccacaaggttttaaaaaagcaaacacgcttgaatctatggcactaagtactacattgaattccttggaactgatgtgcaggcattgcattaggtattaaatctagagatgatttaaagtatacaggaagatgtacataggttatatgcaaatactatgccattttatatcagggacttgagcatcttcaacttattattattatttttttcagatgaagtctcgccctgtctcccagactggagtgcagtggtgcaatcacagttcactgcaacctctgtctcctggattcaagcgattctcctgcctcagcctcccgagcagctggaactataggcgcacaccaccatgcctggctaatttttgtatttttagcagagatggggtttcaccatgtcagccaggctggtctcgaactcctgacctcaagtgatctgcctgccttggcctcccaaagtgctgggattatagtcatgagccactgcacccggcccatcctcaaattttggtatgaggtggtgtcctggaatcaatcccccatggataccaaaggatgactgtactgtattcctagcatgaattcagtatcaatcaggtactgttgagaattcagagacaccataacttggtttctgccatcttggttacttacaacctggttagccaccatgaagagctaaggaagggctgggtagtatgtgcttaatgagttatgggttcattggttcagcaaatgtttcttgggcatcgcgtgccagacattggtaggagtagaggaacacaaagatgaaaagcatgtagtttctattctccaaaagttcagtcaagacaagggggacctcactgctcaaacctgttcaatagcttcccattgcttccagggtgaaattcaaaatccctgtgtggcccacaaggctgtttgagacctgacctttgcgcctctcccgagcctcattctgctccagccacacgggacttcgttcagttcctccatcaggctcactttcctccctcggggtctttccaccctggcatggctttacagaagtgttatgtgagcaggggcttgaataatgcataggtttccaaacagaaagtgatggacaagcgaggtagaggagtctgagtggggaggagcatactgaggaagagtagctggggaagtttcatagaaaaggcaaaacacccgctgtacgtaactgacagtcaataactatttgttgaacggagctgggctgagaaggctagagatgggcagaagctggaaggaaaggagctgggggagttgggggaggaacacctgcgtgaagcctcagaagctagaatcgcctgaggacaaagatgatgggggctgaaaggtcagccatccttgagttggggcgggggcggggttgaggtcctttgggcaagttcaggggtcagacagtgaggtgtgggaaggtggtgatatgtgggatgggatggcctggcaggtgagagagctgaattccagttgcagctcagtgcctggcttggtgatcttggtccagtcacttctctgggccccaggatttgtgaggatgatggagcagattatctctaaccctttcctttccaggtgaatcgtgctccttaacagtcaggtgatgacagagttgcaggaaccaggatggatgccaggtgctggaaaagaggaggaaatctcaggaggctagagacagcccaggcctctgcagcacccggggctgcggaaagaactgggggctggagggagagacagaaggtgaagttccttccaggggaggaatgggtgggggtatccacagcctgtgactcatcagtgtcccaccaggaccaggtcaaaccccagcagaattctccaagacaacccgactttctctcattcctgccctgatctcaagtcctcttgcgggggggtcaggcctgccatcagaggagaaggctgctgtggccagtaaaactgagggccaggctggacgttttcaaagagtaagcggggagggcaaagagctgaaggggctctcaggactgtccaagtaacagaccaagcccctcacataggtttttttctctagtgaccccattctgccccatggatgtcacttgtttttttctttttcttttttttttttttttttttagcttttgggaaggaggagcaaggcgagggaggtgggaagagactttttttttttttttcacatgagccctcagaattacagttcacaaactattcagtaaactgaccggcctcaacctccccttcaacggcctaatctaaggggtggatctatgtgttttgttgcttgtcagaaacaatcgctgcgcggcccattacatttacagcacgtcgccctttaattggtgtaacacgctgaggcctgaaaggaggagaggcccacaaaggcgcccgtgaatgagccttgactcacacaaaaacactctgcagaagttcagagctggccactaacaaggaggtagggagttagtttgaaaagagggtgaagttcagaaatgtgtcaccttgaggagcctcccatcaaagcaatggtcgcattgacaagctgcaaagaaaaaaagttaaaccttcagggctgcggacttgcctgctggatttattcttaaacttgaggaggggggaaggagagggagagtctttctttttcttctcctcttctccacccttgtctctctgcgcccccccccacccctatttacttcagagagccttaaagaagtcccagcaaagaaacatacctcccacccccctgctaagatacacttttaaaaataaacgtataaaaagtcaggctgaatgccgctgcctgaggctgctgctgctgatttcggcctctgtgggaacagcgatttttccctgccctctagtgtgtcccctgcccatcttctgaggcaactcctctgggcggggggcgttgcggcctaggccggggcgccgtgcgggcctggagaacgtgtccccagaggccgccagggccagggcgtgcgcgcagggtccgtgtggcagaggggaccaggtcgcgcgccattcagaagcatttgggagaagggatccgcccccgcgccagtccagctcagtggggtcttgcgtgtgagggtcctgccccatcccaggaaggactcagttttccctcctcctgcctgtaacaccaggaagacccgacaccggcccacgcttcgattccaattgcgaagtgagacgtctttaaaagaagacaccaccgtgcccggggtagaggtgggggaccgagtcgcacctcccattccccggacttccacggtgatggactcaacccctatagcacaccttcctcgctccagatgcccggaatctccccagtgctggtggtgctgcggtagacctccctcggtccccttcctgcaccctgccccacgccttcctcggtggggggcgccctgccacgcctgcgctggggtgggcacctccgcgtctcctgcccgatgcgcgcccgggcgccccgagccgccctcctccgctcgccccctccccgcctttgtcccgctatcggacccccgcccctcgcgctgctcctgtgaaccggctgcccggtgcgaaggcgggggcacttttcaatgcagcgccgcagctccctccagatttgtaatccgccaaaaagccgctgattgccgcaatcgttacttttcattaaaaaaacttagaagcaatttgggagaacccttctcaatgaatacatttacccccgaacggtctttattctccgcctccacttgatgagtttctctggcacgaatcggttcttacaggcacagaatgggcaatcccttgatccccgtcaattgtcatcccgagtcggggccactttgaccgccaatagtggggaagtcagagctaatcctcagaaggaatcacgggaaaagaaaagcaacaataaccaagtcaagcgtaaaaaatgaaagagaaatctctattatcactcactacatttcccagctatgtactgaaaaaatcagctcgcttgtcattcgagtcagacacccgcacaagaatatgaggtcgtggtgggttggtagactcacacgacgtaagggacgatatttgagagcgaaaggcctctcttctgcctctgccaaatccccctcacatccgccataaccattaaatacagactgactttattctgtatggggaggccaggggtgggtggtgagggagcccccagctgtgcctggatacaaaaaaaaaaaaaaaaaaaatccctggagagaggggtgggggcggggtgtggatgcgaaagaaacgcgcccctagccggtacctcccgctccgggccccgcaggcggctgggcctcgtcagcccgggttcagccgccgcgccggccgccccctgcgccccctgcgccccctgcccacggcccccgcagcccggcgggcgcacggcctcggcggctgggtcctcgcgcgggcgcaggtgtgcagggcaagcgcggacgggctccgtgggccgccggcgaggcaggcgcagcggcttgccgggccgcggaagcccgcgcggtgagacccatgagtgtgcacgcgtggctcctttccacgccgacacctgcgattatggacgggggcctcgattcctttctgctacagccaagtgagggccaaagttatttctaagaaggccgggcagagcaggtcgctgggcggattcccggcgcggccgcagcatctccgggaggggtcgcctcagaagccgcgcgcccctctctccctccctccctgtctcattctctccctcgctctctccctctctcccggagaggaacttcgagggcgggaactgctccggcgctcatggactcgggggcggcagcccgagcctctccttgcaccgtgtctgggagggcctgaagcccaaactcctcgggctgagaagggtccggggccgcaaggtgcacgcgcggtccttgctgtcagcggcctttccgcgctctcgcgctctgcaggccaacttgtgcttctggggtactttcattttccaggggatgggtggagagagcctccaccggccggcctcggggcggtggggcagggccgcgggaggcgcggaggcggttccttcttccccttgtccgacctcacccggcccaggagacgccgctgccccgcgcggccgggctcccgcctcgcgcctcagcctctcgaggcaccgggctgggtggggcagtgcccagctcccgcctcacccccaggcaccctcactccggaagccctccgtgcctctccctttggggaaacctctctggcctgtcacctcccctcttcgcaccacacgcacatcacacaccgctcacacatcacatgtgtactattacacacactacataccatttagaccaacgttcacacgtttgtgcctataccaagaaaaaacacatttacacagcaacaagcttatgtagagtcacatttacacgacagctggactcacctgcacacgcatacacaaacacacacacacacacacatactcctgcgcacccaggcacacccctgcgcgtgctttttgtaccagcttgcgcccttgggtgcccgcggactggctccgtcccgaatggcaggtcaggagtggggaggactagagggagacagcctggtgggggtcgaggactttggccgtgggacctgggcctccttggggattcttgtctgtgcagatgtccccgagtttcccttggggcctgaatgcactcgcgcccttcaccccgcggacgctgcaccggagttgggacctccccagggatcctcacccactagaccagagcccgctgcaaggactgggcggcgggttccactcacccggccaccagacattcgcccacgtgcccctaagggggtgggtgagacgccttcgcgtggccgcgggagtggaggtaggatagatagggaagaaaaggggatccgacccgagtaacccccgtccccgccccagttgggctgcccgggccagggaggacgtcgtagagggcgggagtgattgtcgccttctacaaagccagtgagagcttttagtgctccccagatttacattaatgcgaatctccgcttggtccgcagtctggaaacggtgcttgccgagaggccgacactctgcaatcctaattagtgatttttgtccccttgttactgggctcagcatctcatgcaaatgaactcttcatttcagccacattaccccagctccagaattaactgactcttatctttaatgatatgctgctgaagttctccgagcccggctagctttttatcttgattactctaatcaataagaaatgatagagtagaattataaactctattggcttttaaatgttgccgacaagccctctagatgccattcctgttcattgttatttattaaaatgatcctcagcctaacagcggatgcaaataggcgaacaagaagaattagccttgggactcctcccagccagcccctgactccattgccccccaatcccaagggaagactccttactgttggggcttgaaaaggtggaaaataaagatatttaaaagtgtttaaaagaaatttgctcttgtaaaggggccagagaaatagaaagacaatttttaaaacaccaggcccccaccccatccaggtagtcttaaaggtggaagcctcgaaaaaggcactttgagacacagagcctcatgttctgggaataactctctctctctttctctgtctctttctctctctctctctctctctctctcacacacacacacacacacacacacacacacacacacaccccttccaccccacccctttctgcataccagtatctataggctttcgtgtgtgtatgtgtaatttcagaccgaccttgggaaatgcaatttccctcacatagttctcttgggtgaaaaatggtgcttgagtcccttcgagtgtgcagaagcagccctcgttgaccaaagcgtcagggcgcctccagtggacagttttgggttcctcgacgtccagcaccaggtggactgagacctagaacctatcttctggcctcaggcagtcccgtcaccgacacccggccaaggtcccgggaccccacaaccctcccgggtcacacctttctcgcaggcccaatttgagaggcattgtgtttcccaagaagtcaaaatagagggtgtgggacatttcttctttcctttgctcatagagagtgaaaggtgttttgtcgtgaggtatgtcggaaaaggctatgaaacatccctcctcaccctcgatcagtgcattacccggccttcgcccccacctcggctctgagtttcgtctcgggtagagtgggaactttcaggtcgccccgtgagggccaggggctgctgagaacacctggccgtcatctctcattagaatcatgtacgaatttcactagctttcgtttagatccaatgcaaacctattaagagcctactctgcattaggcactttgtctggggcgcagcccaggctctgaggcttaggggaccttttccctggcttgcttgagcctccgccccctcggagctttgaatgggtcctcaaaatccccggcatccaaagccctgaaagcgcgcaacccggaggcgagcacacacaaacacacacgcgccacaactcggcctgcccctgtcctgcaaccctgcgggcgcacgactgtctgtctagatccttttacgcacagccctactcgcccaccgctaggcgacccgtcctcaagcagccgcgccgtccctctagccctcgtagctgcgatttccgttcttttctccccttatccctcagcacagcccagtgagcaacttggccctctggcctcgccagacggggaagctaagagctagggttccccaaggctcctagctgctgagcgggtaccggcaaccagcaacccgccgacgcaaaggcgagaggctgcgtgcgcgctgggagcggaaggggctggaacgcagactcaagtccttgccaaggccgcggtcgatccgtggaaagagaagttggaaatcgcaggcaggctaagccttttttttttttttaatgacacgtggggggaagggctgaatgtatgaaaatcatgtaaaatttctgttcttagcaacatccttgttattaggaatgatgactaaaccgccaggattattctggactgtaagttatcaagagcccactaatttcacattaaagcccattgactgcaacggcgtgattgaagggtttttaacaattaacataatcagaaaatgagctgagataatttttattcaactcattactttttaatcatgtatttcttttaattaatatcttctccgtgaacataacacaaagcggagccccagtgctggcccaagccagcctgcgggactgaatttgacacagccaaacatttcaccagcagcattcattgcatctctattgtggtgtgggcgaaatagaaaaatcttgtccaaaagtcaccatgttgttttgaaacacaattttaaaaacaggggagggcgttgggagcgcacaagccatacgctttcaattcgacttgactttcatatttgggcgcctctcttggtttgcagccagagggacataaatgggaagaaacagaagaagaggaagaaaaggcttttggagatgaatgtcccatcctggcttcgcaggcgagtgggctttggttgtttgcgcctagtacactggctggctggtgggacagctggaggcacagacctcggcctttgagtcttggccccgcggacaaacctggcctagaccgtcagggctgagacgctcaggcccgtccaccaccaccaccacgccacctcctgggctctgacccaagcaggcgaagtccctcggctccccaagcccgcctggaagtgggcggtgattgcgggaccctctttgggcaggattctggattaccgctgccgtgcgcactacctaggcatttgcattgcagcctggatgccgtgaccttgcctgtcccccagcacttcctagtattcccaacccgggagacttgctcctattcaaatgcctcacatgtggtggagaacgagcatttatctgtggcacagggggttccagcctcccccatggagtgtccagtctccactcgggcgactccgaccccgaggcgcatctcgcccttgggctgaccacggcatctcccacacctcccaaaaaaggctgtttctggactaagatctctggcagtaggggagccgcatcagtctcggaaaaaagaaacaaagccgacccctggtggaagaaaacgaaagtttaagaatataaggtttgagggaatcgcatgcttaaacttctgtacaagaaagagtggggaagaaagagggagtagaggggaaggaaaggataaataacgaaaaggaaaattggaagacagagaacaggagaggctatatagcagatggaattcaggtggagaaagctgggaggaatgaggctcagagagactgaccttttatgccttgatcaagcttgtttccttaatccttgtggcctggccagtgtcaggggtcaggcaaggacacctaattttcaatttctctccagtgtaagtctggaagttctgtgattacagagggcagatcgaggtttctgttggacattgcaactactgtctgcctgccctagagagcatccagaatctttcttctcttttttccaaacaaacctctacctcccatcttgacctctcagtcttctacaggtgatggcaactaagacaaaactccaatctataatggctagaatacaagccccaatcctctctggtatttatctgttattcaattttagcagggaacatctggggcacaggttggagcccaagggatagaggaatttcagacactagagcaaaacagtgaaggaagggctgggtgcagtggcttatacctgtaatcccaacactctgggaagccaaggcgggtgggtcacctgaggtcaagagtttgagaccaacctggccaacatggtgaaaccctgtctctgctaaaaatacaaaaaagaaaaaaaaagttagctaaattagctgggcgtggtggcaagcacctgtagtcccagctacttgggaggctgaggcgggagaatctcttgaacccaggaagtggaggctgcagtgagctgagatgcaccacggcattccaacctgggtgacagagtgacactccatctcaaaaaaacaaaacaaaacaaaaacaaggaagaaccactgtcctgaagcctctgctgatgtccagagccaagcagttaaaaagaaaaaaggaaagaaaaagtgacatcagagataagatctcactggtgagcgtatcactgtctacctggagtgagcactttgggttaatcaaggaagagcaaaggtggcattagtgtggctgagctccttctaaagcctctcttgaatccacaatcactatgtgcctccgtgtttgctccctcatctttctaccttctctcccatactctcctatgtgtactgatattccacagggacttctttcaaacctcctatttcttctgcatccatgtcaagccacaagcattttcttttcttggaaaccaccctaatccattcatttattggaggcttacccatctttaaggtaaagctcaaatgccactcttccaaaaacgacttccttgtcatttcttccacctttaaactctcctcatatcataactaacttttccttcaattttcttcttatatcataactacctcataaggcagttaattgtatacatcttttattttttctactagtttgtaagtacctgcagctagtataggccatggcactgaatctaggactttgcccttgccctgcatcagttctcagcaaatgtttgttgaattgttgaccattttctttttatttatttatttttgagacagagtgtcactctgttgcccaggctggggggcagtggcacgatctcggctcactgcaacctctgcctcccgggttcaaacgattctcctgcctcagcctccagagtagctggaactacaggcatgcaccaccacaccctgctaattttagtatttttaagtagagatggggtttcaccatgttaaccaggctggtctcaaactcctggcctcaagtgttccacctgcgtcagcctcccaaagtgctgggattacaggtgtgggccaccgtgcccggccttgttgactattttctaagattcagagtttgagtttataacctaggctagaagcagggaggttttgggctggtttttctgtaatctctggtgtgaaccacagccactccttggcaactgagaacagcccttgctgatgggtgtgattcaaggatgctgttggaggttgtgtctgagtattataggaaggacaactgtatgctgtgcttgtgtctctctcatgtaagtgcaaaacatgagtggggctggaaagagggcaagacatgcagagtacatgacttaggcttgagatgagaaataccaggtcaacaaagagaacactggcaaatgaatcagagccagaggcagagctatggcgacccgactttggcccagggcactctccccagcccactctgtcttatctttaaggctttcctgaaccctcattagctggcatccttttcagtctttcctgttcatcagagcatcgtgacacatcagctcatcctagtattttaaccactgtcctgaaaacacccatggtggttccggctaatttaaaaggtgatttcctgatttcttttttccattttggactgagtctaaacagtacaaagcagagagaagagtgtacaattatcaaagcatttttctttttctttttctttttctttttttggatacagtcccagtctgtcacccaggctggagtgcagtggctcaatctctgctcagctcactgcaacccctgcctctcaggctcaagagatcctcccacttcagcctcccaagtagctgggacttcaggtgtgtgtcaccaagcccaactaatttttgcagagacagggtttcattatgttgcccaggctggtcttgaactcctgggctcaagcaatcctcttgcctcagcctcccaaaatgctgggattacaggcatgagccaccacacccagccccaaagcactttttgttttgagacagccaaagtgcatgattcagctctgaatatacacttaatcaactgaattgtgtaccccactctctctgtcacccgatgacggtctcatttttctttgctttattcactacagatacaagcttgctctttaggagaaattttttgggtattctcagagtgtatgaggaaaagcttagtactttgaatggtttgttgggactccatcatccctttggtaacaaactctgaaaatccactcatgttatattgagataaaaagaaaaatgaacacaaattagtattcaatgcaaagtatcaaaacttaatatgctgcattatatagcacatgaaatctttctttttcataacttttataaagaaaaatttccactatacacaaaaatagagtataataactccctgtaaatccatctccaagctttaataaccgtcatattttgccttttttttttttttgagatggagttttgctcttcttgcccaggctgcaggacaatggtgtgatctcgactcactgcaacctccacctccctggttcaagcaagtctcctatctcagcctcctgagtagctggggttacaggcatgcgctgccatgcccagctaattttgtatttttagtagaaacgaggttttaccatgttggtcaggctggtctcgaactcctgaactcaactgatccacccgcctcggcctcccaaagtgctgggattacaggcgtgagccaccacaccctgccatattttgctttcttgtttcatacctcccttctggtttggctagggtattttaaggtgaattccacacatcaatgtcatttaaaggtgaattttatttttctcacacaagaaggccagaaattagtagttgctggctttgctttagcaacttggtgatgacagggcacatgttatttcttagctttgtccacttggtctcaagatggccactgcctctccaaccaccatgtctgctttcaaggcagaaaagggctgtgccagccacctctgtcccttttaataagaaaacatgtgctttatcagaagtccccctagcagaattctcttgggttagaactggctcatgtggcatcctgagctgctagagaggctgggaaaacagtatttggcttttaaacctctatattggagccaaaaagggggttggacttaagtgaaatgcgtatccccctacaccaatgtcatctgtctttgccttctgacatatcctgtctcctacactttcataaatttctagccatacattctgtaggacaaatggaaaggaataagggtgtccataaaccactttgaatgaccaaacagatggcaatcagacagagattgcctccaacctctaggagcgaatgagtaccttggatgctaagtactgtgttctgactgtgttcctcaaaattcatatgttgaaacttaattgccaatgtgatggcattaagaggtgggggcctttaggaggttactatgtcatgaggacagagccctcacggatgggatgagggcccttataaaggggcttgaggaaatgggtttgctctctactgctcttccaccatgtgagtacacagcatttgtcccctctttgcccttctgttccttctgccatgtaaggatacctcgatggcatcatctctgaggaatatgccttcaccagcctccaaacctgccagtgccttgatcttggacttcccagcctctagaactatgtgaaaataaatttctattgtttataaattaccccatctcaggcattttcttatagaagcacaaacaaactgagacactaaggtagataaagttttgtgtgagtgtgtgtgtgtgtgtgtgtgtgtgtgtattttgagacagggtctccctctgtcacccatgctggagtgcagtggcacaatctcagctcactgcagccttgacctaccagttcaagcaatcctcccacctcagtctctcaagtagctgggactacaggcttgtgccaccacacctggctaacttttaaaatttttattttttagtagagatggggttctccctatgttgctcaagctagttttgaattcctgggctcaagtgatcctcccaccttggcctcccaaagtgttgggattataggcatgagtcactgcacctggcctaaagttgggttttgagttatctgacaattctatgttggtttaaggatattagaggacattaatgatacaagagtggagttggggtgagagtgagaggccagggcagatttgcagaaacaaaatagaagccagggtatcatgagtcagaaagtagccctgacatcaagagattttcactttagcaggatttctagctacctctgttcaatatctcccacatatgatttttgaatgtttgaaactcccccttacagtggacaaattgtatcatagttagcaataatgttaaaatttaaatagttctggaaaattaaccttaacttacttttttttttccaaaatataaagggctgataggaaaaataatgtcattcttatttaaataaagttcaggccagatgcggtggctcatgcctgtagtcccagcactttgggaggccgaagtgtgaggatcgcttgagcctaggagttcgagatctgcctgggcaacacagggagaccttgtccctacaaaaaaccatttttttaatattaataaataaagttcagattcttcacttccaggggccaaaagtaagaaatcagtccttttgtgtcctgtagcacagcagagttctagttagaatattaaacaaatggggctgagcaccgtggctcacgcctgtaatcctagcactttgggaggctgaggtgggtgggtcacttgaggccaggagttcaagactagcctggacaacatggtgaaatcccatctctactaaaaatacaaaaattagccaggtgtcgtggtgggtgcctgtaatcccagctacttgggaggctgagtcaggagaatctcttgaacccaggaggcagaggttgcagtgagctgcgatcatgccactgcactccatcctgggcgacagagtgagactccatctccaaaaacaaacaaacaacaaaaaaccaaagactttgctggaggctaaatagcaaaaggcataataaaagtgaaacaaacagtcatagataatccagtttctggtttttttctttaaaaaaaatttttttcttgatttaataatccagtttttcagacacagcttatactccatgattaaagacccatgccattattcagggaacccagggaaagatcttttgaaggtatgcccctttagattctggctagagttctggttccctgtctgatctctcacaacttactcacatgactgactccccaaatgacctccctcttcagctgagaggtgtattcacaagactggggcctgactatgacctttgcaggatattcatatcagaataaaagacaccatccccacagcctcaacattcatacacaacagggaaagggaatcgcagctgggggctggcaagaggtccagtgcaataggaaagtaatgtccattcaagaaccaatattagctcctctgagtgggaaaggattcttctgaagaaaagaagtaaggcagaactacaaaatgtggaaatgagcagaaggctaagtctagggtcagaaaaacataactcatcttttccaaacaggtagtaagaagttcatcacaataacagtcaaagttagcattactttatgagagctccaggccctatgcttctgaaagccctagggagagttgcatgttgttcctagaactagtcctgtggcaatcctggggtgttgacccttttcctctgatgcactctggtgacatatcccacggctgcctgccaaagtccccatgctgagcacttctagtctgtgtgcacagcctagctgtgcaaggcccctgatgccaccattagagcacattgctggcctttctcccatcaatgacaagtccctaatgctgcctgtagagttgttgatattgcctctggggatattgatgcctcttaacttactataatttttaaaacaaaacaacatcttttagttcctgctggttccactgcagcccctttgctcgaaacaggagaaatggaaggcggttggccttgggaagggagtccatgtcagacttcctggcgtgctcaaaatcatctctctcctctacccagccctttgtctttgaaccaaatgtcaagtccctgcccctgggaagccattattaccccagcaagcccctgggcttctcaagttccagtcctctagagggccgcctcccctccaggacctttccttgctcctatgtaaatccctgtgcctacatctgctatgtgtccgctggggcctttgttatgtatgccatctgcttcactgcttttctatttttctgctaccttatatgtcctcagaaaaagttaatactaagcctgaaaaatatagtcccacacatgtaaaaaccaaggaaaaaagcaatacgtgaaatagtatcgagaacttcatcaaaactgtgtgtaagcaacaacattcatttaaaatgttttaaattatcaccgaatttaaaaattataataccaatagaacattgtatcttgagattgccttaacatcatttgcctctcttatttgataagtaaactgaggctcagagagattaaatgactagtctagagtcacagagttgatcagtcaaaggactaaattaagtgaaactttcacaaagtggaatatctgaatgggaacttatatatctatatagcattagcgtacatattctaatttgaggaggtaaaaaattctttagtaatcttgagctttagctgtgaactaaactgaatttcagtttgaacattgtcttcccactcccaacccttaccacatcagcacaatctttaaattctttaaaggtcaagcaagtgataatcacaaaggaatggagtgcttccaattttactctagcaggcaatgcaatttttattcattagcttatacagtttatatgcagtttaccatactgttagtggatgtctctggaatgtgagtgctgcctgtgggactttggaacacagagatggctataaccaaataacagtcaatgaagcagagatttgtaattatttggttcatttgaacccttaggtagcttatttgagtaacttagagtccaaagcctagattttctcatgttaatcaatctagctttatttatttatttatttatttatttatttatttttgagacagaattttgttgcccaggctggagtgcaatggtgtgatctcagctcactgcaacctccacctcccgggttcaagtgattctcctgcctcagcctcccaagtagctgggattacaggcatacaccaccacgcccggctaattttgcatatttagtagagatggggtttcactatgttggtcagactggtctcaaacttctgacctcaagtgatccacccaccttggcctcccaaatccagttcttaacatagatacacagtgggtacttaattaatgcttaatgatgagggtgataactaacattttatagcatggtcctctccatcaaatctttttacacacaaagtactactaataataaaagcttcattgtatgttgtatagtttcaggctgaataaaaatgctgggagattagcctggcatgctggctcacgcctgtaatcccagcactttgggaggccgaggggagagaatcacttgagcccaagagtttgacaccagcctgggcaacataaggagacctcatctctacaaaaaatataaaaattagctgggtgtggttgtgagtgactgtggtctcagctactcctcaggctgaggtgggaggatcacttgaggcaaaactgactttgcagattgggaaattggatggtaggcagacaaatcaatggttttcacaattggtctgagtagtacagaggcatgagagaggaggtggctgggttgagcaggatcctagtttaggctgtaagaggttcttacctcctatttcctctttccagagctcctactttgtcttcatgctgagcagcaaagctgggagcaacagagtgagaccctatctcaaaaaaaataataataataaggccgggcgcagtggctcatgtctgtaatcccagcactttgggaggccgaggcaggcggatcacgaggtcaggcgatcgagaccatcctggctaacacagtgaaaccctgtctctactaaaaatacaaaaaaaattagctgggcgtggtggcgggcgcctgtagtcccagctgctggggaggctgaggcaggagaatggcgtgaacccaggaggcggagcttgcagtgagccgagatggtgccactgcactccagcctgggcgacagagcgagactccgtctcaaaaaaaaaaaaaaaaaaaaacaaagctgagagaccactgtaagcattctttctctagctcaatcttcaatttctttttttaaaatttgatgacctatgaaggacaggatacaaaaattttgtgcctttttaagagatataaacaggttgtgataatttttctttttgaaaatattaggacaagtatcaagaggaaatgggcatgccaaggtagggtcaatttgggatcccctgccatgaaattagatttcctagtctagccaggtgcggtggctcatgcctgcaatcccagcactttaggaggccaaagcagatggatcacctgaggtcaggagttcgagaccagcctggccaacatggtgaaaccctgtctctactaaaaatacaaaaattagctggtcgtggtggcgggtgcctgtaatctcagctcctcaggaggctgaggcaggagaattgcttgaacccaagaggcggaggttgcagtgagccgagatcgcgccattgcactccagcctgggtgacaagagagaaactctgtctcaaaaaaaaaaaaaaaaaatttcctagtctagaaaagtgagtgtgcacaggcctgtggtataagtttattgactcagtgaccatgcaaggaaagtgcatgttggatgtatgaaaatggatatatttggatatatgtaggcattagctgcctacaagcctacgaacagagagaaagtgaacttgtttctttttttctttttattatgaaaaatttaaaacattacaaagagtaaggacataatatgataaacacccatatatcaatcacttatgtgtaacaattgttagtattttgcctcatttgcttaattttttttttgctaaagtattttgaagaaaatacatgctgtatacatccctaaaagttaagaacaatttgtctacacagcctcaatgccttatcacacctgacaaaattagcaaatgttctctaatattctctaatatctactttacaaaataagcttcacatggtcatttcatgggtaaatggaattatgaacattaagtagagaaacccattctctagcgactgatattcatctttattgtccacagaggtagcttggtgttatgaacagcattctagggctgaggacagctgggttctatttttgggtctgccacttacatattgcttaattgctctttgtctcttgctcgtaaacaaagaggatggaccagtatttgaagagctgataacctgtaggcctaaagattatttggctgtattttcacacattattgggattgttcagggatgatgcaggaagaaattgttctatcatagtcgcaaacattatttctatctaaggtagcattttttccctacaagaatacacttgtttcactatctccttattcttttcttctatgatgctacttagttgggttaaaatgatggtgtcactgtggctaccccttacaagaaactgaaccagaagatttttggactttcccagagtgacacaaggaaggagatgaatgcctctaggtttttagttcttgaccagcgtgatggccagctttaagtattaacttggctaagatatagcagtacccaggtatttaatcaaacagtaatctagatattgccatgaaggtattttgtagatgtggttcacatgtacaatcagttgactttacatcagagagatgactctcaataggtagggggtcctcatctaatcagtgaaggacttaagagcaaaaacaggtttcttgagaagaaattctgcctcaagactgcaacatcaactcctgcctgagtttccggcctgctggcctgccccacaaatttcagactagccagctgccacaattgtgtgaggcaatgcctttatttattccataaagagatcatctaatatatacagtatatatccgattggttctgtttctccagagaaccctaactgatacaatctgctttatagaccagaataattttgagcatatgtatggtatatattgcaaattagtttggcttcctctcagaattttattagtgtggaattttaactctttagatacatgctgttttgaaatctaactgtttaatatctaagaagaaaaacattgagcaaaaacaatacatcacagatggcaatggtttattcaaaaggagaataatgaatgcatagcactggagaagcacctgaaactccctggaatcacctcctaaataaactgcctgagcacaagtctttagttcaagctctgttttttggaagcatctaggttgagacaatgacagaaatttactatcaaggaatggcttcaggctgtgtgcaatgtctcacgccactaatctcagcactttgggaggccaaggtgggaggatcacttaggctatgagtttgagatcagtctgggcaacatagcaaaccctatctctacaaagaaacaaaattagaaaaaaaaaaaattagcctggcatggtgacacgtgcctgtagtcctagtttctcagctactcaggaagctgaggtaggagggtcacttgaagccaggagttcaaggctgcaatgagctagatagtgctactgcactccagcctgggcaacaaagaccctgtctctttaaaaaaaaaaaaaaaaaaaaagggtgtgggggcgggtggggaatgccctggcctcaagaagcaattggacctgttcattagaaataattcaaaattaattacttcaaaatcatttttgaacaacaatgtttttcaaacattagtttggagctctttatataaagaaatcttattcagaaatccagtgtacaaacaaagagaactgggcttccacttgtatccttcttccagaaagtgcctaaaatgtatttgtgttagcgtgctagggtgccataacaaagtagcacagactgcagggggtttacacagcaaatgtgttgtcttacagttctgggggtagaagcctgagatcaaggtgtcagcagggctggtttcttctgcaggctgtgagggaagtatctgttccaggcttgtctccttggcttgtgcatggccaccttctctcctgtgtctccttaccttgtctttcctctatctatccctgaatccaactatcaccattttataaagacaccagtcacattggattagagcccactctaattgacttcattttaacttgattacatctttaaaggctatctccaaataaggttacattctgaggtactgggggttaggacttcaatatatgaatttgggaggggacacagttcaactcataatagtatttgaacactttcagatcacagtttgaaaaccacaattctcagttggataattttaaacaactccacccatcggattaacatttcgattaaagaggggaactttattaagatccttagggtaactgtacttctcaaacttaagcattctacatgaacaatatgaacttttttgaatagtggaagcagtttatatagaaactcctgacctcaaaattcaatggttgtcttgtggtgtagatctgtttgggaaaagttttggctaagcctacaaagccttactctttcatatcgtttctgctatgcctggttgctggaacagctgggtctcctattaatcagtaatacagaatgcctgattgcgcccctccctaaagttatggtataggtttattctgtgccccaaataactcccaattttatcagattgggacctgacaaaacaaaattttaacagaagaaaaactcagagaaaatattaaaggttattttcaaataaaagagtgaaagagggaaatattctgagcagttatttttttaaaagattttacaaaaccaagaagatagtgcagagttcccatataccacacaccatttcccctgttattaacatcttacattagtataatacatgtattactattaatataccagtttatatgttcttattaattaaagcccactatttactcaggtttcctttgttctatgaaatattttttttctgttacaggatcccgtccaagatgccacattacatctgattttcttgcctccttaggttcctcttaactgtgagtttctcagatttttcctatttttgatgaccttgacagttttgatgaatatgactcaaatattttgtgggctgttcctctcttgggatttatttgatgttttgtgcattattagactggagttacgggtttttatgagggatatcacaaaggtaaagtgccattttcatcacattatatcaagggtacctactattaacatgctctaccattgttgacattgaccttgatcacctggctgaggtggtgtttgtcagatttctccaccataaagctactcttcttttccccctcctttccatactgtactctttggaaggaggccactataaatattccatgcttaaagaatggggagctgtattccaccttcttgaggacagagcatctacataaattatttggaattcttctgcaagggagatttttctcctcccccatttatatattcaatcatttatatcagtatgaactcctgaatgtttataatttatggtataattcagtgtgggttgagtattctgcttgggaccagaagtattttagattttggattttggaatatttgcatatacataatgagatatcttggagatggggcccaagtctaacacaaaattcatttgtgtttcatatacaccttatacacatagccggaaggcaattttacacaatatttaaaaataattttgtgcatgagacaacgttgtgtcaagtacttaggtgtggaagtttctacttgtggcatcatgtcagcactcataaagtttcggacttggagcatttcagattagggatattcaacttgaactattttattttattgctcaaattgttccacctctcaccattgggagctctttcagttggctcctgtgtccttttgacatattcccaccaatgtagggtatgtttacttacttgttcaattgcagcatacatgtacaatagtatcagaattgttaacttgtacccctgtgagaaacgacatcaaccagagtatactgctcatgtagagtcccttttgtctttagtctttttttctttgcaatttatttatttttatttatttttaatttttatatattcaaggggtacatgtgcaagtttgttacatgggtatattatgtaatgatgaggtctgggcttctagtgtacccatcacctaaacagtgagcattgtacccaataggtaattgttcgaccctccccctctcctatcctcccctgttttgctgtccccagtgtctattatttgtctctgcacctccgtgtatacccattgtttagctcccacttaaaagtgaaaacatgtggtagctgattttctgtttctgagttatttcacttagggtaatggcctctggcttcatccacattgccacaaaagacataatttcattcttttttatgggtgcatagtattccatggtgtgtatataccacttttttctttgtttgtttgtttgtttgtttgtttttagacagagtctcacactgtcgccccagctggagtctgcagtgcaggggcacgatctccgctcactgcaacctccacctccgcctcctgggttcaagccattctcctgcctcagcctcctgagtagctgggattacaggcacccgccaccatgcccagctaatttttgtatttttagtagagacggggttgcaccatgttggccaggctggtctcaaactcccgaccttgtgattcgcctgcctcggcctcccaaagtgctaggattacaggcatgagtcaccgtgcccggcctataccacatatttttaatccaatcatctgttgatggatatttaggttgattccatgactttgctattgtgaatagtgctgcgataaacatatgaatgcaggtgtcttttttttttttttggtataaaatccagatcctgtacaatttttctttttggcaggtatctttttgatataactttttttttctttggataagtactcagtagtgggtttgctgggttgaatgttagttttattcttagttctttgagaaattgtcatacagttttccatggaggatgtactaatttatattcctaccaacagtgtataagctttccctattctccacatgctcaccaacatctgttattttttgacatcttaacaatagccattctgattggtgttgagatcatatctcattgtggttttagtttgcatttctctgatgattagtaatgttgagcatttttttgtgtttattggctgcttgtatatcttctttagaaaaatgtctgtgtcttttgcccactttttaattttttttcttgttgagctgtttgactttcttatagattctggatatccgtcctttgttggacacatagtttgcaaatattttctctcattctgtaggttgtttgtttactctgttgactatttcttttgcagtgcagaaggtttttaatttaattaagtcccatttgtctctttttgattttgttgcatttgcttttgaggtcatagtcataaattatttgcctaggccattgtctagaagagttttccctaggttttcttctatgatttttaccatttcaggtcatacatttaagtctttaatccatcttgagttaaaaattttgtttatggtgagagataggggtccagctatattcttctgcatatggcactccaattttcccagcaccatttattgaatagggtgtccattccctattgtatatttttgttgattttgtcaaagatcagttggttgtagtatgtggctttatttctggattctctttctgttccattgatctgtgtgtctatttttgtaccagtaccatgctgttttggttactatatccctgtagaataatttgaagtcaagtaatgtgatgcctccagctttgttacttgttaatttttctttctttctttctctttttcttccttccttccttccttccttcctttctttccttctttttctttttttttttttttttagatagggtcttgctatgccatccaggctggagtgcagtggcgtgatcttggctcactgcagcctcaacctcgcaggctcaagtgatcctcccatctcagactcccaagtagcttgtactaccggtgagtgccaccaagcccagctgtttttttatgatttttgtagatatgggttcccaccatgttgtccaggctggtctcaaactcctgagctctagcgatcatcctgcctcagcctcctaaaatgctgagattacaggtgtgggccaccacacctggcctagctttgtttttttttgtttttttgcttaggattgctttggctattcaggcttttgtgtggttccatatgaattttaggattggtttttctaattctgtgaaaagttatattggtattttgataggaaatgcattaaatctgtagattgcttcgggcagtatggtcattttagtgatattaattcttccaatccatgaccatgtttatccatttgtttgtgtcatatgatttcttccattagtgttttatggttcttgaagagatatttcatcttggttaagtgtattcctaggtatttcatttttttttttttttttttttgagacggagtctcgctgtgtcacccaggctggagtgcagtggcgggatctccgctcactgcaagctccgcctcccgggttcacgccattctcctgcctcagcctcccgagtagctgggactacaggcgcccgccaccacgcccagctaattttttgtatttttagtagagacggggtttcaccgtggtctcaatctcctgacctcgtgatccgcccgcctcagcctcccaaaatgctgggattacaagcgtgagccactttgcccggcccctaggtattttatttttatgtgtggctattgtaagttggagtgacttctttattttgttctcaagttgatcattattggtgtatagaaatgctactcacttttgcacgttaattgtgtatcctgaaactttactgaaatcatttatcaagtctaggagtattttggagaagtcttgaggttttcatgtcatcaataaacagagatcatttgactttctcttttgcaatttggatgccttttatttctttcttttccccaattgctctggctaggacttccagtagtatgttgactaggatgtatttagtcttatagattctactcatttccaaagttacttagatcagaaccccctctactgcccaccctcctcagtgaggttgttttgtatatttataatacagtttcattttcttgtcactgtatgcattctgtcctgttatcctccaacatcctaaatgactatttttttacatttgcctaatattaaagttcaccttttctgctagaaacttctacagttttcacaaatgcatagtaatcatgtagccaccattagcgtatcagacagaatagtttcatcactcctcgaaatcccctgtacttcacttgttcagccctccttgctcctcacaaacccctgacaaccacaaatttttttgtctctgcagttttaccttttcagaaatgccatatagttagaatcacatagcatgtagtattttttttttctttttctttttctttcttttgagacggaatctcgctctgtctcccaggctggagtgcagtggtgcaatcgtggctcactgcaagctctgcctcctgggttaatgccattctcctgcctcagcctcccaagtggctgggactataggtgcccgccaccaagcccagctaattttttttttaatttatttttttactagagacagggtttcactgtgttagccagaatggtctcaatctcctgacctcgtgatctgcccgcctcggcctcccaaagtgcccaaagtgctgggatttacaggcgtgagcccccgtgcccggccagcatgtagtatttttaaactggcttctttcatttagcaatatgcatttgaggtttatccctatcttttatggcttgatatttttttaattttcaaaaaataggccatcatgtggatataccatagtttatgcacctattgaaggacatcttggttgcttcagtttgagagttatgaataacactaatgacattgattaaaacagtgatagagtggcacaggagcctacacaaaattggaataggtcagatatagaaaattatataaaataaaggtcacatgtgctggttcataccactttgggaggctgagataggaggattgcttgagctcaggggttggagactagcctgggcaacatagagagacctcatctctactaaaaatcacaaatattagcgaggaatgttggtacatgcctgtagtcccagctactcacgaggctgaagcaggaagatcatgaacccaggagatcgaggttgcagtgagctgtgatcatatactgaactccagcctgggcaacagagtgagaccctgtctcaaaaaaaaaaattattggccaggtgccgtggctcacactgtaatcccagcactttgggaggtcaaggcgggtggatcacctgaggtcgggagttcgagaccagcctgaccaacatagagaaaccccgtctctactaaaaatacaaaattagccgggcgttgtggcgcatgcctgtaatcccagctacttgggaggctgaggcaggagaatcgcttgaacctgggaggtggaggttgcagtgagccgagatcgtgccactgcactccagcctgggcaacaagagtgaaactctgtctcaagaagaaaaaaaaatttcacaaggatatattttaaaattagtatatggtaaagtagcaacttaaattattgcatatatcattttcattacatgttgcctgccacttactcagtgttcttcatgcattcaaatgatttataataactaatcacctatatttaaatcacttgggtctatcaaaaaaggtattacttgtgataattttttaattatgcaaatccaaatgttaggctttaattttatggctcatttccacatagttttattccttttccatggatgacatagttttttatgagggccatctcgatttccccttaggaaaaacccagtataacagcatttctttcatttcacaatgaatggtacaattaagatttaattagaagcacactagtaagggaattgaaagctactccgaacccgtagatgaaatgttacactttaaaattgttcacatgttgcaacccacagccttaaaaggctagcatgcgtaaacttaatttgagatggagctttttaaaacaacatgattacttgttatattgaatctcttccttgtcatgtgtccaccaaaaagcctcattttatctaaaaaagaaaggctcacagatgcttcaaggaagaaaaggggaattttcagcacatgtgctttacaaagaacatcctgaacaagcattcaagggtgaggagaagactttactctccttaatacatgtcctacctacttctcccacttttttttttgtttgtttttttttttttgagatggagtctctctctgcctcccaggctggaatgcagtggcgctatctcggctcactgcaacctccgcctcccagattcaagcaattcttctgtctcagcctcctgagtagcggaattacaggcacgcgccaccatgcctggctaatttttgtatttttagtagagacggggtttcaccatgttggtcaggctggtcttgaactcctgacctcgtgatccacccgcctcagcctcccaaagtgctgggattacaggcatgagtcaccacgcctggtcctctcccacttttttatagcctcacaaagatgcacgtttaggaagtgatttgtccaccacatatgaattgatttttaataaatatgtaactttaaacaatgctttaaaaaactaatacttactagaatttgagtcttctaacattttttcaaatttaaaaataccattaactttttttcaaatttagaaataccatttcaaagactgaaacagagggtatatttaaaggtgatttgcatctacagccataccaccctaaacatgcttctcatttgaattgagattaattgcttttctgaatggtgcgttggaacagcaatttagtgtagacctgtgagccttggtgaggctgccaaaaatgacctattgatatcagttaactataagaaagaggagtgactttgctccgaagtggatttctggaaattatatgtataagtgcctaaggcctgaaaggtttctgataacctggactataagtagattagtatcatagaaaccttttctatccatcctgttctttacatccaaatccagagggcccagtcatgggatgaagcagagaaataaccaagtgcttgcaaacatggagaccagaaattacaggaaatccagaacactcaaagtcttgacattcagagggtggcccagaatttatgctgtaaatgcagagcatctctggagacaatttattatccacaggtctccgtcattgagacaatatactatcctaatcagtacaacttctaataatggggtagatgatattttaatatattttgagaggaagtagaaggatcttctagaggtaattattttagagaggtggctaattatctcatgtttaaagatctccaggaaagatgactttattaaccttgagccttaaatttctttttctacaatttttagaatataacctgaatagtagtggccacatataatgcttcccaggatgacattaaatcccatttctcccaggatggcattcatttgctcagaatgtataaccgaggatacacatacacacacacacacacacgcatgcactaaaacagaacttaagaccagcatggaataacagacttgctgtcctgagttgatatcattttattctaaagcagagaaatttgatggttttgatgttttgatgttttaggtagtccatcatagctttgtgccaggtaagtgcatcatttgctttagactttatgaaatactagaaataccttatgggtcttcagttttttccttgtagatccttagatgtcccgggatttgaggctgaaacccattggtttacagaatggaaacaacggagtcactgcttgtacattatggtcatttcaggcactatggtaactgagttgaatctctgcaaagatgatccagataatcaacatatatttgcatttgaagatggatcataatccaagaataagtttgccacaatcaattaaatctttttgtataaaaatgtcccaaatatgcggctggacgtggtggctcatccctgtaatcttagcactttgggaggccaaggcaggtagatcgcttgagcccaggaatttgagccaggctgggcaacatggtgaaaccctgtctctaccaaaaatacaaaaattagccagtctcataacctggtctcaaaataggtaaatagataaaaatttaaaaatataacataaaatataagtttaaaaaagaatggcccaaataatgagctttatatttttttaaagaaccatacatatggtatgaattgaaggggcccagaaaggtccagttgcctcaaaattcctccctttaccaaacctacttaataccatctacctccttttccccagtgtggtctccagaagggcactgtttaagatccattttccattaagagggaagagagggccttgcactggacacctattaggtttggcacccagttccccttttctacaaacttctctcttctatgctcatccacatggtcacaggctggcttccaagcagccatggttatatattatggagtcctaattagggaaaaggagccagactggcaggatgaagggaaagcaaagagataaagcaaataagctataggtctgcctttcttcatggtccaggacatataaatgaaaagaggaagcagataagctacaagtctgtctttctttatggcccaggacatatagtcctcctgagcaaataacatacacaactcacaaactttctgcttatcaccaaacgcttcaattcatcatcaaacacgttggctgacagaagaatacaagctggctttctgctacctttgcattatcaatcagcccaagaaccatccagtaaaatctccagcaagcctttgtttccttgtagtcagctcctcttctgctggttctgcccactgctccctggcaacatattctcatactttctttaataaatctgcctttctttacctacaactgtcttggtaaattcttatcccccccaaatcccatgcctcaccaccagcccagatagttgctgctcacctgtgacatatattatggcccataaccatcatgttggctacaatctgggctgaatagagattccttggaaaatttgggattgggaataagaggtctggtctttgtctgggttgaaatctttagtgcaagacatataaaaactggagtttgggctgggcaaggtggctcgcacctgtaatcccagcactttgggaggctgaggcaggtggatcacctgaggtcaggagttcgagaccagcctggccaacatggtgaaaccctgtctctactaaaaacacaaaactttactgtgtgtggtggtgtgtgcctgtaatcccagctactcaggaggctgaggcaggagaatcacttgaacctgggaggcggtggtgcagtgagctgagatcacactgttgcactccagcctgggtgacaaaagcaaaactctgcctcaaaaaatatatatatatataataataatggagtttgtgtagctatattttccaccacaaagcctgggaagacatgtagactagaacaaggacagacagactgtttggtgctagttccagagtgtttggtgcatagttccagagtgtttggtccatagttccagagtgtttggtgtatagttccagagtgtttggtgcatagttccagtcccatcctgagacatggtcttggtttcatccttgaatttctcactttttgctgaagttaacttgcattggtttctgtttcttaaagccaataaagatccaacagataggctgtcttgatggaagtctattagtcagtcccagagtcacattattgcctctaccagatcagccagtagttatcctcagatgcacagagaatctagtctctgaagacctaggaatacaaacaaggtaccccaggagaatcaaaatgagatcttggcttacatctgactaatccaagatttatatgtatacataaatgtatacatatttctttgttgtaaaaccaaataattagtttaaatagttgtcatagtcttcaaaatgttaatagaccaataaaagggaaccgatatgcaacatcttctctgtggtattctgagcagcagaatggttttttttttttttggtgggtaatttcttttttttttggaagaaaaaaatgacgctgtcaatagttttatcattcaaatatagaaagcatagttctccattcttcataaggagctggggtggacacagctggaaaggactgaataattaaaatattaatcagaagagcagagattaaatgactttatttgaatagagcaattgggcaaaattagaattgaaaggaaaataaaatagcttataaaagaagcaaacattttaacactggccctgtcttcaactaagcatagcataaggatggtaacaagtggtacttgttccaaatgttgccataggtaaattcaggaacatccacttctctgagacatgaacattcgtacacttcatcttgactgtaacatttgcttcctatacttctgttgttatgtacacagtgaatatgaaatataacttatttacaaagaatatttaaatgttgatatatttttaaagacatgctgcatagaaataacatcttattgatttctctagtaatctatatgtcgtaggaaattaaatggataataagcaataaataataaaacatactttaaaactgtcaagagacacataaaatccatatgtggttattaataagcattgaacaacaaattttttttttgagacagactcttgctttgttgcccaggctggagtgcagtggcgtgatcctggctcactgcaacttctgcctgctggggttcaagtgattctcctgcctcagcctcccaagcagctgggactacaggcatggaccaccacgcccagccaatttttgtattttttggtatttttagtagaggtggggtttcaccatgttggccaggctggtcttgaactcctgagctcaggtgatacacctgccttggcctcccaaagtgctgagattacaggcgtgagccaccatgcccagcctgaacaacaagattttttaatagtgcaatcacttttctacatataattaatgtatctttatgagtcacagcagaaccaataggaaacatatatatctagatatgggtagacaatgagattaattacaacaaatggcccgcatgactatggacgctgagaagtcccaacatctgcattctgcaagctggagacccaggagagttaatgtgtggttccagtctgaaagccagcaggctggagattcaaaaagagtcaatgtttcagtttgagtcctaaggcagaaaaaactgatgtacgagctcaacagtcaggaaggaggagttccctcttattcagcatttttattctcttcaggtcttcaatggactgaatgaatgaagcccacccacactaggaaaggcaatctgctttactcagtctaccaattcaaatgttaatttcatccacaaatgctctcacagatgcacccagaatgacatttgatcaaataaattaaccatcataaatccattccttgttaacctggcatctatatgtatctccaaataaagacaataacaagatcataattatacctagtatgacacaactatcttcatacaactgaacatgcactaacctctattccagaaaaggagataaagtccttgagtgatgtttaactcttctccttgatattttataacaaatattatgatataaaattaacaatacttacatattatattatactatgataatatgaagtcaatatatctttttttttttttttttgagatggagtttcgctcttgttgcccaggctggagtgcaatggcacgatctcggctcactcactgcaacctctgcctcctgggttcaagcgattctcatgtctcagcctctggagtagctgggattacaggcacacaccacaacacctggctaatttttttgtatttttagtagagatggggttttgccatgttggtcaggctggtcttgacctcctgacctcaggtgatccacccacctcagcctcacaaagtgctgggattacaggcatgagccactgcgcccagcctaaagtcaatatatcttataagagaataaaagagagaagaaaataaagatatttggggtgtgtgtgtgtgtgtgtgtgtgtgtatgtgtatatatatatgtgtatatgtatatatatatacatattcataacaaaatatggagaaatactcataataattatattcctaatttctataactggtcacatggtcatagctcgtatttataactaccttctaccgcccattctgtattatctttgatctcagcaagcatctcagctggtggtgatcctttacctgtagggcaatccaaacctccattcctgaaaggcctgggccattcacaatcctgcctagattagcttgttatagttttccatcaatcttaataatagggcataataatactaagacataccctaagggatctcctgtatttcagacatactcttccttacttccattgtggagtggtagtccaatttccccttggtagttaggatcaatcaccctagccagcacagtaactctcttctttaaccattgatttagagggagcccaaagtggccaggtggcaatcttaaattccaattccgtcattcttgtatctcctagtggatgcactcctccttttgggactgtagacctctagcccagcagggcataaagtcattagaacaggaagcaaaaattttgctagtgggtcaccaggagtaatagtgagtggcgccattctcatttctacttatgaatgctggctttccaagaaatagtaccacatattaggcatctaattaacaagagagtttctgttatattaggaaatgggttcggtgatcagactttggtcactgataatatatatctactgaagcacacatatttttaatgtatattttcatttgtaaattgaacaaatatttattaaaattatgttgatacaaactcaaagttctaataccactcatctattagaaacatacatttaccaccagagagtctgtcaagtaaatgtgattcaacttcattgttttaaaaatatctcctaatgccgaagctataagattatcttcaggtgaaaaaaaatctatcttcagatgagagttctggaaatgagattggccactggagtgagtagattagacttttgcaaagtatcatgaatgaacaacatgatttacatgtcccatgtgttcaggtcattctgctcaggcatgcaaagcttatgggcatttacttacagcattgttttgcccattaaagaattacaaaaataaaaatatgtttccattgatgtatcaatctgaaaagcacttaaagcagatgtgcatttgtattacacaaattcaatgtaacaaatgttttgggtaccttctctgtacaagacatcaggctaagtgcttctaagtatacaaatataaataggactcagtccacattctccataagatcatctcatggctggaggtgacataagatatacatgctgactttaataaagagcaaggtaaaacacagaaaagactgccacttaagacagcaagttgaacacatgattagatctgttccttcctgaaatcccacaagatttgtaaaataatttttaaaaagacacataagaacatagagaacaggagaaaagaaaaagtaaaaatattggttcttgggatggtgatgcatacctgtagtcccagctacttgggaggctgaggcaggaggatcacgtgagcacaggagttttttgtttgtttgtttgtttgtttgagatggagtctcgctctgtcacccaggctggagtgcagtggcgcgatctcggctcactgcaagctccgcctcccaggttcacaccattctcctgcctcagcctcctgattagctgggactacagacgcttgccaccatgcctggctaattttttgtattttttagtagagatagggtttcaccatgttagccaggatggtctcgatctcctgacttcgtgatccgcctgccttggcctcccaaagtgctgggattacaggcgtgagccactgcgcctggccgagcacaggagtttaagttcagcctgggcaacatagcaagaccccatctcttcaaaaatatattggaagcgggaaagcaggtggactaataaaaactgacttagcaaaacctaagcagaaaagctaatttgtatgcctgtagtaggaaaaaaaggcaactgaattatattatagaaccctcaaagagcccaagaagtggaaagacatcaggtacctctgaaaatgtagataaaagaagaaccaaaacaagatgattgaaaggctatttacaataccctccctactattctatgtcccatcccaactccagcagaataccactaaattcctgatatctggagaaagtgaagcaaggggagtctggaccaagagacataagcatatttgagggcagggacattttgctaaaacagggagattaagtaaaagttcattcactgaagttgagttgccagcttttttccactgccaggatcagggattactggcagcaaggtagcatgctggcagaatcttctgtgaagaggataatctgcccaagagaaacgatttaaaatactgatgttttcaatgctttgttttgggtgaccatcctgtgcattttaagatgttttgcagtgttctttgtctctattcattagatgctagtagcatacccttctcccagttttgacaaccaaaaatgtttccacacattgctaaatataccacaagggtggggagcaaaactgtccccattgagaaccattggcctatactgaaactcatagtctaaaagaactatccatgaacacagagtttccattcagctttgtagtgcctctctcttaaatgtaagcagaaagccaaggttcactagacacttaaaagtatagataaaaacaaacaggaataaaagtaacttggccggctgtggtggctcacgtccgtaatcccagcactttgggaggctgaggtgggcggatcacctgaggtcaggagttcgagaccaacctgaccaatatgatgaaaccctgtctctactaaaaatacaaaaattagctgggtgtggtggcggccgcctgtagtaccagctatttgggaggctgagacaggaaaattgcttgaacccgggaggtggaggtttcagtgagccaagatcgtgcctctgcactccagcctgggtgacagatcgagactctatttcaaaaaataaaataaaataaataaataaaagtaacttggaggaaacgggctaggaggaagaaaaaaactttaaaaggacgtaacatctacataatcctagcattttgggaggccaaggagggcggatcacctgaggtcaggagtttgaggccagcctgaccaacatggcaaaaccctgtctctattaaaaatacaaaaattagctgggcatggtggtgtgtgcctgtaatcccaggtactcaggaagctgaggcaggagaatcacttgaacctgggaggcagagtttgcagtgagccaagatcgtgtcactgcactccagcctgggcaacagagcgagactccgtctcaaaaaaaaaaaaaaaaaaagaaattttgggaattaaaagtatagcagaaatgaaaaaactcagtagaagcattgaagaacaaagttaatgaaatttctaggaagtacaataaaaatatacaaagagatgaaaaaataggagaacattagaagttgagaaaatttaagtaaccatctaggaggactgcattaggatcagcttaagttgctgtaacagagactccaaaatatagtggcattaataggacagaagttcattcctctgtggcctagagtaggtagatgactctgctttatgaccagctggctccgtcatgctaaacatgttgcatccatatccatctctgtacccaggcctgatgtttcagttattaacattttctgtccaggcgcagtggctcacacctgtaatcccagcactttgggaggctgaggcgggtggatcacctgaggtcaggagtttgagaccagtttggcaaacatggccaaaccctgtctctactgaaaatataaaaattagccaggaacagtggtacgcgcctataatcccagctactcgggaggctgaggcagaagaattgcttgaacccaggggtcagaggttgtagtgagctgagattgcaccactacactccagcctgggtgacagagcaagactgtatctcaaaaacaaaacaaaacaaaaaacatttcctaacaggaagagggcggatacaattcatgacttaaagatatgactagtaagatatacgcacttcagttcacacttagctgcaagggaggttggagcatgtagtcctgccatgttcagctaaatctcaggagttgtatcattaaaaggaaggagagaatggatgttggaggaagttgagcaatctccactataaggtttaacatctggctgggcctggtggctcacacctataattccagagctttggaaggcagaggtaggaggattgcttgaggccaggaattcgagactggcctgggcaacacagtcagaccccatctctacaaaaaataaacacaaaaattttagctgggcatggtggcatgtgtccgtagttccagctacttagacggccgaggatcccttaagctcaggagttcatggctactgtgagctatgattttgccactgcactccagcctgggcaacagaatgagaccctgtctccaaaaaaaagaaaaaagatttaacatccaaataaaaaaacgttccaaaagagtgaaccagagaaaatagcagagaggaaatcagcaaagaactatatatttggatgactaggttttgctgtggtggtaataaacctcttccaagggagacaacccaaaagtctgaccatgtcatagtataaagctcagtctagaatctcaaagtctggaatcaggataacctcagaaaccagcaaaggtgtatttgggtgactaggttttactgtggtaataaacctcttccaagggagacaacccaaaactccaatcacgtcatagtataaagttcaaagtctagaatctttgggtagtgtgtgggatagtttctacaacaggttcaaatgtggctccttcagatccagagacctatgtgctgaaaggctaagctctctctcctcatataccaatgcacagtgatggaacaggatcaggataacctaggaaatggggactggagacacacagcagacattagcccactgcaaaatgtaacaaaacagtggtttccaaactattttttcccctaggggaaacttgaaaataatcttctgtggaattccaatcatgaaagcaggtcaaggtgggctgctctgcttggggactggaatgctcactgagctcctcttaccctcaaactaggggctgctcctgaggaagctccacaaaatctatagaggccatgaagcatagcaaaagtgaggtcatcaagagatagtcagcttttgttccatcaaagagggtaaagggacggtttagagaagatattgaagaaaagagattacagatgatagatcatgagttacaaaggacccagtggaacggtttgggaaggtgggaaggcattggaaactgggtcaggtgggatgtgtaaggtgatatggtgcactctcctttcatcatactggcctaggcaatgtcccaacaattttaagcccaaccattatgctgctctacactgtcacctgaacaactaaacattgctgacgagaacacttaattaggtctattgattataccttaaaactgtgcccacggatctcaaataggcattcaatattgcctggcaatggtattacatatacctaatacatttattttttcgtaagtttattttttccagaataattatttcataccttcttttcgagcctcaaactgcttatattctacccctctctaaaggaaatcatatttcaataaatatttattgagcatctatttcatgccattgttctaagcactgagagagcagtggacaacacagtctttgctctcaaggaacttaaattccagtgcggggagacagaaataaacaagtgtataggattccgtatggtgctaagtgctatggaaaaaaaataaagcaggttggggaaaagagaatgctgataaaagcagcagatcccagattcttctagggcataacaagagctttgctttaactttgggtgatatctgtagccactggtggggtcaaaacaaaaaaactgacataacccaacttaggttttgaaaggatcactttgtctgctgtagttagaataaaccatccatgagagagaaagagtatcaatagggagactgttttattggccttggttcctgggccttttctggtcatcttcgactaccttcttggcctaaattcttgcttccccactattccacgttttaatgggaaaaattgtcaaagtataattttcaaaaagttaaaaatgtgactcatacaaatatagaatgaaaatgtgtcgaatgtttattaactcattaatattaactcaatgtctctcaaaccaggtataggcactgaaaaagtaatgttagaattaggttgctggacagcatagaggatcatggtggacgggaggcgggactagattgcaactaccacgcagacagacagagcagtatgtggagactcgcactgtaaccttttgctccagaactactgcaggaataaaccaggaaagctgagaaaacccacagactctctgaagaaagcggatgactcctgtaggacactggagacaacccaaatactgtgaatgcccaagctgtggtagtgggaaaagagaactgtccacccctgaacacataccctcactggggaacctgaaggtctggatcacaggagaatattctgaccttacctggagctgagtcaatttagagagcagagcaaaatacaggggtaaaggaagcagcaggaaaagccctgtgggctctctgggtcccctgggtacccatttctgccttgtctcacaggggtccttgaggagggctgccagagaaaagaccacagggagaaggaaacctctagctgaactttgtaacaattccaactgaatgtgaagtctcctggccagaacccggtggaggtcatgaatctggaatgcagacttcacaggctgaaaggaacaaaaacccagctggctttcacagtgggaggctggtagcctggggcaagctctcagccctgctctcccactgcctggaaattcacttggtgctgttgggggggtgcacagtgggagtgagaccagccttttgggttgcttgggaggtgggtaaggcctgtgactgccagctttctcccacttccttgactaactgcatgacacagcagaggcagccttaatcctactgggaacataactccattgacctgggaaccacatccccattccccacagaagccgcagcaagacccacccaaggagagcctgagcttagacaggcctaaccctgacccaacctgatggtctccttccctacccaccctggtggctgaagacaaagggcatatactctcctgagttctagggctctgcccaccagctgatcctccctatactaccacagctgatgctctcttcaaagtgccacctcctggcaggaggccaatcagcacaaaaatagtgcattaaacaaccaaaactaaggaccctcacagagtccatttcacccccctgccacctcctccagagcaggtgctgatatccatggctgagacacctgcagactgttcacatcacagaacccggtgcagacaatccccagtaccagcccagagcttggtagacctgctgggtggctagatccagaagagaaataacaatcacaacagctcagctctcaggaagccacatccctaggaaaagggagagagtacttcatcaagggaacaccccatgggacaaaagaatttgaacagcagccttgagccctagaccttccctctgacacagcctacctaactgagaaggaaccagaaaaacaattctggtaatatgataaaacaaggttctttaacacccacaaaaaaatcacactagctcaccagcaatggatccaaaccaagaagaaatccctgatttacctgaaaaagaaatcagaaggtcagttattaagctaaaatcaaggaggcaccagagaaaagcaaagtccaatttaaggaaataaaaaatgatacaagaaatgaggggagaaatcgtcagtgaaatagcataaatacaaaacaatcaaaacttcaggaaacaatggatgcaaaaattgtagaaatgcaaaatgttctggaaagtctcagcaatagaattgacaagcagaagaaagaacttcagagctcaaagacaaggttttttaattaatccatatgaaaaagacaaagaaagaataagaaaatatgccccagtatgctgattgttttttactttatttccaaattcgaggtaatttttcttaacaatttctcatgaaaacattttttttgaaagtctcacagagtcttgattaacattttgaatttacatgaggaatgtgaggtagcatcgtaggtcaatttctcatcttcttttctggttttccagacgtttccctttgattgctagtttttgctgttacaatatcgtagacaagagatgcaaaggatctgaatttaggcaatagcattactttttttttttttaaatcaggtttacattcaagacaagacctttccttattcttacactatggggctattgtatcatgatgaatataatcttctctcataatcattaatctcatcagcaatgtacataactaccatctaattctcagaccctattcaaattttgctagttgtcccagtaatgtcctgtcaggtgcagttcctcaatctttccttgacttttgtagctgtaacacttttgaagattatagtcgagatattttatataatgaactttaatttgatttgtctgacacttccctcatgattagaatcagattatgcatctttggcaggaatataacagaactgacactgtattcttctaattgcagcctatcagatgcacacaacttgtatatgttccattatgatgatgttcatgttgatcatttgattaacataggactggacaaggttttccactgtaaatttactcctttttccccatttgtaattaataagtatttggtggggagaatctatgaaaatatgtaaatgtattagtccttatcaatctattatttaaattgatcactatgagcttgtggttttatgtaatgggttatagtttgttaaccatcattatttcaatgctgagagtgactcagatttgaccagcgggagtccattcaagctgtttctgtatgcccttcacatgtttccaacattattctttgagcacttccttactttctggcacaagatgatccagtctcaatttgtgctttttctgaatcagccatttctccaaggatccttggttccttttagtggagaatgatacttcaaatccaagatctgggcattatgcatgctcattatcactggggtacctttgctactaagtgttctaagtggacaaagccagaggaagtacacccacacaagtacatatatatgtatacatataccatatattcatatatgtacatacacatataaaatgtatacacataaatttacatctgtatttatttctatactatatatagttggccctctgtatgcatgggttctgcatcttgggattcgaccaactgcaggtctaaaatatttgagggctgggtacagcggctcatactgctaatcccaggactttgggaggctgaagtgggaggatcactggagcccaggtgtctgagaccagtctgggcaacacaggaagatcccatctctacaaaaaaagagaaaaataaaaccacaataaaaagtaacatgccactgaaagtacattaaaaatggtaacttttatgttatgtatattttaccataatttttaaaaaagtagtatctcctagtagaaaaaaagtaacaataaaaaataatataaattaaaaacccaacatagtataaccactatttacatagcatgtatattgtattaggtactataagtaatctagatatgatttaaaagtataaagaggatgctttaatagcatgtaagaaaaaagaaaaagagtatacggaaggaaatgtgttaggttatatgcaaatactatggtgttttatgtaagggacttgaggatctgaagattttggcatctgtggggggtcctgaaaccattcccctgctggtatcaagggatgactatgtattttaagctatgaatttgcactatttctaattttaatccaacattagagttcatttctctcttttcatatttgtaactttcttctctgacagtctgaaactgaactccaattattcttaatatatttactgattccatcaatccttctgaatgtaagcaacctcccagtcactgctgcccaatcctctgcatggagacccttcttatccactgagaacccaatactctgcatcaggctgatgctgccaccctccctcacaccactgtcctcttcagcttacctatgctctgacacctctctctgggcctctgacaccccattcctaccaagcaccgatgcctatcttgctctacttgacctttaagattgaattgttccgggaatggaaaggaaaggaagagggaaagtgtctgtaatttccttaagtttttttttttttttttgagcaggagcacagtggtgtgatcctggcttactgcaacctctgcctcccaggttcaagagattctcctgcctcagtctcctgagtagctgggattataggcatgcatcaccatgcccggctaatttttgtatttttagtagagacggggtttcaccatgttggccaggctggtgtcgaactcctgacttcaggtgatccgcccgcctcggcctcccaaagtgctgggattacaggcatgagtcaccgtgcccggccccttaacatgctttttgaagccatccttttaccactacaaacaatattgtaatgaataagtgtctatgacaaggttgtgaacttgctgcatcaaagagcttgtgcatttgcaaggttgttggttctgcacattgatttccatagaagttaacaatttacacatccacctgcaacacaggatggtgcttgaaagaatttaaaagaaagataattctaatacatagaaagacctaagagttacatgatgacttttgcaaaacttaagacaacttattttctcttttggaaatacgtttattgttacacaaatcaaatttcctactattcagtttcttagtaacaaaaatgaaacaaaatttagctatcccaagcaaatttaggaacataaaacaataaccaaacagacggggtaaaaagtaactataagaacccccaggctgggcacagcagcctgtgcctgtagtccaattgtttggcaggccgaggcaggaggatcccttgaacctaggagttcgaggccatcctgggcagtctagcgagactatgtctcaaaaccaaaccaaacaaaatacacaacaacaacaaaaaagtttttgaagaaccctcagaaacataaattaggaccctaagctaagtagactttagtgcaacagctctgcaatttacaaggcaaaaattacaaccctgaaaagcaggatgacacaaagcccggaaataattttctaccaacctggttggtcagatacttgtcagaaaactgttttccaggttatgagcttaaattctttttacagactggcaacggtatcaggacgctttttagagtgtcccctgctattgcctcgggcatgtcagaaactggataggagtttcaagttgagcagtttgtccaggatttcctgggctttagcactgaacgcgctgcgtccctggtaccccttcagttccaagcaaacctgcttgttggccactgtaggaccagacttacgtcaagtacagttgccactacacagatgtggctacttacatttaagttaaatactttttacttttgagatggagtctcactttgtcgtgcaggctggggtacagtggcgcgatctcggctcactgcagcctcgacctcctggctcaagccatcctccccgctcaacctaggactacaggcttgcgccaccacgcccagcggctaatttttgtatttttagtagatacggggtttcgccatgttggcgaggctggtctccaactcctggcttcaagcgatctgcctgcctcggcctcccaaagtgctgggattacaggcgtgagccaccgcgccggccctaaattaaattaaaaattcagttcctcagccggctcaacaccacacatgtggccagtggctgccttaataacgcagatgtagaatatttccctcatctcacagagttctgacaacgctgaggcagacagttgagagtttttttaaaaacaaaaacaaaaagcttggaaaccgctagtctccaccacctataataaccaacgggcattattactctctccaaatgggatgaggaaaaaactacgctaaggaacaccatgcagaaaatctgccgaggcacaggccagcggggtttctctgcgaacgcagccgacggccatttccacagcggaggccgtcgtcggtccagcgaggtaagaaacttgtaggacgcccggaactcccagagggttgggcgttcaagggtcaggacccccgagatgcaattgtccaaagcggtgggtgctcgtggtcaccggctggcgagcctcggctacggataccccaatgcaccactccgccccgccccgcgcctaacgccggctggagagcgcgcggccgcagggtaggcgccctcccgcacgcgcgaaggcctgcggcccggaggcagccggcagccaatggggcggggcgccgcgcgcagggggcggggccgtgacgcgccctcctcgtgacccggctctcggcctgcgctcgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcgggggtgggtacaggaccacgtccgggactgtggctcaggagagttgggaaaggaggagggtgtaatgatggtcagcgctgggggcctcagtttccccaacagtaagaaaaaggggttggactgagtctgtagagttgggtcatcagaaaaagggggtggcattatggggcttgggatttgggtttttgcttccaagaatgctgttggacatctttggttcatataggtgtgattggttttcttgggggtcctgattccccaaccctcttgctcttcctccacccactccaccacggcttcttctcatcttcacctggagttgccaggaaggatccttttctgaaacaagtggggtggagacactggtagtggttagaaatttgagctttgtagccagaaatgttcatgtccaccaacttctaactatgtaaccttggattaattatcttctcagaaccttagtttcctcctctataaagtggaaagaacatctgcctaatgcggctgttggaagaattaaaagagatattgcctgtgacttcatcttagtgatgtgaacagtctggagctagctagcggccaggactccagttccactctgcttattagcggtatactatgggcaagttacttacattctctgtgcctgtttactaatctgtaaaatggggataaaaggaggttttagaaaacaacacatagtaatacctctaagtaaatgggaggtaaatttttaagaaattgtaagactgctcttcattcttcataccttaagggttctctaggtgtgtggtagctgctgtgaggcacttaattttaaaaagaaaaacagacaattcctgctcctaagtactttataaagtttagactaggaaaagattagagtgtcagggttggtgggagtcacgaggtgtgggccggatatgcttggtaaaggaaaaacatgaggaataacattgggattggagaatgagaaagttcctcttgtattacggggacagcaagtagtctcatgaaaatgtggttggaattattccataaatttaaacttgtctaaacttgtttatagttgcactaaatataaatttgtacctagttggatcctgctttaagtcagcctgttatttaaaataaatctgtcatggctgtgtgcggtggctcatgcctgtaatcccagcactttgggaggctgaggcagggggatcacctgaggtcaggagttggagactagcgtggccaacatggtgaaacccccgtctctactaaaaatacaaaaattatccgggcgtggtggcacgtgcctgtagtcccagctgctctggaagctgaggcagaagaattgcggtacacgtctgtagttccagctactcgggaagctgaggcagaagaatcacttgagcctggaaggccaaggttggggtgagccaagattgcactactgcactccttcctgggcaacagagtgagactccatctcacaataaataaataaataaaaataaaataaaaatctgtcattttacataactggggaatttatttgcattaaataaattctgtggtcaatctctctgtaaagagcatgtttttttttttttcttttttcttttttttctgagacaaggtcttgctctgttgcccaggctggatggagttcagtggtgtcatctcggctcactgcaatctccgcctcctgggttcaagtgattctcctgcctcagcttcctgagtagctggaactacagatgtgcactgccacacctaactaattattgtatttttagtagagacaggtttcaccatgttgaccaggctgttctcgaactcctggcctcaagtaatccacccacctcagcctcccaaagatttgggattacaggtgtgagccaccacacctggccaaggacatattttcgaggtaaataaattcaggcttacatgcggtattttccaggcacacttccattgggtatagcaaggaatatatatcttactatcactttaaaataaagtacccaagacatgtccctgtcaactacagcaggatacgatatagcatcatattcagtgttgagtggttaagatgagttgttttagggttccatttactctaaagaacaagggctattgtgggcagaatggccagggatcatgatgcaaagtttgggtctttgaaggcagcaaatgcttttctcatgtgtgtaggtactgtggaattaaagagaggctaaaaatagcacctcaaactctagggtgcagtattatgggcatcacccaatctgcatgtgaatttccatatgaattccccactacccaaaggaggcttcccagtgggggagttgtagaaacccccttcctttccctcagattctaccagcaacctgggtacccagctcaactcaccctgatgtgaaaggaagtggataaacaggtgaaaagaggcagggaaactttttttgtattttctctccaactcatcctaggccttggtctcggctcgccttatttccccagtagagctggatatgattcattagctcaaaagtgtgacatctacagttctgaggtactttatagatttaaaaggctatatggactggtttgggagttgaaccatcatgtataataatgaacttatgaggccaggtgtggtggctcgtgtctgtaatcccagcactttgggaggccaaggcaggcagatcacctgaggccaggagttcgagaccagcctggccaacatggtgaaaccctgcctctactaaaaatacaaaaaaaaaaaaaaaaaaaaaaaattagccgggtgtggtggtgcgcagctactcaggaggctgaggcaggagaattgcttgaacccgggaggtggaggttgcagtgagccaagatagtgccaccactctccaacctgggggacagagtaagactccgttgcaaaaaaaaaccaaaacaaaacaaaacaaaaacctatggaaaaatgtgtcatgagtgaacttgaaggaattagttgtctcttggggaggtttatttatccagtgtagtatattttcttttctttttcttttttttttgagacagagtcttgctctgttgcccaggctggagtgcagtggcataatctcagctcactgcaagctccacctcccaggttcatgccattctcctgccttagcctcccaagcagctgggactacaggcgcccgccaccacgcccggctgattttttatatttttagtaaagacggggtttcaccgtgttagccaggatggtctcaatctcctgacctcgtgatctgcacacctcgacctcccaaagtgctgggattacaggtgtgagccaccacacccagccctttttttttttttttgagacggagtttccctcttgttacccaggctggagtgcaatggcgggatctcggctcactgcaaccttcgcctcccaggttcaagcgattctcctgcctcagcctcccaagtagctgggattacaggcgcccaccaccacgcctggctaatttttgtatttttagtagagacagggtttcactatgttggccaggctggtctcaaactcctgacctcaggtggtccacccggctcggcctcccagagtgctgggattacaggcgtgagccaccacgcccagcctatccagtgtaatgtattttgtttgactcagactcagtcttttattgaaatcagtttttagcaagcacctactattcttgaatattgggctggtaaaaggataagaaggaaaagaagggtaagattcaggcctcaaactatcagtatagttaggggaaataaaataccttatatggggaaataggaaaatatcagtgagtgttataaattgtaccatagcaatttagaacaaaagagtgaaaggaatgccaagttaaaggagggaacagagccagatgcagtggctcatgcctgtaatcccagcactttgggaagccgaggcaggtggatcgcttgaggccaggagtttgagaccagcctagccaacatggcaaaaccccgtctctactaaaaatataaaaaattagccaggagtagtggcatgtgcctgtaatcccagctactcaggaggctgaggtgggagaatcacttgagcctgggaggctgaggtttcagtgaaccaagtttgcaccactgcactccagcctgggtgacagagcaagactccatctcaaaaaaagaaaaaaaaaatgacggaacagagcaaggctggttcatcaggggaaacctacaagctgaatctcaaggcattctttctacccttctttagtgtgaatggacatggattgattgagagaggagaggagtataataaggagaaaaaaagaatcaaagccagaaactagtaagctatttatgtggtacagcaatataattagtttaactataatagaattccctgataagaatcctaggttcttgtcacttccttttagaatttctgggagagggatcgcatatagtttcattatctcaaggtgaaaaatacagtgatttctgaaacctgaatgatagaactgagggattccctcttccttagagtcatactttctccttttagtttaaactgatagggacatagtttcattgtgattcagcattatcggaatggtcctgaggatgcttttgccccctcagattctgaattggtaggctctgtcctattctacttggtttgtttaaaatttagatagtgtttaaaatttagatctatagatccatccatctacctatctatctctatctatctatgtatctgtgtatctttgtgaagtgctagtcatttgggttatgtatttggtgagtattcaatatacttttactgtagattattaaataatgaattctgaggactatagggagaaagccagaacatagtgtaataatctgtgtctttcattagagatcagaaaatgtaatatttcttctgcattcattcaaaaaaattattgagtacctattatgtacaggttgtggtagctactagggatatagcatgaatgagcagagcttgtagtctgaagacagacattaagcatctcattatacaaataattatttaattcatgtgtgataagtgttgctgattaaaaaacccagatgctaccaatgcatatgacaagagtgctgatcttgagtatgactggggggtaggtagaatggtcagtgattaaagcagacacctacaatttgagagaacacaggcaggggagggaaggtatacatgtaaagaaatagcaggcatgaagactgagatgggaaggagtttgtggtgtatctgaggtctagaacacagcacagtgagcaagaaggaaacccgtggtctgagcctaaggaagtacacaggtgccaggtcatgtgggccttgtagggtatgttaaggattttagactttgattttaaagcagtatgacgttagtgaaaggtttaattctgtggaatgacataatcagatttgtactttaaaaggctatgctggctatgtgacagaaaatggagagggtaggggctggggagggtaggggaagaagatatgtggggagatgaattaggagactgttgcagtggtgtgagagacagtggtgtctaggctatgtgggggccatcatgatgtggagaaatgggtggatttcagagatacttaggaggcagaaattacaggcttggaggttaattgaatgtggggagtaaggaaaaggtagtgatgatttccagggttttaataagagcagcttaatgaatagggttgtcatttactgagctggagggaggagtctgtttagtgggcgaagatcattaactcagttttgaacgtgttgattttgaggtgtttatgagctttctaagtggatatattgattgcctatgtggttgaatatacacatctagaggactggactagagataacacctttgggagtgtcggcataaaaatggcatttgaaattatgacatgggtgaacatacctgaagaatgagtaggaacactaagagtttaagattaaatagagggtaaactctcaaaggtgactgagaaggaagaattggagagataaagaagaatgaggagagcatgatgccctgtaaatcaaggaaaagggaaggggtggttatttgtgtcaaatcctgctgagagaattggagatatatctgtcaacactggcagtattggtgacactaacaagagtgaatttgatggagtccttgggtacgaaagtgagatcagagtgggttgaacagggattggaagatgaggacatgggaagagtgaacctagacaactgctgaagagtttggccttgatggggagataagaaagagaagtcactaaagagcaatgtgggactcagagactttctttcatttctctttctctatttttttttttttttttttttttagacagaggctcgctctgtcaaccaagctggagtgcatggcacaatctcggctcactgcaacctccaccatcccaggttcaagcgattctccagcctcagcctcctgagtagctgggactatgggtgtgcaccaccacacccagctaattttatacttttagtagagatggggtttcaccaggttggctggactggtctcgaactcctgaccttaggtgatctgcctgcctcggcctcccaaagtattgggatacaggcgtgagccacggtgccaggctgactttctatcatttctttccattcccctgtccctccattcctctgtcctgccttcccttcttccttgtccaagatgggagagagctggacatgtttaaatgttgatagtaagggtcctttagagaaagtgaagattctgtaggagggagtgggaagcagacaaggtcagtttccagaaaaggcaggatagatgggatctagggcatcctcagagagatgggccttgaaaaggacaggtgccttccccaccttaatgggagggtagaaggagaggttgcatgtaggggtaggcaggttagagtttcagctcgaaggcttctgttatccaggaggctagatcttcttttgagagtaaagagtgggagagagatcagagtttctgggagagtggagaggatttgaaatagcggttgtaaaaaggagagaatgagcagacagaaaagtgaggagtacggtttgggattatggatttactttggaattaatctgtgttgttaattttttgccagcagctcctgacttcctgggtgcaggcatgatcaaaggaaatggctggcttcaagatggttagggttctgctaagtagttaggatagatttgagtattaagagttctaagtataagcaaggaccattgattttttggtcacttggcgaggtgttgggaatacaaagatgtgacagtttccattttaaagggacatctgtccagaagagaaacctaaacatatataggtggatatcatgctttaagaaaccatgcatcagggtaatgacgcatgggtcccacattgctctttagtgacctctctttcttatctccccatcaaggccaaactcttcagcagttgtctaggttcactcttcccatgtcctcatcttccattccctgttcaacccactctgatctcactttcacactcaaggactccatcaaattcattcttgttagtgtcaccaatactgccagtgttgacagatgtacctccagttctctcagcaggatttgacacaaataaccaccccttcccttttccttgatttacaggacatcatgctctccttatttttctttatctctccaattcttccttctcagtcacctctgatagtttaccctctacccagctaacactacctatttcatagagttgttatgaggattaaataaggaagttggaacatttggaactggtaagtagtaagtacctcatcatcgtttggattattaatcatttcctttctgtcctcactgttgccatcatcctttcattatacctgatctatggaagtagtgtaatgagtctccctgcctcctcaccctacatatcacggcctaaagatgtattcctcaaactgcttttcatgacaccctcctcataaatcttaaagaatttctcactggctaactctcatgaccctcacggcctctcataaccttgttctaacttagccctttaatagccctactttcatagactactgaatactctccgaataccacataatcattatcactttcaccccatgatcatttaattcttctattttcgaatcctcttctcttcctcaatatagggcttagttcatatcctgcttccttcatgaactctttcctaatttctcaaaactacattgatatcttcctgaaccgaactgttccacacattgaacactcatacaggctctactgtattgatttttaaaatagccagtcacccacttatgaagattcaacttaaccaactaatgacacttatccaactaaacctacttagagcacttcaggttggcagcatggtagctaggtgaaatagcatatatcagtcactgtgtgccagacagtgtgctgagtgattaatgtatgctatttcatttaatacagtaactgtaggacccctgattttgaaactgaaccttagcgaggttgggtcagctgcccaaggtcactagctagtgacccaggcttgtattaatacaatattattacttctacttaagaagtgataataggccaggcatggtggctcatgcctgtaatcccagcactttgggaggccgaggcaggtggatcgtctgaggtcaggagttcgagaccagtcaggccaacatggtgaaaccccgtctgtactaaaaataaaaattagccaagcatggtggcatgtgcctgtagtcccagctgctcgggcggctaaggcaggaggatcgcttgaacccaggaggcagatgttgcagtgagctgagattgcgtcactgcactccagcctgggcgatagagtgagactccatctcaaaaaaaaaaaaaaaaaagtgataatagaaaattttcttctatggctggtattgctcagaaggtaattctaaaaaagagttttaaaatgttctgttcatggccaggtgcagtggctcatgcctataatcccagcactttgggaggccgaggtggatggatcatttgagttcaggagttcaagatcagcctggccaacatagtgaaaccccgtctctactacaaacacaaaaattagctgggtgtggtggcatgtgcctgtagtcccagctacctgggaggctgtggcatgagaatcgcttggattttatattttaaagcagaaattcttccttttctccctcttttctccttttttccatttcttctcccacatgactgaccatttgtttcccaggagttaccactcttttattattcatcacactgtataactccttgtctgtgtaactgcgagaggttctcaaagccccagaattgatggcattcttttatactttttatatcctcagaacttcaggatttttatagtgcctagtaaatagtaggagttaaataactttgaaagaattaagggtcagcaggacttagttccttgcttggggcacgaaggaaaggaaatagataaggatcaaatgatttgggaacttggatttattatttgcatagcatgagtttctttcattattaaaatgatctacaaaagcatatttttccatctgggtacaaactatttagataacaaagattttcttcctttgcaagtgaacctagtaccaataaatgttagctgctaattactttattatcattgtttttattaatgttaacatctgatcatatcaaacaaaatgttaaaaagcttataataaatgttatttttgtaaggtttttgcctcaagttgtttgcaaagtctgaaaatactcagattgtatttttctgtcttctttttgttacagaatacttcagagagtcagagttgtgccagaagtctcttaatggcagatagaatgcaaatagttgtgattctctcagaattttttaataccacatggcaggaggcaaattgtgcaagtaagtaattctttcattttcatgttgcagttatggttcagtagtacagatgtcagattttattttagtgaattttgggatctttgaagctggataatactttttattgctaagtttaaataaactgtcatggacaccatggtttattaatggcaactgagcaaatagcgaaaggcagaaaagtgtagcagttactatgagctttggatttagatagacttgggtttgattctaagctctgccacttactagccctaacctactagctgtcagatatgggagaaaaactttgcctcttggaagttcagtttcttcatctgtaaattggtggtaatgatagaacctatcttatatagtcgccttgagaatgaaatgaaataaattgtgtaaagcacttagctcaatgcctgacacgtatttagtgttcaagaaatgttaactgtttagtataataataattatgatgtttacagtaatctgtcaagtggtgtgtggcaggcggcggggtgggatgatgacatctgttctaccttctttgcaggtttgtgtgtaattgtgtaataaaataagatctatttttagatattctttggaaaaattaaaatcacttccaattcagatgatgttttgaataccaactatgtgctaggcagttcttatttttcaagtcttataatttaatgagtgagaaagatatatttacaaatacagcctaggacagacacataaatgctttaataaagttatagagtccttggaggaagaagaaaataaatcttactggggagaatttgaaatgacttcctggaggagctaccttttgaacctaggcctgtactattggacatgatttcaataagtagagatgacgccagtgaggcggctcacgcctgtaatcccagcactttgggaagccaaggcagaattgcttgagcccaggagtttgagaccagcctggggaacatagtgagacccccatctctacaaaaatatatattttttaaattagatggacatggtggtgtgtgactgtagtcctagccacttgggaggctaaggcaggaggatcccttcagcccaggaattcaaggatgcagtgagatatgattgtgccactgcattccagcctgggcaacagagcaagaccctgtcttaaaaaaaaaaaaaagtagaaatgagagaaggacattgcaggtagtcacagaggtataaaagggcaacagatgttccaggaagcatagtgggaggtaaagttagcaagggaaagtaggaccttgactgacagagtagtatactatttgggccaacattttttatactgcttagaatatcagcatattattaagaaggggttatagaccaggcatggtggctcacacctgtaatcccagcactttgggaggccaaggtgggagaattgtttgagcctaggagttcaagaccagcttaggcaacatggcaaaactttgtctcaacaaaaaataaaaaattaactggacttggtggcatgtgcctgtagtcccagcaacttgggaggctgagatgggaggtcaaggctgcaatgaatcatggttgtgccactgctccccgctctgggcaacagaacgagaccctatctacaacaacaataacaaaaaaaaaaaaaaaaagaaaagaaaagcttatatagtattctcctattatgattatatagtattctattagccatggtttcacttgctgtagtttcagttactgcagtcaactgcagtccaaaaatattaaatggaaaatttcagaagtaaaccatttataatcttaaattgtgtatgattctgagtagcataatgaaatcccatgccatcctgcttcatctacttgggctgcgaatcatccatttgtgcagcatatctatactgtagatgctgcccctcctgtgaggcactcaggagcatcttggttataaggtcaactgtcatggtatggcactacttgtgttcaggtaacccttagtttacttactaattctttaataatagtaacataattattagtttttgtttttaatctcttactgtgcctaatttataaattaaactttatcatgggtatgatatagaaaacagaaaaaaccatagtatatagaaggtttggtactatactagaaaaaaaaacatagaaatagaaaaaaacgtagtatatagaaggtttggtactatacttggtttcaagcatccattgggagtcttggaatatatcccttgaagataagagttgactactgtatgttgtagtatctttgggatttacaatgcacctggaatattaaatgcattgagatttttttaaaagggtttttttttggctcagtggggaggctcacacctgtaatcccagcacttcaggaggacaagatggtagtattgcttgagcccaggagttcaagaccagcctgggcaacattttttgtagagacagagtctctacaaagaaaagaaaagaaaagaaaaaaattagctgggcatggtggcaaatgcctatagtcccagctgcctgggaggctgaggtaagaggagtgcttgagcccaggagttggaggccacattgagctatgactgtgccactgcactccagcctaggcaacagagcaagaccctgtcttaaagaaaaaggttttttaaacatcatttaacctagcactttctaagcctttaaaaaaaaaaaaaaactacaaagatccttttttcatggaacctcattggaagagagagagaccagtaagaagtttactgctatagtttaggcaagaaggaaagaaaatgtgaagtagggaggggccttggaaatagaaggatagattaaaaatttgtgtacctataagtcattaagtagcttagcttttatcaagacttgtctttttgtttagttcatatgaagaaaaactaaaatgggataagaagccccagccagtttttttcccttgtcagtatactatggtatattgaatactgacttttaaaattttgtttccgaagcttgactaacacaacttttttttttagcatatcctttacttttcagagtaaaattttctagtataaatatgattgaagagcatttgcttaacatatgtagacctgtttttaagtattcttaagctttttagaaaaatccattaacatagaaaaatatgttaattataaataatttaaaatcagttaattggaataagtggatatatactgggattcacttctttattttttaattttattttaagactagtcaagtgcagcagtgagaagaggggaaagagtagaacaaggagttcgatctgtaaccaactgtgaacaattaattgagataactcactaccttcagatgagccaggggttcacttcttttgacagatgtgactaaatttatatacttagaagaggcagggcattttttttctttaaaaagtgtttttgtttgtttgatttttgagacagagtcttgctctgttgcccaggctggaatacagtggcacaatctcagctcactgtagcctccacctcttgagggctcaagtgatcctccagcctcagcctcccaagcagctggggctacaggcagcacgaggatgcctggccaatttttgtgtttttaatagagatgctgttttgtcatgttgcccaggctggtctcggattcctagactcaagcaatcctccttccttggcctcccaaagtgctgagattgaaagtgtgagccactgtgcctggcttaaaaggtgttttgtaaaaaagatttcactaattcgaagtacagaccttttttccccagttagttgaaaagaaaacgttttaccgcatactcagtatggcaggtataaaatgctttagaataaattcttagggtattttgttcttctgtgaggcatcctatcttgaaaatattccttacattgaacttctgaggaccaaataaaatgctaagcaattagatatgacttacttaaaagactcttcccaattaaaattaatttggcccagacatatggtctcaggtaaaagaagcgaggtacagagaagtatgatattttgtgttctaaaaatacatatgtattttgagggagggcagttggatagctgtgtgggcaggaaagaaaggaagatttagttttcaccgtatttgcatttgtaccctttggattttatgccatatacatttaatatgtattcaaaaatatatagaaatttaaaaaatttaacagaatgttcaaatctgtgatgagtatttgtatgttagatgtggttagagagattagctatttcattttccagaattacgcattaaaaattatcatcattcatcatcccatttatgtggcagaaaagtggaagagtaaatcccatttgtgaagaaggaaccctcatgacctagtcacttcctaaaggcctcacttcttgatattattgtattggccatcaagtttcaacatatcaattttgggagacacattcagaccataacaggggctattagaatttttgtaaaataatattattaaataacagaaaaaaatgtaaaaacatgaaaggtaaaatattactagaaagaatattattaaaatgagtatactgcccaaaactatctttctgttctgcttaatttagcttgaaataggggtggcatctagtctctgcagttattattcatgaaaggaaggctaggaatccaagagaggagagaatgccatccatgtactactcccatcccttttcttctcagaattcctgtgtcttcaaatggtattagtcttggtaggaatctggttattggaaattgatggaaggtcaaaagaagtgttaagagtgcaactttttctactcatactacaaataacatggaaactagctgtttctgatggagaatgactgccaaaaagtaaagagagtatattaaaggtttctcagaattttaaaggtgtgtattgttgacatagggatagccttgttattgagacccttcttgcttatcttgtgcatacagcagttaaataatcagcagaatgaccagatttgatgagttcatgactgctttagtgttttggttctttggtaagcagtatccagtatgaagcattattataatgagataggcctcaaaattatcagttcagatatttgttcttacacactgaaaactctttctttatgagcaacctatatcttcagtgatacaggtgatctgggtgataattaatgagcataatgatgctgttgaaccactgtgtaatcccgatgtatattctgattcatcagaggaaaactaactttcagttaacacatacaatgtatgtcttgatgctttaaaaagcaacaacaatagtacttaatgattaaccagaaggtcaattaaccaaaacatttttttttttttaagacggagtcttgctctgtcacccaggccggagtgcagtggtgcgatctcagttcactgcaagctccgcctcccaggttcacgccattctcctgcctcagcctcctgagtagctgggactacaggtgcccaccaccacgcccggctaactttttttgtatttttagttgagacggggtttcaccgtggtctcgatctcctgacctcgtgatccacctgcctcggcctcccaaagtgctgggattacaggcgtgagccactgcgcccggcccaaaacctttctttcccatattttatccagagggaaatgtactaagcgttataatcatattatttgtatcttataatttaaagtatcttagttttcatatttgttaaacttaattaggtcatttaggtacaaagttgccgtagtttatttttattttctgaagcttaccctaaattggtgattatctctgctattttctataaaactagttttgaaaaacagcaaagatctttgtaaaattcctaagagatgccaaatgctttatttaaagatgcataattcctgttatgataatttagtaggtttctctgtgaggtcttaacttgaatccttaatacctttaagaatgcctcttgaggccaggcacattggaggctgcaatgagctgagattatgccagtgcactccagcctgggtgacagtgagattcttctgtctcagaaaaaaaaaaaaaaaaaaaaagattgactcttaagctgatgcctgagccttctctgagaaagccactctgctaatctgcccttgatgaggctccattgattatctaagatgaaggaaattcataatgaccacttcacttagtgcttaaaggaagctttattattattaatattctttaactcaccaatttctaaaacatacagcttctcactgtttataatcttaagctcccaattcctgcaaaaagataaaaaaggaatttactagagatctgttatttcgattcagaaagtcatggctttttaataatgaagactttttaaccccattatataaatgaactgctttatgctttatgttaccaccatctaatgatcattgaaaaagttttgatggtaatgcattaatgtaattattaataaaagaaattaagttcttttgttcttcagagaagctttctttataaattgcttttgcaaaagaaattatttgttttaattaggtatcttgcatagaagaaatttgctattgctctctcatgataatgcactttatactacttttgctggcagtatgtggaccccttttatccctatattgttatgtcagttgtcacgacatagctcattataacacagatgtacaactgttgtgaatgaaattgtgttcccttaacttccctgcaacacatcaactacaaaaactatataattgtttttgtaaacatgtacaaaaactatgtaattgtttgtttttatttatatcaactctgcctcatccctaaaaggattgcgggctacttcatgatgatattaaactagcattaagaggggcaatgagacaagttcttactctttcatgcaggttggaatgcagtggcgcaatcacagcttattgcagcctcgacctccccaagctgaagcaattctcccctctcagcctcccaagccgctgggaccacagatgcacgccaccatgcctggctaattttgtattatttgtagagacaggttttcaccatgttgcccaggctggtctcgaactcctggactcaggcaatccacctgcctcccaaaatgctgggattacaggtgtgaaccaccatgctggcctatttttatatcaatggcttattaacttgtggtatgatcatcagcatatcacctatttctgtggcttagtttcctaatttgtagtgatccctcagattttttaaataagggtgagaagttagaatgagattcatgttctggagaagataaagcttcagagaatgtagagtatgtgagttcagagaggggacaactcctgaaataggtttaccaagaggatcctgtgtacaatgggtgcagaaggagccctgcacaagggggctgtacaaggaggtgaatggggctgaattccagcttagcttctggaggcaggaatgaccttttgtaatttatctacccagagggaatatctttttctgatttgcacaaaggagctttactgtgctgtctgcccctgtctaccaggtttaggtttcatctcagttgctaactctgatcagttggtggggactgcctgaatccctgtatggtgtaagatatctatgggtagtggagggagtaggcagtggcatgtatttgtagattccgagtcttgaacttttaatggtttagaatgtagatataaatatgtttattttgcagtgtttgagagtgcaggctcaagaatcagactgagtacagagtctagctttttacttaccagttttatgtccttgggcaacttccttaatttatctaaacctatctctgttccttatttataaaatggagataatgataatttttccctcatggaatcactgcaagaattaaatgggcaaatgtgtttaaagtgcagtgtaagcatagttcttagaacatagcaagtatttagtaagtgttaactttcgttgtagtaattgttgtctgtcagagtacatggatgtcccttagtgtgtcatatcctagtgtctacctagtccgtctctcttttctccacaaattctacttgccttgctgcctttctcctgggtaattgcaatagctttgcatgttgtctttccacttccagttgagagagatcctatctgatggccctgaatttctaaataaggtgggcataatacaaagccatctgttgaaattaaggggaacaagagtagggctgggactagagatgagaaaatatgtggaacatcccttgcagagcaattaggagggcatctacaaggatcattttgttgccccgagatcagaacacatgaatttgaattgagtcccttcattatcattttagaatttctgtagtagtattctgtaaccagactgagagtacagaaagtagatggggactgtccagggatgaaaatggctgtgaatatgtggaagataaagagggcaaggattctaggagagtcagatggaaacgactgaccacaagttccaagatctggaaccaggcagttgaacctcgattggagatagcaggctgagaacacaaggagaggtaaagacaaaggtttacctgaggataaagactaggttccctggctgagcgcagtggctcatgcctttaagtaatcccagcactttggaaggttgaggtgggaacatcacttgcgcccaggagttcaagtctgcaatgagctggcaaattgtgccactgcactccagcctgggcaaccgagcaagaccccgtttcttaaaaaaaaaaagaagaatagattattccctgaagaagggaaaatggatacataaattgtgatatacacatacatagaaaataaaagggatgagtgaacttgagctaactctaagcaagaatagccagttgcagagaaataccatttatgtaggatttttaaaaatgtaaaacaattttgtttctagactttacttgaagcccccacgtcagtattttaggcaaaattctcaccagtttgtttctctgggctcccaactcgtgatggattagaaagagcgaattttaaaagttaccccattaggtacaataaatgactcattagtgaagttggaagatgcagagaactatgaaatttgacacaaaaaatgataaggcatatgagtttcggtaaaattaatgcagggtaaacagtcttatgcctaaatagcactgttaaggcagcatttgatagctgatattccgtgattatgaccttgtgccatcaaaagtccatttgaattttatttggtatatttttatgaaaagagagtatgtgattattttaacatgttcatgaaaatggttatgacttttttaacttttggaaaataaaaggagtaagcttcatatatttggaaaattcatgcttgtttgaataaagaattactgtagtgtgaaacgaagctgatagcttaagatataaatgacaacatagaattgttccttgagttatattaatatactttttgaatttttttgacagattgtttaacaaacaacagtgaagaattatcaaacagcacagtatatttccttaatctatttaatcacaccctgacctgctttgaacataaccttcaggtattttatatataatatttaaaattaaaatgctgccttgtacaaaggaataatgtgcagttccaagtttttagagcactaattattgatatttatctaaattcatgatgtaaaggagttagtggacctggatttctgctcttaagtaagttcttctacttacaaatcatgaaaacctcagttctctcattgtaaaatggagataatatctatcctgcctatcttaaagtattttgtaatgagaatctggtgagataatgattgtgaaaacattgattgaggtgtgtgattgtttaattaaaacacaatggttttcaatctgacttacgtaggtattttgcagtgtagtatgattctgtctataggaagtttattctttgcctgaaatttgcttaagtatgttttacctaccttaaaaagcactgtttagtaagataactttgagtattgaattatgataataaaaggtagctttaagaatcttaaccttgtagattattgccatctctatctctgactcttgaattttggtattggaacttgcccggtcgtggtgaaggacgaggttggaactctggttaaaatgtagttttgaaacttacataacaagtaagtaatccccatagtagatgtacacatgcttagggtataagcatgtatgatttcttctgtaataaatgtggtaacactgaattatgaatttccttgagaataataaaaattgggccaggtgcagtatctcatgcctataatcccagcaccttgggaggccaaggcaggcaggtcacttgaggtcaggagttcgagatcaacctggccaatatggtgaaaccctgtctctactaaaaatacaaaacttagccaggcttggtggtgcacgcctgtagtgaagtagaggttgcagtgagttgagatcgtgccattgcactccagcctgggcgttgcagagagactctgtctcaaaaaaataaaataaaaaaaattaggtgaacatttctcagaatttgttctgcagcatgttaatagatgtcctatcagaaagggtttagtattccattaaggttgggaaatgctttactacaggacttcagagcctttagtggactgatgtgtgttgtaacactcaaatagcaatttttctataaagtcatcccttttatatatggcttcactttccacagtttcagttacctgtggccaactgcagtccaaaaatattaaatggaaaattctggaaataataagttttaaattgtacaccataaacagtcttcttttcatttaacttagagtacttgtatgagtttggtagatttctagaagtagaattactatattggcagcctaagaaaaagacactagagaaaattatctccaaatatgatgagtttattagggaataagaaagaagtatggtaatttggaatgcactggcaaaccaccagtacatccagtgagggaagggtaaagggaagcttttattagcaaaaagggagaggttcacacaagctgcttggaaactgagttcattggttcctgaggctcaaagccaagttgtcagttcattggtggcgatgccattactgggcaagtgttcttttgagtgcatcttatctgaattactgcagtcctaaagaatggcagtgataaaccatgtgaaagcaggagttgcaatgaagggcgtgaaaggatttcttgtggggtttttagaaagtctttggaaacaaggactctttttgtctctattttgtcttggtctgtcaaaaggtgatttcatcctaatgtctgcaactttcacattattaaaagatatgtgcattttaaatttgaataaaaattgtggccaggtatggtggcacctgcctgtaatcccagcactttggaaggttgaggtgggaggatcatttgagcccaggagttagaaattagcctgggcaaaatagcaagaccgtgtctcaaaaaaaaaaaaaaaaaaaaaggttaaattactccccatctagattatgtgcacaattttagttaaatggattatgtgctcaatttttttttttttttttgagacggagtctcgctctgtcacccgggctagagtgcagtggcgcgatctcggctcactgcaagctccgcctcccgggttcacgccattctcctgcctcagcctcccaagtagctgggactacaggtgcccgccaccacgcccggctaagttttgtatttttagtagagatggggtttcaccgtgttagccaggatggtctcgatctcctgaccttgtgatccgcccacctcggcctcccaaagtgctgggtttacaggtgtgaaccatcgcgcccagccctgtgctcaatttttaactaagtgcacaattgttctgtgaaaaacaagcaatgggctatttcttgtagcagactaaggagagacttagtttttctgtcaagcagatggtgagggtaacattgttgggccaacatcagtgtaattactttgatttttctcttttctctttcatcccaatgttcagttaatattctttcttcatactacaaagtaaagaataaagggcatagaaagcaaaggtgtgaactgactgtttagcaaacttattcttgaaaagacaagtgtcagtctagaagtacaaaatattgagatttagtagcataatattttatgtacctccactatcctcattttaggttatacaattctttggtatttggccctttttgttgactagaaaggcctggattatgagccttgtgataagagagttgagtggggatgcagttttggtgccttttccctttccatttaaaaagttctgtctcagtaagataaactatggtgttcaagtcagcataggcaggaacctattttatttattcagtgagagtaggatagataagtgagggtttgtgatgatgagataatttaggaaattttgtatttagttactagtcatttggcatatgaattattgttatcctcagttaacattagctaatgcagcagttttgaaaatttagaggcacctagaaagttccaaacagtttgccatctgcttcacataccgggtctctaatccttcggacttataatacaggtagaggtcgttttattttatagatgataaaactgagactcagagtgatttagtaacctactcaacatcacagcttagcactttaacacaccatattgtttcccgtcttctagaagcgtaaatagcttacattaaagagatattgtatataatgtttattgtatatattacatgtgcctttgtcattttaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcagtaagtactttgcttctgatgtgatacatattttagagtgttattgaatgtaccttcagtatgattattatttttggtgatagggtggaatctgcatattctgtcctcaaccaaaaataactagttataaagtagtaaagttttagaatatcctggtctgttaaaccaaaatggatatttccttagtagtctcatggttaggataaaaataaaacagaaattaattaggtacttcataagtgagttgatgctttggtacattttaatctttttaaatttgaaaatatgtgccatttgcagaggtgtaggtattgttatatgtttatatttcagtttcttgtgcacttgttgctaatttaagaagtttctgagctgggcacggtgactacacctgtaatcccagtactttgggaggctgaggcgggcagatcacgaagtcaggagttcaagaccagcctgaccaacatggtgaaaccccgtctctactaaaaatagaaaaattagccgggtgtagtggcacacgcctgttatcccagctattcaggaggctgaggcaggagaatcgcttgaaaccgggagggagaggttgcagtgagctgagatcgtgccagtgcactccagcctgggcgacagagcgagactccgtctcaaaaaaaaaaaaaaaaaaaaaaagacgtttctggatttcactacatgtttcagaagccattcctcaatcacttcctattccattgttttattttcttatatctattaccatctgaaaatatttatttatttatttttagtctgtcttcctcactaaaatataagccacatgaggacaaggacttaggctttttttgttcactattcagtatttaggacagtatttaggacagtctagcatataatgggcttaataaacatgtattaattgaatggtcaaaaaaaatttttttttctccattttatagcctgcctttacatagggtgccactagatggcaatcatgcctttttaggcactatgatgctggagttttggggcattagaggaaactgagaaattattggctcaaagtagagaacttgaggtcagaattaatgagcttaagaattgagaatgtgtgaattatcacagcagctcagagggaactataagaaccaataatattcgagatggtaaaaagtacttaaaatgaaatgtacagtgtggctttttgtttgtttttactgctccattcctattgcctaaaacagtacctggtttctagtaggctctcaataaataataaatattttgtaaatgaataaaacagggcctaactatattcctcttcatataagttctttgtttgaatgtacaaatggttgacattctagaatactttggtcagtattatggacttagaatatgaaatttctgtatggatataaatttctacaatgactgtattttgaaccaggtttttttcctggcagaagaagttgtcctcaactatcagtaggtttttagaggtatgtattgagtctaaattctagattcctgtttagttattagcaaaataattataagaaattgaagacaagttaaatataaaatagaaagatattgtttgctcttgttccagatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcgtaagttttttacaattatttattttatagataaaagcctgtattttaaaaatttaggcctgttttagaaatgatagctactctgagaactcaaagtagattagcctaaaaggactctctgctttaagttttacaatcatgcttactagtgaaagagatctgtgaaaattttataagtgtggacaataaaaagttaaaacagggctaggtgcagtggctcatgcctgtaatcccagcactttgggaggatgaggtgggcggatcacgaggtcaggagatcgagaccatcctggctaacacggtgaaaccccatctctactaaaaatgcaaaaaattagccgggcatgatggcgcatgcctgtagttccagctactcgggaggctgaggcaggagaatcatttgaacttgggaggcggaggttgcagtgaaccgagatcgcaccactgcacgccagcctgggagacagagtgagactgtctcaaaaaaaaaaaaaaaaaaaaaagttaaaacacagtgtctttcagatgattaaattgagaaagctagattacccctggaataaggttggcaacaacagaagaataacaacagaggctttgcactcctaacatggcaatagcagggagatacagacagctcttagacccatcggagtcatggtagaaccacctaagtgtggcaggcaggaagaaactatagctgacataacagacagtttgtttgtgaacaaattggaatcgtagttccaaggagattacttgatataatagtatatgctcaatacatattaattccctttctttctccctatgaaataggccagagcaaaagaagcactaactagagatcccatccagctaaggaagagtggcttctaagtcacgtggctttcttgtttattatcagaatgaaagtacaggcttatgccttaataattttagtttttaaaaaagagaactgtttaggggaaaaggttaattttcttttctctcaaatactatttgtagtctaggaatgtctgatataaaaattcttttccctataaatttcgatcactacttcatctaacttcacttctaatatatctaatttttttaaaaaaaggttacctgtagatcagtttgaactgaatttgtaatgttttgtcaccttaaaatgctagctactagaggggagagtctttgtcatgggtgtatttattaaaggttttttgaaggctgccagcattctgtaaatatgcagtagctcaggtccttaaagcacttacttagaataatagcaaaatattgtgggcacctcaccattgagaaactatttttcagagcttggtatacttttaaagtttagcatcttatttgccttgctaatctatttaactttatggaaagtatttactgcttctgatcaggattttttgtttgctgtcaaagtaaaagtcactaccagtgtcactatttgctatggaagccacaaaccttgtagtcatttcttaattattttctttcttttatttttccattcccacattcccctctcatccccttttaattcattagcaagtatgctgccagttctgcttagtccgtctctctccctccactggtaaaccctagcccaaaccatcttcatctcttatctgtactaacgcaagagccccttaactggtatccctccttccatttcttgatctactaaaatccatacgccacatagtggctagaataattttttaaacacaaattcaccatgtttctctactaacttggaatgcttaatgtgttcccattgtacctagaataaatccaaacttactttccagggtctgctctccaagctgtacatgacctggcccatagccacctttctaaactcgtcacatccattctcctcattgctcatggtgctgtggacagtctggttcctttctgttcttctccactaccaagctcattcacactgccccttttccaaggcccttccctctttacttacctggcttcttgcaagccaggtcttagctctaaagttacttgctcaaagagaccttttatgactccccagtctaagaatacacctctccatttgttcttctgtgccgtctttctttaatggcacttaatcacttaaactaatttaaattaaataattggttatttaaatcatctttttcatttattctctactttatttgtttgtcttccctgcctgaagggaggagctaactgcattagaggtgttgaaattcaccgttagatgatccctgggctagaattttaaaggatgtggggatttatcaggtagggaatataaaggcaaggaagatgtaggtgtatgtactcattcgtatttaacttgtccagtttattaagtcatttgaattttgtcagaagctagatcacttctagtagtttttaacaaagtaattctcaaaaacccaaactattgatttggtttgcctcccaaatctactgaaggcttaagaagtagattttagtttaggccaatgtttttagtttaagttttccctttattttaagctgaagcagtacactcgtccaggaagtcatgttgtgattttccacttacagttgatagaaaccagagacaggccgggcgcggtggctcacgcctgtaatcccagcactttgggaggccgaggcaggtggatcatgaggtcaggagattgagaccatcctggctaacacggtgaaaccccatctctactaaaaatacaaaaaaaaaattagccgggcgtggtggcagacgcctgtagtcccagctactcgggaggctgaggcaggaaaatcgcttgaacccaggaggcagaggttgcagtgagctgagatcgcgccactgcactccagcctgggcgacagagtgagactccgtctcaaaaaaaaaaaagaaaaaaaagaaaccagagacattggtaggccaggcacggtggctcacgcctgtaatcccagcactttgggaggccggggcagacggatcatgaggtcaggagatcaagaccgtcctggctaacacggtgaaatcctgtctctactaaaaataccaaaaaaaaaaaaaaaaaaaaaaaattagctgggcgtggtggtgggcacctgtagtcccagctacttgggaggctgaggcaggagaatggtgtgaacccaggaggcggagcttgcagtgagccaagttcgagccattgcactccagcctgggtgacaaagccgagagtccgtctcaaaaaaaataaataaaataaaataaaaaaagaaaccagaaacactggttctcatccttggctacacatcagaattatctgcagagctttaaaaaagtacaggtactagggtcccattgcagagcttctaaatcataacccctacccaagttttgtgaagctctgaagtagggagactcttagttactcagtataaaatactctcactatgggcatgattgtttttcatttctagaacatgagaaacattcatgtttaactataagtacaaaacatattaccaagccaaatagccatgatttgttttattaaccctaatgactcagtcccattagcatcaaatcagaattgatggtaacgtattttgttagcagccatatgtgtttgtgtgtttatataacataaaactcacttttctttgaggatcattaaaattttttttttacaatacagagttccataataatatacaactcacttttctttgagggtcattaaaatgtttttgttttttttttttcccattacagagttctttcactgatttttttttcatctgaaaatagaagcagttttctttctttctttccaatatgtatagctttccttttctttctcttgccttgttgcgctggtgataaattagtggcatgatgtcaagcaagaccaggtattttcgtcttattccagatcttagggggaaaaatcattcagtctttcacagttaagcataatgattgctatagaatctttgtacatgctctttatcaggttggggaagttttcactgaattcttttaagagaaattcagatttggatttctaacttagacttttagatgtataattttgttattctaccttatagcactttcattgtctaagtacatttatttcacgtacattacatatttaagattgtgatgttcaagaagatataaatgatgttgttttatttgtactgcttctaacaaagtcatgtgcaatttctaacaaagttatgtgtttttaaggttggtagaaaaaagttttaattaggttttaattcttataaggctggaactgttaggattcaaacatagaattaatagataaatactatagattacataaaaatagtaaataatcatgtttgataattaaatttaaattaaaatataattcttttgatttatctagccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggaaataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtggtaagtgcctgtagtcctagctacttgggaggctgagatgggaggatgtcttgagcccgggaggtggaggttgcaatgagccaagattgtaccactgcattccaacctgggcgacagagccagaccttgtctcaaaaaaaaaaaaaaaaaaagaaaaaagaaagtactgtctgtcttaaattttgctgcaaataaaaatgtactttggattatttattgttgaacttgagagatagaaataacatcagatatattttttcttttttttttataattaattttttttttttttttttttgtagagacagtgtctcactatgttgcccaagctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataatttgactgatccatgcttcttacagtgtggagctttgcaatgatgattttttaaatatgtttttcttgtgataaacaggtattttttaaaatctgctgggtgtggtgactggtacctgtaatcccagcactttgggaggctgaagcgggaggatcacttgagcccgtgagtttgacaccagcctgggcaatatagtgagaccttgtctctacaagaaattaaaaaactagctgagcatcatggtgtgtacctgtagtcccagctactcaggaggctgaggtgggaggatcgcttgagtctaggaggcagaggttgcagtgagccaagattgtgccactgtactccagcctgagtgacagaacaagaccctgtctcaaaaaaaaaaaaaaaaaatccatctcagtaccccaatgcaatcaaaagatttcagagctttaaaatgaatgatgctgggtgcagtgactcctgcctgtaatcccaacactttgggaggctgaggcagggtgattgcttgaggccaggagttcaagatcagcgtgggcaacaaagtgagacccccatctcatatttttaaaattaaaaagtaaaaggaatgataggttcattttagctagaaattgtgataattcctccattgtctcaaatgctcaggatcatgtctgaaagatttgcccaatagcattggaagtggaaaataattcaattgtaatttctcagataattgtatataactagagtatagataggcagaattgaaaattattagttgcttgtcctgttttgacttctgaaacagaagagtgatcacatgaaggtaggagaagggctgggtacggtaggtcacgcctgtaatcccaacactgggaggctgaggctggtggatcatttgagaccagcttggccaacatggtgaaaccccttctctactaaaaattagccaggcgtggtggtgcgtgcctgtaatcccagctactcgggaggctgaggcaggagaattgcaggaggcagagtttgcaatgagccgagatcgcaccactgcattccagcaaaaagtaaaaagaaggtaggagaaggctactgtcactgtattgggtatctttagaggcaggggcccacagcagaaatccttgcagccatccctctttccagaggtgatcagctatttcttccttttcctctctctcctactagtacctcattttctacattgatttgtagtgctattaccagtaatgtaatagaagctgagataccaagggcttgcttggccttggctttttgaaaccctctttatatcttggctgtcctccattaaataaggcacaatgtttacttgtataacccagggactctgagcagtcaaaatccaacacccacccacctccctccccaccccatgctcatgttccctcttgctgcttttctcttactgtggtgcaggcaaacaactagcataaggatagcataaagaaggaggagtaagcaagtagaatctctagatcaaatttccactcccccaatcgtggtttcgtcctgtgattcctgaatgtatatgagggaactagaggtagcagtctacacggaaaagggaagttgggggtcacttgtcttgaagagtgcatgcatagaaattgtaaaattaggctgggcgcggtggctcatgcctgtaatcccagcaatttgggaggccgaggcgggcggatcacaaggtcaggagatcaagaccatcctggctaacacggtgaaaccctgtctctactaaaaaatacaaaaaattagccgggcgtggtggtgggctcctggagtcccagctacttgggaggctgaggcaggagaatggtgtgaacccgggaggcggagcttgccgtgagctgagatcgcaccactgcactccagcctgggccacagagcgagactccgtctcaaaaaaataaataaataaataaaaagaaattgtaaaattagattgtatatttttaagcttttgggaaatgatggagattatggaaaggattgaagttctgcttgaccttgcactacttggcacatttggcccaccatccattcaggacttaccccttgcttcaacccaatatctcaaataggagcacatgggtgtttagctgcttcagttcctcctgggtctgtgacctctgcatcagcagattatctgttcaccttcttcctgtctcctgatatcacaatagatgaaatcataggaactatcctttgtagtttggctcttgtcacaatctgtaccattcattctatgtctttgagacactggggaataggtgcttagctgggcactgcagttatgcaattttgcttgtaaccaactccactgtgccgaaagtgatttagagaatgtagtctgatgtggtctggctctgaaaaacacattttgggtttggggaccttgcttattgatggtctgatttcaagaggcatacccatgtcattctggctctcaggtgcaccccagcaccttgcatctaagccctgtcatttactgttgttcccacagtaccaccatctttcttctcaattctagccctgattagcttcaccaacaccaagatttcaagttacctgataggattgtggtaaagtctaagttttctaatactttaaagaaattactccattgcctcctggcttgcaaagtttctgttgagagttctgctgtaattctaaattttgttcatctatatgtaatttttttttcttgctgccttctagatatcgtttttttttaattttcagcagttaaactatgatgtgcctttttttttttgatacagggtcgactctgttgcccaggctggagtgcagtggtgtgacctcagctctctgcaacctctgcctcctgggctcaagcaatcctcccaccttagcctcctaagtacctatcattacatgcatgtgccaccatacccagctttttttcttttcgtttcttttcttcttcttttttttttttttttttttttttagtagagatgaggtttccccatgttgccaggctggtctggaacaactgtgatcaaacaatcctctcgccttggcctcccaaagtgctgggattgcaagcgtgaaccaccgtgcccagcctctgggtgtgtttttctttgtatttcttttgcttgagattctccaaacctcttggatctgtttgttgtttttttattaattttagagaatcctcaactattatatgatcaaatattcctctgagactgcaattagatttatgttaggccatttgatagtgtctcatggctctgttggatgtgctgttttcttttatacactctatttttctttgtgtttcaatttggattatttctgttaacctatttcaggcttactgattctctcttgtgctgtgtttagtccaccaataagcctgttgaagagattctttatctcttaatatcatatttttatttctatcatttttatttaactcttttttttacagtttccatctctctgctgaaattcccaatctatttatacatggtgtccatccattccactaggtcctttagcattttaatcatagttgttttaaagtttctatctgataatatcaatatctgggtcatctctggatctggttctgttgactacttttatctcttgataatggatcttttttttcttactttttattttttttgagacggagtctcgctctgtcacccaggctggagtgcagtggcacgatctcggctcactgcaagctccgcctcccaggttcacgccattttcctgcctcagcctcccgagtagctgggactacaggtgcccgccaccacgcccagctaattttttgtatttttagtagagacggggtttcaccatgttagccaggatggtctcgatctcctgaccttgtgatctgccgcctcggcctcccaaagtcttactttttaaaatgtcttataattgttgattaaatgtcagatgttgcatgttaaagaacagtagaaactgaggtaaatagtatttatatctggaaatgggcacagctgtctttctattaggccattagtgttgggggagaggcaaataactctaataaatagttgatttgggtttgagtttgttgctgctatagttactttcagtatatcacagatttcaaattcttcagtggtggactgctgctgctgtgggcttagtgtgtggcctagagtgccagagtttttctcagtgttcctgctccaccctcagcttttagcagactctgcacacttgtaccaccgatgatatctctttctctctgctcctgcccctcctcagctgtagaaagctattgcttactactttgtgcaaggctttatggttggggcaagaggcggttctcctcctccagcctcagtctcatgcaagccatgggggtgtgagcttcagggctgggtcccctttctccgtggcactcagaccttgttttgtaattgtggggtcttaggtgagagtgagtttcctgtccctctctcattggcggcaaacctctgctttgtatcagtgcaggatcatggtcacaagtgtgagtttccttgccccgtccaacggcagatggtttttgcttcaactcctccctgcctacagccaactttgttggctgacaccaggggataggaggttttgtatcactcccctggtggcagatggctttttctttatgtaagagaaggacctgggtttcatgtctctctcacagtggtagctggttgtcacctgcatgcctgtgtcaccaaaaggagtctctttcagttctcctgctctgtccccagtttttcttacgaatacccagtggaggctatgaaaaagagccagtaatttgggctaaactctccttgtatctgtggctcccaggaattctaagctatcacactagcccacacttagtctttaagcatttgttaaaatttcggttttcttctctttttttttttttttttaatttgctgctatctttcatcctgtactctgcgcaaggcaaagtagtttgtgaaagcaacgcttcttggctttctctatcataagtggaactggaacttattgattgctttttttgttgtcaagttttacttgacagaaaattgctctgaaatgtgtttaataggtttgaagagctaaaacaagaaacaagattaataattatggaaaccgtaaaaagaacaaaatctcaaacaaaaacaaatagcagctgaaattgagaactaaatggaaaggttttatagcaaataagatatagttgaagacataattaagaatacattagaagaacatttccagaaggaaacatggagtgaaaaaaggtcataagtacagacaagggggataagagatataggggatacaatgagaagatttaatataaatgtatttagagtccctgaaaagcagagaacagagaaaatgtgagagaagcaacttttttttttttttttttttgagacagagtcttgctctgtggcccaggctggagtgcaatagcgtgatctcacctcactgcaacctctgcctcctaggttcaagagattctcctgcctcagcctcccgagcagctgggattacaggcatctaccaccacgcctggctaatttttgtatttttagtagagacggggtttcatcatgttggccaggctgatcttgaactcctgacctcaggtgatccacctgcctctgtctcccaaagtgctgggattacaggcatgagccactgtgcccagcctagaagcaacttttgaaaagataatagctgaggactttcaaaactggtgaaaagcattgtcacagattaaaaaacccaagcagaatttaaaatacacaaaaaacccaggcacattcatagtaattgataaccaaagataaaatcttataaaatagctagagaaaaaaagacatcaccatcaaaagagcaaccactagacttactgctggattctccagagaaataatgaaacccagaagacaaatggaatattttcaaagtgctgaaagaaggtaattgattggtcaggtgtggtggctcatgcctataatcccagcactttgggaggccaaggcaggtggatcacttgagatcaggagttcgagaccagcctggccaacatggcgaaaccccatctctactaacaatacaaaaattagtcgggtgtggtagtgcatgcctgtaatcccagctactcaggaggctgaggcaggagaattgcttgaacccagaaggcaaatgttgcagtgggctgagattgcaccactgcactccagcctgggtgacagagcgagagtccgcttgaaaaaaaaaaaaaagagggtaaccaattgtctagaattgcatgcctagcaaaaatggtcttcaaaattaaaagggaaataaaggcatttcaggacaaaaagaatttatcacaagtaggactgcattaaaaaaatgctaaagacatcttcaggtggaagtaaaataaacccagctggggctgggcgcggtggctcacgcctgtaatcccagcactttgggaggccgaggcgggcggatcatgaggtcaggagatcgagaccatcctgactaacggtgaaaccccgtctctgctaaaaatacaaaaaatgagccaggcgtggtggcgggcgcctgtggttcccagctactcgggaggctgaggcaggagaatggtgcaaacccgggaggtggagcttgcagtgagcggagatcgagccattgcactccagcctgggagacagagcgagactctgtctcagaaaaataaataaataaataaataaacccagttggaaactcacaggggcaagaacaggaaattagtgtagagggtaactatatggataaatctaaataaatactggctgtatacaatgatgtgatgtggagttaacatatatatatatagacacacacacacacacatacagagagagagaataaaatgcacaagtgacataaaagtcaagaggtgatttgtattagggttctccaggaaaaacagaaccaagaggagagagagctatatggtatataagccatattatatatgataatatataagccacttttaatttaattttattttttgagacagagtctcactctatcgcccaggctggagtgcagtggcgcaatctcggctcactgcaacctccatctcccaggttcaagcaattctcctgcctcagcctcccaagtagctgggattacaggcacatgccaccatgcccagctaacttttgtatttttagtagagatggggtttcaccatgttggccaggctggtcttgaactcctgacctcaggtaatctgcctgcctcagcctcccaaagtgctgggattacaggcgtgacccaccatgcctggccataagccactatttaataattaatatgtatgtcataggagatagatattttatatatatgttttatgtttaatatatgtcataggaaatacataatctacatatataacattctatatgaaacataatctacatgttatatgatctatatattatgtattctctatgtattatatgtctcctataacatatattatatatatttagcatataaatgtctcctatgacatacatacatactgtaagaaattggcttatgtgattatggcacctgagacatcccaagatgtgcatttggcaagctgcagccctgggaaagctgtcgatgtggttccaatatgagggcaggagactaatgccccagctcagaagtcaggcaggaaaagtttcatcttatcagcctttttattttattcaggtattcaattaattcgatgaggtccaccaacattggggaggacaatctgctttattcagtctactgattctaatgctaagctcattcagaaataccctcacaaacacacccagaataatgtttgatcaaatgtctgggcaccctgtggcccagtcaaattgacacataaaattaatcatcacaatattcttggagttaaaatgttttagggttgttgcattatttgggaataagataaaaattcaagtaacattggagattaggattaatgttgaaaccttcaaggtaactgctaaaagaaagtaaaagagggtgtaactatcaaaccaatggaggaagggggaaatatcaatataacagaaatcaagaaaagagggaaacaggaacacaggacaggacaaatagtaacatgatatattaaactcaaatatcagtaagtagattaaatagaagagggaaagaagggagggagggaagagggagggagggaggaagggaaggaagtcccaattaattttacaaagtcagcatcatcttgatatcaaacctgatgaacatagcacaaaaatgaactaaaaaactcactaaaaaatattgagagcgaaaacaaaacaaaaatattgagagtggcaggaggcagccaaacgcctaggcaaacagggatgggtccctggtgaaaccccatcttcaagcctaaaagcctgaaacctgcagcccaaagtgagaacttctattcctgtttgctcactctctcttgattggttctttctgaataatgtctttttaccaatccagtgttgtcttttccaaaactacgtgtggcccaccacactccacccacccccatcctgtgcctataaagatcccagactcagtcagtagaaaggagagatggctggactttggggaagagatggccagattttggggaagactatctgcttttcccatcccctctccagctcccctctaggctaagagccatttccactgctcaattaagttctctaccctcaccatccttcaagtgtccacacaacttcattcttcttggatgctggatggacaagagctcaggacccactgagtgtggggacccaaaaaggctatcacaccggccctttgcccttgctgttagagggcagccaccccacgtgatgagacaaggggccagctgagctgttaacacatagccatctgcagatggcagcgctaagagagcactgtaacactccccctggggttttggggtcatgggcaccctcatctcggtgatgccatgggccctgcacagagcttgctcccgccagtgcccaaagtggccagccagatcctgcactcactcgctcactcctgatctggccatgagccccacatggagcctgctcctgccagtgactagaacagctggcgagatcccacactcacttgctcatggctggtttggccatgggccccacatggagcttgcttctgctggtgcccggagcggccggctggatcctgcactcactcgctcacaggctcccacccacaaggggttgaatgtggtgggccgagcaagtgttccctccggttgggagtccagtgaaggggccaagaaaaatcctgcatcaatctgaagacaaaatgtcacatatagtatttgtggacttaacagtatgccaaaagaatagtacactttgaacaaattagagattatcctaggaatttaagttactaagagatcagtgtaactgaggcgacctttagttgtatagccatcaggagttacttgtccttttaacaactatgaatctcattggagccctgagtctgcacaactgggattgtccttgcagatacttagaagttgtacaagtctgccctggctatcccttcacctgagctactatttcgagacagctgtctactctgaaggttacctcttgctgtaactgtatttccaggatgctactgcagaaattataaagaaaatgactcagatttgtttgtgttaaaaaaaatcaactagaagtaatatgcagcatatatgacaattcaaagatcttaatgtgtaaagtgttctaaatgcaataatgaaaatgaattttaatttataaaattaaatttaaaataaaattatttagaggtaaataaatatagaaaaataaagtagggcatggtggctcatgcctgtaatcccagcatttgggaggctgaggcgggaggattgcttgagttcaggagttcaaaaccagcctgggtaacctggtaaaaccccatctctacaaaaaataaataaaaaaataaattagctgggcatggtagcgtgtgcctctagtcctaactacttgggaggctaaggtgggaggattgcttgagcccaagaggtcaaggctgaaatgagccaagatcatgccactgcactccagcctaggagacagagcgagaccttgtctcaaaaaaaatcagcaaaggaaaaggtacagagaattctaaaacaaagttaggcagcaaagatatgaataggtgttcatatctacccactaaagaaacacaaattatagctacatggtgatactatattccatctaatggactggcagatattgaaaaggaatgataatgtctggtattggcatgagaacaatgaatttatataatatatggtgtgagtgcaaatggatacaaactttctaaagggacattttcttaattatttaggcttaattcctggaagcagaattgactgtcaaacagattgcatcaaggtatttgctgctttgaagttgggttgaagggtacattcagactcagatccaattccacttcttccatgacatcttacatgattttcttctgctcctgactcttcatatttcttaaagaaacaatttgccataaaggaaaaggcaaggactttgaaatcagacctggggctttccccctacttgggtaagcgatttggttctctgagccttggtttctacacctgtgaaatgggagttcataatacttgcctcaaaaaaaaaaatttgcacaaattaagtatacaaaaagcctacagcacaatacccaacctggagtatttcatgctgctcagtaagtacttgtccatctgtttccttatgggctacactgcacaaattggctatgtaatttggcacttgtttatgtacccgctcatgctgttaccagcttctttattgttctttattgtgtgtgattgttattcctcctctccagactacattgtaatctcttccaattcaaggactctatctcctttgtcctttgtacccatagttcaatgaatggtttttgaagttagagtagcagttgtttgagaaaagataaaatacattcctgaactacactgtatgatgttagaaggtgtctttgtagcaggtctacagaaaagaatgtttgagaccttgaagaaaagtccttcagctgcccataaaaagtataaatggtagaaacataactatttagtggaaagtgagaagcactgctttgccactcatgaacccctcgtgttaaagcactgaagattccaggctggagccagtgctgagtatcatgaattactgcccttaaaactagcatctcaagtcatatataataccttttctgggcaagagtcccatctccttaatctctgctaaatgagtgtttattagatctggctgttgaaaaataccaagttaaatcagacagttaaaaaaaatcaacatgatgcccataactggtttaatttatcttccctcttcagtaatcccacacattacctacttatttgctgtaatgaacatgccattcagctaaaataagattaactgcttaaaccatggcattacaggcagagaactttaatgccgctttgtgtttcattgtaagggttcagcagttaaacgatatgctgttgtcgtttcttccattgtaatcaagacggtttcacttaggattagtgctccccagctgattctcctgatggaacatttgaagcagcaaatttatatgtctaagttacagcctggcagcaataacaaccttctgaatcaaacctgttggcctcatcagcactcaaattgcactgctctttgtgaagccccatctgctctaatggtgatggaaatctcgcctgccatgcagaccagggatggaaaattgaaaggggacttgggcatgcatctggaaaatagcactgtgatgccccaggtgggatcaggattcagaaaattaacccacattcccccacgtgaatgagcatttgcctgttctctgcatcaaagtcaaatcccacttcttcaatggtgctttctggactgttccagccccactcatctctcttttctttgaactcattataattatacatcttcctacattacttaaggccaattatttattgatttatgcaaatcatgtcattatttcctccgaggtaacactgtctcttcacttagactgcaagctcttataagtcagggactaataaataactgcgtggtcctgggcctataggaagggcccataggaagctccttgactgagggaaataccctctgtgcactgtgaccaatattaagattctgcctggatagtccagagtggggaagcagcttcagctgagtgtgcttgaacccctctcgtgatcctcccttctctttcatggagtatattttactcctgtggctcatcacatctggcaccacaaagagagtcaatatgatgacccacagatgtgtccatccatttgttcagttatccactcagtaaatatttatcgctgggccttatgcctacaatcctagcactttgggaggtggaaggatcacttgagcccagaaattagagaccagcctaggcaacagagcaagaccctacctctaccaaaaaacaaacaaacaaaaaaatagccaggtgtggtggtgcacatctggagtcccagctactctggaggctgagatgggaggatcacttgagcccaggaatttgagattgcaatgagttatgatcacaccactgcactccagcttgggtgacagagcgaggtgcttaataattagtaatttattttaatttaactttaattttttttgagacagagtctcgctctgtcaccctctgtcacgctctgtcacgctctgtcacaggctgcagtgcagtggcgcgatctcggctcactgcaagctccacctcccaggttcacacgattctcctgcctcagcctcctgtgtagctgggactacaggcgcccgccaccacgcctggctaattttttttgtatttttagtagagacggggtttcactgtgttggtcgggatggtcttgatctcctgacctcgtgatccatctgccttggcctcccaaagtgctgggattacaggcatgagccactgtgcccggcctttaatttaactttaaattaatgtttaaattaataatttaaaattaaattattatttaccaagaacctactgtgtggcaggtcttgtttctcaggaatctgagaactgagaaactctttggtggtattttggcagaaatggcagaaagtttgaaagagctagaagaaaacccatttcttcttatacactacccttcaaacccaactttggagcagaagcaaacttctgcagaacttccttttcctgtgtgtttattcaccactcctccccatactcttctctcctcctgcttaaattgccttgaggatgaagcttctccttccctgccttcctggctgtgataatagcaggctattgaattttccggtgtgaaattggtttgctcaggtcgccactaggcaggctgcacttgctaggttggatgggttccaggtatgctgctgtgggtggggtttaggttgagtcaggactccttcattgggtgggaaaagggtgaggagggaaggaggaaattaggttggttttaccttctctgcctaggggattacattaactatttagcaaaacaaggagaccttccttggttccctctctcattgaccacgtcttaacccttccaggataaagccagagcctcagatgcctgtggtttgatctgagcttgggtctgggggcactggagcagctgccctccaagccagacctcctgggaactcttctgggaaactgtcttcacagctatgaatccaatagtgatgatccctaatcctttgcttccttcatgttcctgctaaaaatagggatacactggaataatagacggttgaaagggaatattaatcatcttttattccaggtctccttatttctcaagtgtaggaattacaacttagtcacactagcttatgcaagcagatggcacatttgtggcagagccaggactgtacgcaggtcctgactcccaggctggagctgtctcatatgccatggcgtttctcataattcccttctccatcactctgttcccaggcttcctctactgcttctcagtctattccttttcccttggctggctacacttactgtttcttttcctcttagaatttcaaaagcagaaactactagcataagaaggaaaataaagaatgaaaatgagcaaaactagtttccccaaaattctccgaaacacctttgatttatcaatagtttgctaataaaacttccttagatcgtatctgcttaaacattcattccattgaatttactgtggactcatggaagtttcttaagcctgtttctaataggaagagcatgttactttttcttttttagatggagttttgctctgtcacccaggctggagtgcagtggcacaatcttggctcactgcaacctctgcctcccaggctcaagcaattcttccggctcaacctcccaagtagctgggattacaggcatatgccaccatgcccggctactttttgtatttttagtagagacggggtttctccatgttggccaagctggtctcaaactcctgacctcaggtgatccgcctgcctcagcctcccaaagtgctgaggttacaggtgtgacccactgtgcccagcccccgctttttttttttttttttaaagttcagacttgttttgattacaagtgacagaaacccaactcaaaactcaaactagcttaagcataaaaggagatttactggatcacataactgggaagtccagaaattgatctcgcttctagtttgaccagactcaagaacttgaaggaagtcaccatcttcactctccacccacttgtctatgttgtctttgttcttgttgtggggaaaaaaaagaggctgcagcatccccattcacatatttctgaaagtaaggccccttctccttcagctccaaatggaaaagtcaccaaaaaaggcattgattggcctagattgaggcacatggccaccaatatatcaatcacactgcccaagagaatgaggcactatcatgggctgggtttgagatactattcttggttgcacctaccactaccacacacacaccccactgtggtcagagggacagagtcctgcaattggcaggctcatcaaaatcatgtagagtagcagaagagcagttcctcacaaaaggaaattcagaaaagacaacattggcagattcctacttgaaacatccttccactgtgtcccccgaagacaattggtttttggttcctttggagtagatgtctatctggagccttcccattgaccttgtgtatctcacctgtcatcaccactgacagggaccatggcagtatctgctcactggtgtcatctccattctctccctttcccatatatttaatactctaccaggttaatattcttagactacatatctgatcttctgtgctcatctactcgaaaatctttaattaaatctgtaagattttaaatatcacataaatccagtcctgtgatttatggaggttgccacaaggcaacagaatggtcttgtcaggcaactgccatggctactagctaaatccatgccctgtggcatgaggcacccaaagtctggctccaggaagccatcatttcccttaggactgaaggagcaaggggagagaaaagtggtattagagcctggtgacatgggccacctgatgggagtgataggtgcggagcatgacagctaccaacagacacagctcctaagcaaaggcatagataataaagcctgacccctctctcctcttgccctctgatctgaaggggttggttcagtctccttgggcacagagcagggcaaggaaggatgaaaaatgaatccaggaggcaagtagagaaattataacctgcgcagttgtctcagagctacacaacagctctgtaattcagccactgctctaacttgtacagcaaatggaaccatgcagtggctcatgcctgtaatccctgcactttgggaggccgaggcaggtggatcacttgaggtcaggcgttcaaggccaacctggccatggtgaaatgctgtctctactaaaaatacaaaaattagccaggcatggtgctgcacacctgtaatcccagctactcaggaggctgaggcaggagaatcacttgaacccaggaggcggaggttgcagtgagccaagttcatgccactgcactccaactggagtgacagagccagactctgtctaaacaaacaaacaaacaaacaaaactagcaggcatggtgacatatgccaactactcaggaggctgaggtgagaggatcagttgagcccaggagtttgacgcttcagtgagctatgattgcaccactgcactgcagccttggccatagagtgcgactctgtctctaaaaaaaagaaaaagaaaatgattctctgaagaatctctcttgaggaaaaacccctagtggagtgggggcagctctcagagctcaggaccacccactttcttactgtgctttgagagggcagcccagaatcttcagcactgcatgggcagctcgtcttggagtctcactgtgcgcctttcctccgtgtcacctctctagctatcctccaggacagcctcagcccttattgctgtattccttcatgctacagggaggagaagcacctgtcagagtataaaagtgagcagatgatagtcaaataagagttgcttcaattactaagatgtatttcatttttttgtttgttttgttttgttctttgtttgtttgtttgttttttgagacacagtcttgctctgtcacccaggctggagtgcagtggcgcaatctcggctcactgcaacctctgcctcccgggttcaaacaattctcctgcctcagcttcctgagtagctgggattacaggcgcccgcctccacgcctggctaatttttgtatttttagtagagacggggtttcgccattttggctagggtggtctcgagctcctgacctcaggaaatccacccgcttcagcctcccaaagtgctgggattacaggcatgagccaccgcgcctgaccaagatgtatttcttacttgggcctacttgggcctagtgtggttgtttttatttttattttttaaattattttccttttctttcttagataagtgataacttattaacttgcattcctttgactacaagtgaagttgaaaatgtcttacatttattagacatttttcttttctttttttatttttattttttatttttatttttatttccagggtacatgtgcaggatgtgcaggttttgttacatagggaaatgtatgccatggtggcttgctgcaccggtcaacccatcacccaggtattaagcccagcatcctttagctatttttccttatactccccctccccatgtcccaccccccgacaggcctcactgtgtgatgttcccctccctgtgtccatgtgttattgttcagctcccacttttaagtgagtacatgtggtgtttggttttctcttcctgtgttagtttgctgaggatgatggcaggtggtttattttttgaaaatccataaataaggctgggcacagtggctcacgcctgtaatcccagcactttgggaggctgaggtgggaggatcactgagactaggagttcaagaccagcctgggaaacatggcaaaaccctgtctatataaaaaattagccaggcatggtggcacgctcctgtaattccagctactcaggaggctgaggtgggaggatcttgagcccaggaggtcaaggctgcactgagccaagatcatgccactgcactctagcctggatgacagaaaccctcactcaaaaaaaaagaatctataaatattataccaataggaataaaaaatttagtttcaaactcttgtagacacctgttttctttttttttttcttgagatggattctccctttgtcgcccaggcaggagtgtcgtggcacaatcttggctcactgcaacctctgccttccaggttcatgagattctcctgcctcggcctcccaagtagctgggattaccggcgtcaccaccacacctagctaatttttgtaaatttttttttttaggacacctcttaaaagacaaacgatgatgggccaaggcccatgccactggtatcagttgtgtgtgtgtcacatttttcacaaatctccatagaaaggaaggaagagagaaagcctgcagggaatttgtaagaaaatattttgagtgaaacaaagggtaaataaactgacaatctactgtcttttcctaaggaggaagaaatttcaacatttgtggattcctctcagggaatatgttgcactcattaagtatgaaaaaaatgtcttattgcaaggaaaaggaaaaagtaaattctgatcatataagcgtctaggaagcatgggtgatgctgctgacctacagtgcaatctcgttttaatgaaaaaaagtctgaaaaaaactctggcagcctacacagcccaaatcaaggctttcataagcagatatttccacctttggggccagtagaaaatcaaatcaaatccttgggcaaattataaaacaatactcttaggaaatattaaaataatgagtcattctacttttcaaatatatggtagtaaaatcacattatttctctgttttgtggtagttttatttaagtgtattttttaaagttatattttcgtaaaattgtttttctaacttcatggtcttttggaaagcagttttgttatatttttctgtttgtgatggtcactgagggactattttacacataaaaaaaggaataataaaagtcctggcttcaacaggcaaaaagacaaaacctactttgtaagaaaaacttacttccttcttatttaaaaatacatatttggccaggcatggtggcttacgcctgtaatcccagaactttgagaggctgaggcaggtggattgcttgagctcaggagttcaaggccagcctgggcaacatagcgaaaccccatctctacaaaaaatacaaaaatcagccaggcatggtggcatgcacctgtaatctcagctacttgggaggcgaaggtgggaggatggcttgagcccaggagattgaggctgcagtgagccatgatcataccactgcactccagcctaggtgacagagcaagaccctgtctccaaaacaaacaaacaaataaaaaataaataaataaataaataaataaataaataaaaatttaaaaatctatctatctatctgtatacgtatatatatctagatatattgggtctttaaactttcattttggcttttgccatgccatacacaaagaaaatgaagacctctgaagagaaaggtgttgacacttatgggtgctgacacttaagagaaaggtgttgacactttttttatgggtgttgacactgaagagaaaggtgttgacactttctgcagcaaaaaagtatataagaggaaggtagaattactcaataagtcagtatttcccaaaaaaagactctgcagaattctagtcttaagagatcacacatacacacacacacaaagacacacacacaggcatattatctttgcgattcataatgtatatatgtacattaacattaggccgggcatagtggctcacgcctgtaatcccagcactttgggaggctgaggcaggcggatcacgaggtcaagagattgagaccatcctggccaacatggcgaaaccccatctctactaaaaataaaaaaattagctgggtgtggtggcacgcctgtagtcccagcttctcaggaggctgaggcaggagaatcgcttgaacccgggaggtggaggttgcagtgaactgagatggcgccattgcactccagcctggcgacaaagcaaggctccatctaaaaatatatatttttaatattatatataaaaaaggctctgataattacaataaagaaatcaggttaacattggttttgcccaccctttttttcttccacaaaactctattaagatattaaggaaaaattaaaaacatgctttgaggaatgtggccttgaactgaagtttccttaacttcagtgtaacgcattataaagatgtatgttgtcaacttgttttgaaatgtttaagccatcctggaaggagtctgatttctagaaaggtttcatggagatcaaatctcatctggaagccaatgacctgtcaaatgtcacaaagccagcaccagcaagagcgacaccgagctcccacgctttgtttcgagcctaggaaacctttcacttccctgttgataccccaagttcctgaccttttctgcccaaactttccccttatctcttacattgtcctcacaaaagtctctcacaggagaaaacagaatcacagcatattcaatactcctctggtgttagctcttctgttttgattcatatttatcccttaaattctatctcctttcagcctctccagaaataatccaaccagattcagtttatcctgaagtcctggtgctggattgtgtccactcattcattcttgaagaaatatcactggtcccctaagacaaggcaggccatgtgccaggcactggggctgcagcagagactctgacggaagcagacctgaccttgcagaggttgagatctaatgccataccagtaataccaatggtggggtcttgggcccagaacaggacgaaggcagatcctgggtgagaaaccagggattactcagtaacaatcagtgagaatggaacttaattgtacataggcaattacattttatataaaactttaaaatgcatatcctttttttttttttttgagatgaactctcactgttttgcccaggcaagagtgcagtggtgcgatctccgctcactgcaaccttcacctcccaggttcaagcgattctcatgcctcagcctcctgagtagctgggattacaggtgccttccaccatgcccagctaatttttgtgttttcttgtagagacggggtttcaccatgccactcaggctggtcttgaactcctagactcaaacgatccacctgccttgacctcccaaagtgctggaattgcaggcgtgagccaccatgcccagacttgcatatcctttttaatggagtggttattgtttcttttgccattttaataaataattataattttacatgaaaagcaaagttgcttttataaaagcatgaggatttcctctagattaactgattttgtagataatataaaccaagttttcttgatggcttcatagtctaacttcagtataataagtggagatcaataagaagctttttcaagctggtgtaacttgaaacatttcaaatgccaagcgagtggtaggtatttagatggaaagagacaagaatttgttatgaggaacatttttgggtataaattcttttggtctaaggactgttgttttttcaaggggctcctcttgtttgggagaaacagctggccttggataactttggagaagagcaaggcttctaagaatcagagctcaggaaacctggctcctgcctctttctctttcttgctctgtgtgaatattcaattccagcaattccagcttcttcttcttcctgtcactgattttcagatgaattgggctcctttcccagggacagagtctggcagctttttggaagcatcagctatttcctccctcaagggcggcgagcttgggaactaggggtgagggctgctctgggagggattgcagggtgaggcagatctcacccagcctttcggatcaaagtatagtcaggagcaactgaggggaaattttccactaaacctcaggttcgtagcaccggaacaaatcttagggaaaaaggcaggtggggaatgtagactggaggaggtagaggaagaaatgtctcaggctttcttccagagtctgtgcccatctctataacgatgtggtcattatgccctggtagccttctccataggcagttctccaagcccatttttgaatccctgatttaaaaatgacaacccaactgcctgccaatccaccactctagtttcaccttttttgatccttgagagctttcttcttaaaaatgcacatattccccaggaggagttataggttagtttaggagttacagctcataacatcacatgtctaaaaccaaattcctgattttccatctcactaaacaggtagcaatacccatccagttgctcaaactgaaacatgccctttctcctacatgccttatgctgtctatcaccccttcttgttagtttttccttcaatatacatctctcttttttttttttttttttttgagacaaggtcttcccctgttgcccaggctggcatgattatggctcactgcagcctcaagtgatcctccttcctcagcctcccaagtagctgggaccacaggtgcacaccaccacacccagctagtttttaaattttttgtggagatggggtctcactatgttgcccaggctggtctcagactcctgagctcaagtggtccaccggcgtcagcctcccaaagtgctgggattacaggcgtgagccactgctcccagcctctgtaaatatatttctaagaataagctggcctgaaatgaatccaaatcggtttagacggtaaaagattagacttcgtttaggaccaagaaacttttccaaacttcacctatcaaagtaccttcagggcaaccatctgttgttgaaatcccagctgatgcacactgcaaaaggtttaagagaagattctggatgaattaaacaatggggatccttttgaattaaggttattgggagcagcccaggcagacacacacaaaaaaatcctttttaacctttttgaactttagggccaaattgtcaccttcatatctagaagactttggggctggcgttgcagtgtctaaatgatccgtccttccatttcttatccttattcctccagctccttgcctttctccaatttagtgcttatttgaacttcaccagccaggacacagaagaaaagataaaaagctcaaaaagttgattccacttttccaaggaagttaacagggagcaggttgactttacagtacaatattgaggatccttgttcttcaaagctttctttgtttttcttagattctgtctcttcttgcctccctcatctttcattatatttcttttttttttaattaaaaaaatgttaaaacagcaatgagaccgggtctcactatgttgtgctggctagtctccgactcctgagctcaagggatccgcccgtctcagcctcccaaagtgctgggattacaggtttgagccactgcacctggcctgtgtttcctttatcctctctcagaatcagctccttgatttctagaatcacagactcttaaagctagaagagaccgaaggaactcttctgtatatggcttaatagctcctgggggaaaccaagcctcaaagagatgaaatgatttcgcatgacacctagaaaccaagtcttttgactcatggccctcaattctttctactatgtcacactgccttgcttctctaaaataacagtaaaatgaaagaaaactccaggcactgaagaaaaaattttctttttctttttcttttttttttttttttttttttgagacaagttctcactctgtcgcccaggctggaatgcagtggcatgatctcagctcactacaacctccacctcccaggctaaagacatcctcccacctcagcctcccgagtagctggggccgcaggcatatgccaccacgcctggctaattttgttttgtattttttatagatatggggttttgctatgttgcccaggctggtcttgaactcctgagcttaagccatctacccgccttgggctcccaaagttctgggattacaggcgtgagccactgtggctggctgaatttttttttcttttgttggaaaaaaataatagcagtatcacacatgcatttttgctttcagaatatgtttcttgagttaaagagcaaaactcatgtaagatagaataaaaaagaaatcccaattaaagtaggaaataaaaatgcttttaatatgagtttaatcattagatttctgattggttcctccagttagctagtcagtggcccagtatttctcaggtacaaagatctgataacatcctaatcagctccatggagcaatagggaccctcagctctggatgaattcgggaggcttagaacttttctgcatgccttgctcatttctttactttctttttatggatttggttaattactttccttctgcattctcaggtgtttgaaaggtatccatccaagtgtctctttactgtggtgtaccataaaaaagttgagacaaaaatattgatacaatttggctgtgtccccaccaaatctcaacttgaattgttatttcccagaattcccacgtattatgggagggacccagggggaggtaattgaatcatgggggctggtctttcctgtgctattcttgtgacagtgaataagtctcattagatctgatgggtgtatcaggtgtttctgcttttgcttcttccttatttttatcttgccgccgccatgtaaaaagtgcctttcgcctcctgccatgattctgaggcctccccagccacgtggtattgtaagtctagtgaagcctctttttcttcccagtcttgggtatgtcttagcagcatgagagcagactaatatagtaaattgtaccaggagtggggcattgatgaaaagatacccgaaaatgtggaagcaactttggaactgggtaacaggcagaaattggaacagtttgaagggctcagaagaagacaggaaaatgtgggaatgtttggaacttcctagagacttgttgagtggctttgcccaaaatgctgatagcgatatggacaataaaatccaggctaaagtggtctcagatggagatgaggaacttgttgggaactggagcaaaggtgactcttgttgtgttttaacagagagactggtagcattttgcccctgtcctagagatttgtggaactttgaacctgagagagatgatttatgatatctggtggaagaaatttctaagcagcaaagcactcaagaagtgacttgggtactgttaaaggcactcagttttaaaagggaaatagagcataaaggttcagaaaatgtgcggcctgactatgtgatagaaaataaaaacccattttctggggagaaattcaaactggctgcagaaatttgcatcagtagcaaggagcctaattttaatccccaagaccgtagggaaaatgtctccagctcatgttagagaccttcatggcagcccctctcatcacaggcccagaggcacaggaggaaaaagcggttttgtgggccgggaccagggtccccatgctgtgtggagcctagggagttggtgccctgtgtcccagccactccagctgtggctgaaaggggccaacatatagctcaggctgtggcttcagagggtagaagccccaaaccttggtagcttccacatggtgttgagcctgctgtgcacagaagtcaagaattgaggtttggggacctctgcctagatttcagaagatgtatggatttcagaagaagatagaagcaaaagtttgctgcagggggccctcatggaaaacctctgctagggcagtgtgaaagggaaatgtggggttggagtttccacacagagtccctagtggggtgctgcctagtggagctgtgagaagagggccactgtcctccagatcccagaatggtagatccaccaacagcttgcaccatgcacctggaaaaggtgcagacactcaacaccaccccatgaaagcagccaggagggggcctgtaccctgcaaaaccactggggtggggatgcccaagaccatgataacccacctcttacatcagcatcacctggatatgagacctggagtcaaaggagatcattttggagctttaaaatttgactgccccgctgtattttggacttacacaagccctgtaacctccttgttttggccaatttctctcatttggaatgggtatatttacccaatacctgtacctccattgtatctagaaagtaactagctcgcttttgattttacagactcatagacagaagggacttgccttgtctcagataagactttggactgtggacttttggattaatgctgaaattagttaagactttggggactattgggaaggcatggttggttttgaaatgtgaggacatgaaatttggaggggccaggggtggaatgatatggtttggctgtgtccccaccaaatctcaacttgaattgtatttcccagaattcccatgtgttgtgggagggacccgcagggaggtaattgaatcatgggggctggtctttcccatgttattcttgtgatagtgaataagtctcacgagatctgatgggtttatcaggggtttctgcttttgcttcttcctcatttttctcttgccgccaccatgtaagaagtgcctttcacctcttgccatgattctaaggcctccctggccatgtggaattgtaagtccataaacctctttttcttcccagtttgggtatgtctttatcagcagcatgaaaacagactaatacaaatatcaaagagattactcttgaaaaactgttcccagggaggcatgcttcccattcagtccttaagaataggttgaaaacacagggccttgttcattaggatagacaaaaactgacttaaaagtaatagcttatagtataatttgagagcaacgaattttttttttacttgtgcagttgatgagtaatttttcatcacttggatgaagaacaggtttacatttgtcatggtccaggttgcccttttggtaccctgcagaagaaacagagtgtgcacacacagaaagtaaccaccgaacattttgtgagagaaccctgagaatcttgtggtcagcctgaacctttcactttgtttagcctgcttggcccttgtgaactgacactgcctgcttctcccaggctcgtgtcttaatgctctcccctcactccacgctccagccagctgtcttccactctgttccttgcattccgcccactgttcactgcttcaaggcctggacctttcccttctctctctgactgcctccttctcctccagtggaagctttctgaggcactctatctgcaggaggctccacctttatccactcagtctccagctcatcaacctatttgtctcccttatagcacctaccatgacctgaaatcattgagtttatttttttattgatgcataatatttgtacatatgtatgaagtacatgtgatattttgttacgtacatagaatgtgtaatgatcaagtcagagtatttatccattgcctaaagcatttatcatttctatgtgtcaggaatatttcaagtctctcttacagctatcttaaaatatacaatatgttgttgctaactatagtcaccctattctgctattgaacatttaagaaagtattcctacttataccggtatgtttgtacccattaaccaacctctcttcatccccctgacccacccacacatccttccagtctctaataaccaccatacattctctgccaccatgagatcaacttttttagcttccaaatatgagtgagaacatgtggtatatgtctttatgtgactggctatttcacttaacataatgaactccagggaacatcattctttgttatggctgaagagtactccattgtgtatatataccacattttatccattcatccattggtggacatttaggttgattctatatctcggctattgtgaatagtgctgtaattaacatgagtgtgcaagcatcccttggatatactaatttccttttctttgggtagatacccagcagtgggattgttggatcatattgtagttctagttttagttttttgagaaatcttcatattgttttccataatggctgcactaattatctttttttataatttttttaaattttatttttgttggtacatagtaggtgcatatatttatggagtacatgacatgttttgatacaggcatgcaacgggaaataagcacatcatggagaatggggtctccatcccctcaagcatttatcctttgagttataaacaatccaatgacactatttaagttttttaaaatgtacttttaagttattattaggcgaggcgcagtggctcacacctgtaatcccagcactgtgggaggctgaggtgggtggatcacctgagcccacaagtccaagaccagcccgtgcaaaatggtgaaaccccatctctactaaaaaaaaaaaaaaaaaaaattcaaaaaattagcgaggtgtagtggcgcacacctgtagtcccagctactcaggaggctgaggtgagaggatcacctgagcccacaagtccaagaccagcccgtgcaaaatggtgaaaccccatctctactaaaaaaaaaaaaaatacaaaaaattagcgaggtgtagtggcgcacacctgtagtcccagctactcaggaggctgaggtgagaggatcacctgagtcctggaggcagaggttgcagtgagccaagatcatgctactccacttcagcctgggcaagagagttagaccctgtctcaaaaaaaaaaaagttattattgaccatagtcaccctgttgtactatcaaacagtaggtcttattcgttctttctaattttttttgtacccaataaccatccccaccttccccttagccccttggctatactaatttttgttcccaccaacagtgtatgggagttttcttttctctgcatccttgccagaatctggttttttgtttgttttttatctttctaacaatagccagtctaggcctggcacattggcttatgcctgtaatcccagcactttgggaggccaaggcaggtggatttcttgagcccagaccagcctgggcaacacggtgaaaccccgtctctaccaaaaatacaaaaattagccagtctcataacctagtctaaaaaataaataaataaacaacagccagtctagctgggtaggatgatatctcactgtggttttggtatgcatttccctgatgcttagtgatgttgaagctccataagcatttgcttgtctggttcaccatacgtattcccagcatctcagatagcacctgacatgttggagatgcttgataaatacttgttgaatatatgaatgaacaaagactgggtgtggtggctcacacctgtaatcccagcactttgagagaccaaggcaggaggatcacttaaggccaggaattcaagaccaacctgggcaacataatgaccctgtctctacacaaaaataagaataaaaataaaataaaacaagctcgaggtttgtggatgttgttcaaatagcaatgggttgtacaattatgatgttgactggattcggaattgtctgccaggaatgaagctcccaagaacatcagtgtgggcagtaagacacatatagactcaatcatcccaaggcaattggttctaatagcaattcttcctaaactggggctgcactctgacagttccttatagtgtttctcatcatcttgaaaggtggcacatcggctgggtgcagtggctcatgtctgtaattctagcactttaggaggctgaggcaggaggattgcttgagcccaggagttcaagaccagcctgggcaacatagagggacccctgtctctacaaaaaaaaaaaaaaaattagtcaggcatggtggtgcacacctgtagtcccagctacttgggattctgaggtgggaggatctcttgagcttctgcactccagcctcggcaacatggtctcaaaataataataataataaaataaaaattaaattaaaaactaaaaaaacaaaggtggcatgtcattagggttgtttcacacatcactctaaattcttcaatgagaatgcccatacagtattgggaactgtgatgtgcctattgatgctaagtcctgaagttgatgagatgaataagtcaccattcttttctttaagaatctcatggccaggtgtggtggttcacgcctgtaatcccagcactttgggaggccgaggtgggtggatcacctgaggtcgggagttcgagaccagcctgaccaacatggagaaactctgtctctactaaaaatacaaaaaattagctgggcctggtggtgcatgcctgtaatcccagctacttgggaggctgaggtaggagaatcccttgaacccaggaggtggaggttgtggtgagccaagattgtgccattgcactccagcctgggcaacaagcgcaaaactctgcctcaaataaaaaaaaaaaaaaaagaatctcataatttagggctgggcgcggtggctcatacccgtaatcccagcactttgggaggctgaggcaggcggatcacctgaggtcaggagttggaaaccagcctggccaacatagtgaaaacccgtctctactaaaaatacaaaaattagccaggtgtggtggtgggtgcctgtaatccaagctactcaggaggctgaggcaggagaagtgcttgaacccaggaggcgaaagtttcagtgagctgagatcacaccactacactctagcctgggcagagcgagactctcaaaaaaataaaaataaaaaataaaaaatagaatcccataatctagtaagggaagacatgaggtgctttactttttgcaaattgcctggaacacaggctttttattagcacatgaagcagtaacagcagtgttgttctgcaccatatgatgttgaaatggttgctgaatccttcagcattaaaagctaggacactttgggtaccactaaagtgtccagtgtttcaaaatgaataatggtagtgataaaaactacccattgctgagctcctgctatgggcattttttatattggttttctctcaaagtatttctgattatgttatactcacttttacatatgatgaaacagagactcagaaaagcttagaaacttgtccaagctcacacaactggtaagtgtaagccatgagtcatatccaggtgtttctaatgactgagaccatgttctttgcatgacaccacaggctcttgtttcaaacatctcaggtcccacttcctcagttcttcacctacaatggatctcttcccaacttcccttctctactctagtcagagaacatcttatacacatcaggtaaaaactgtgtagatgcatgcaggcttctttacaacagaacatcccatggcacattgtgttgataggaccattatataaagttgtaggagctataagaatacagagaagacatagtgatatggtttggctctgtgtcctgacccaaatctcaccttaaattgtaataatccccatgtgtcaaggtgaggaccaggtggagataattcaatcacgggggcagtatcccccatgctgttctcatgatagtgagttctcatggaatctgatagtttcataagaggcttcccccttgacttggactcattctctctcctgctgctctgggaagaggtaccttcctaattgtaagattcctgagacttccccagccatgtgaaactgagtcaatgaaacctcctttctttataaattacccagtctcaggtatttcttcatagcagcatgagaatggactaatacagtaaattggtaccaggagtggggtgctgccttaagggtacctaaaatatggaagcaactttggaactgagtaacaggcagaggttggaaaagtttggatggctcggaagaaaacaggaaaatgtgggaaagtttcaaacttcctagagacttgtttaatggttttgaccaaagtgctgatagtgatatggacaatgaagtccaggctgaggtggtctcagatggtgatgagaaacttgttgggaactggcataaaggtgacttttgctatgctttagcaaagagactggtggaattttgcccctgcccctagagatctgtggaactttgaacttgagagagatgatttagggtatctggtggaagaaatttctaagcagcaaaccatccaaaatgaagcagtgcaaaaagtttggaaaattttcagcctgatgatgcaatagaaaagaaaaatccactgggtgcggtggctcacgcctgtaatcccagcactttgggaggccaaggcagatggatcaggagatcaggagatcgagaccatcctggctaacatggtgaaaccctgtttctactgaaaatacaaaaaattacccaggcatggtggtgggcatctgtagtcccagctactcgggaggctgaggcaggagaatgtcatgaacccaggaggcagagcttgcagtgagctgagatcacgccacggcactccagcctgggcatcagagtgagactccatctcaaaaaaaaaaaaaaaaagcaaagaaaaatccattttctgggaagaaattcaaactggctacagaaatttatataagtaacgagaagccaaatactaatcaccaaaacaatgggaaaaatgtctccagggcatgtcagagaccttaacagcagcccctcccatcacaggtccagaggcctaggagggaaaaatggtttcatgggccaggcctaggcccccctgctctatgcagcctcagaacatggtgccctgtgccctagatgcctcagctgcagctgtggctaaaaggggccaaggtataacttgggccatttcttcagagggtgcaagccccaagccttggtggcttacatgtggtgttgggcctgcaggtacacagaagtcaagaattgaagttagagaacctctgcctagatttcagaggatgtatggaaatgcctggatattgctgcaggggcagagccctcgtggagaacgtctgctaggccagtgtggaagggaaatgggggttggagcccccacagagtccccactggggcactgcctagttgagctgtgtaaagagggccaccatcctccagaccgctgaatggtagatccaacaacaactgtgtgcctggaaaagctgcagacactcaacaccagccatgaaagcagctgggagaggggatgtaccctgcaaagccagagatgcagagatacccaaggccatgggagcccacctcttgcatcagcatgacctggatgtgagacatggagtcaaaggtgattattttctaactttaatgtttaatgactgccctattggattttggacttgcatggggcctgtagcccctttgttttggccaatttctcccatttgaaatgggtgtatttagccaatgccaatacccccattatatcaaggaagtaacaaacttttgattttacaggctcataggcagaagggacttgtcttgtctgagatgagactttggacttggacttttgggttaatgctagaatgtgttaagaatttggggaactgttggaagggcatgattgtgttttgaaatgttaggacatgagatttgaaaggggccagggcagaatgatatggtttggctatgtgtcccaacccaaatttcatcttgaattgtaataatccctacatgtcacgggtaggaccaggtggagataattgaatcatggggggcagttttccccttgctgttcttgtgaagtgagtgagttctcaggagatctcatggtttcataaggggcatcccccttcactcggactcattctctctcctgccgccctgtaaagaggtgccttctgccatgattgtaagtttcctgagaccacccaagccatactgaactgtgagtcagttaaacctctttttttttttttaatatgaattacccagtcttgggtatttcttaatagtgttacaggaaaggggtcccaatccagaccccaagagagggttcttggatctcacgcaagaaagaatttagggtgagtccgcattgcacagcaaaagcaagtttattaggaaagtaaagtggtgaaagaacagctactccacagacagagtagggcattcctataaataggaggaggaatgcatccacgtacaatgcttttgcgtgtgtgtgtgtgtgtgtgtgtgtgtgtgtgtgtgtgtgtgtgtataaaatttaaaaagatcatgcaccaggcggtggctcacacctgtaaccccagcactttgggaggccaaggcaggtagatcactcgaggtcaggaattcaagaccagcctggccaacatggcaaaaccccgtctctactaaaaatacaaaaattagccaggcgtggtggcatgagcctgtagtcccagctacttgggtgtctgaggcacaagaattccctgattcttgtgcagaggttgcagtgagctgagatcacaatacagcactccaccctgagcaacagagcaagatcctgtctcaaaacaacaaccaccaccaccaccaagaaaaaagatcatggggagatgtgctctgctacaagagtttgtgataaaggattaattttcttaattactgtactttgcaagaatgttatctttttcatgcctataatcctagcactttgggaggccaaggcagctcacgaggagatggagacaatcctggctaacacggtgaaacccaatctctactaaaaaaatatacaaaaacattagccagacatggtggcgggcgcctgtagtaccagctactcgggaagctgaggcaggagaaaggcgtgaacccgggaagcggagcttgcagtgagccaagatcgcaccactgcactccagcctgggcgacagagcaagactctgtctcaaaaaaaaataaacaaaacaacaacaacaacaaaaaaactccctctcaaaaaaaaaaaaaaagaatattatctttaaaacaaaattaggaatgtctttgttctccagatatcgggatattagaacattcccaagtctggttctgtttagtaaacattatcaatctgtttcattaactgtaaacatctagaggctaggaatacctttctgggaatgcagcacagcaagtcccagcttcattttcctggccctcactcaagatagagtcgctctggttagaacacctctgacaacagcagtgtgagaatggactaatatatatgggaaaaaataacactaaaccattaaatacagatgtgactgacacagacccttgatgaactcagctgctgcttcctcgtttataactacagagcccttttgggtgacaccatttctcctccaggtctgtccaggtttctgtcatctcttgccttaccatagatattttcagtccttaatggtcacctacaaaatattcattgatgtggccaggtgcggtggctcacacctgtaatcccagcactttgggaggccaaggtgggcggatcacgaagtcaggagatcaagaccatcctggcagtggcgggcgcctgtagtcccagctactcgggaggctgaggcaggagaatggcgtgaacctgggaggcaaagcttgcagtgaaccgagattgcaccactgcactccagcctgggctacagagtgagactccatctcaaaaaaaaaaaaaaaaatcattgatgaaaagtggctgtgctctaccggcgggatttgactgcgtgatgtctcacagaaagttttctgctcccagacatgggtccctcggcttcctgcctcagaagcgcagcagcaggcatcgtgggaaggtgaagagcttccctaaggatgatccgtccaagccggtccacctcacagccttcctgggatacaaagctggcatgacccacatcatgagggaagtcgacagcccagcatccaaggtgaacaagaagcaggtggtggaggctgtgaccattgtggagacgccacccatggtggttgtgggcattgtgggctatgtggaaaccccttgaggcctccggaccttcaagactgtcttcgctgagcacatcagtaatgaatgcaagaggcgtttctataagaactggcataaatctaaaaagaaggcctttacgaagtactgcaagaaatggcaggatgaggatgtcaagaagcagctggagaaggacttcagcagcatgaagaaatactgccacgtcatccgcgtcattgcccacacccagatgcgcctgcttcctctgcgccagaagaaggcccacctgatggagatccaggtgaacggaggcaccgtggctgagaagctggactgggtctgcgagaggctcgagcagcaggtaaatgtgaaccaagtgtttgggcaggatgagatgatcgacgtcattggggtgaccaagggcaaaggctacaaaggggtcaccagtcgttggcacaccaagaagctgccctgcaagacccaccgaggcctgtgcaaggtggcctgtattggggcatggcatcctgctcgtgtggccttctctgtggcacgtgctggggagaaaggctaccgtcaccgcactgagatcaacaagaagatctataagattggccagggctaccttatcaaggatggcaagctgatcaagaacaatgcctccactgactctgacctgtctgacaagagcaccaatcctctgggtggctttgtccactatggtgaagtgaccaatgaccttgtcatgctgaaaggctgtgtggtgggaaccaagaagcgggtgctcaccctccacgagtccttgctggtgcagatgaaacggcaggctctggagaagattgaccttaagttcattgacaccacctccaagtttggccatggctgcttccagaccatggagcagaagaaagcattcatgggaccactcaagaaagacggaattgcaaaggaagaaggagcttaatgccaggaacagatttcgcagctggtgtggtctcaataaaagttattttccactgggaaaaaaaaagaaaagtggctgtgtcttccaagcgatgtgactccacaatacatgggcagcagtgaacattggttttcccgtggcgccagactcttcctctgcctcagggaagcagctctgcttgaagcccctgtggatatggtttccatgatttttcttccagatatcactacttggaaaattgtggttttattcctactcattaagtcttataaacattatgatttgacatgtcacattccccagtgaatttccgctttgtaaactctgggctgtttagtcagttgcagaaactaggtagggaggctgggggtggcaggaatgtagactatcaccccctgtccctgtcccttcccacacagacaatccagccaatggcagaagactgccggaaatgtagaagagttaaggtagaaaaactttggaaaataattatttgtctgctgaggtaataaaattaaggttccgtaaagccacttttttggagtattaggcaaatatctttcgacctcttgaatttgaaatggttttgtaggtgcatgtgaccattgacttcaaaacaaaggcttttggaggagacaggtctattagctgtgctctcctctaaatatgttttaggctgggcgcagtggttcacgcctgtaatcctggcactttgggaggccgaggcaggtggatcacttgaggtcaggagttcgagaccagccttgccaacatggtgaaaccccgtctctactaaaaatacaaaaattggctagatttggtggtgggtgcctgtaatcccagctactcaggaggctgaggcagaggaattgcttgaatccgggaggcggaggttgcagtgggctgagatcgtgccactgcactccagcctgggtgacagagcgagactccatctcaaaataaataaataaaataaaataaatatgttttcaaagaaggcatatgaccatagtgggaaggagagggatgagaaaccagggaaacagtcgaagagaaaaagagggggagaggggaaggacaggaggtaaggagagtcagaaacaaaagacatacagggtttaagtgtcccgcttccgtttccttttcactagcacaaaagcctgtggatttcaaattcatctgagctgttcttgggagatggttgtggcccgaggcaagggctgactcgcagaggacagcttggcagtgacagaggcagaagtcagacagaaaggctctgactgacatgtgagcagcggggtgatgtcaacaacagctgacccgtcatgagaccttaggaagaaaaccaatgggaatcttgttttggagcgtctagtgcccagctagctccctactaggtgcttgcaaacagattgactagcataatagagtgattttgtaatctgtcataataccataagccacagatccacagactttgacccctcacaggtataataagcgcctttattcagctgcacatgatctccctatggggaaggagggagggggcccttcttctaattacacaacctaagcatatgttttgctggagaacaaagcattatattcattagcaacaatcttgtaagccaggttccttttactagccagttaactaattgacagttaagaatgtgtattaataatagactgcagccaggcatggcttaatctgacagttttattaaaaatgtaggcaagttcctcaagccggtatgactgtcagcttttatgtaggaatcctgcttaccaaggatctcaacttgctataaaacaatatcaccctggcagaaaattgttctcccaggtcaaagtccgggagtcagcagagttattcacttggaggatttttgttgttcttccctttgtgacgcatctgaacaaggaagtgattttgctgtgttttcttaaaatcttattgacatggttcacttgttctggaccaaattattctggtggtgaatgatcctaattcttccttgctgcttttctgtgtaccttgtcctctttttaaaattttattttgttttatggggtatggaaataattatttctcaaatcactagcaactccattgaaagttctgcgagagatggtagagaggttgaaattcaaaatctgtcctgccacacactgttctttccagtctttgcctttgaaattcttccagtacctaacttagatacgccctagcctatggcgtcttgttgaatttcccccatgttggaaattgagcgttttctgccccccattctcccagcacatgcaccaaacttctctccagctccctactcacctgacctaacaccccgcttgggacatggtctgtccttttatccctttttcccatgatcccttgcccttagcaaatatgcagcaaatatgtgctgggttaaagtgaatgtactctttattactaactctaatctcagtagtcagtctgtaaaacacctttgatctctgttggtttgtaaatgtctctggaatctagcctttctctgtggcagggcctttatcacctcttgtcccctgcttcagctcagcctccttgagagggatctttctgagacataaatatggtgacgaggccgggtgcagtggctcatgcctgttatcccagcactttgggaggccgaggcgggtggatc

SEQ ID NO: 291 - DNA, 735 bp, Homo sapiens
agtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggacaaggtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactggagcggctcattgacaaggccatgaagaaagatggactcgtgggcatggccatcgtgggaggcatggccctgggtgtggcgggactggccggactcatcggacttgctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtgctttgggatgagtgtaaataaaacggggctgtggcttgggaaa

SEQ ID NO: 292 - DNA, 726 bp, Homo sapiens
gccttccttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaaaaaaaaaaaaaaaaaaaaaaaaaaaaaaaaaa

SEQ ID NO: 293 - DNA, 1449 bp, Homo sapiens
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgaaaaaaaaaaaaaaaaaa

SEQ ID NO: 294 - DNA, 1488 bp, Homo sapiens
gcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgcaaaaaaaaaaaaaaaaaa

SEQ ID NO: 295 - DNA, 126579 bp, Homo sapiens
gatcatatgataggccataaaatgagcctcaataaatttaagaaaactgaaattatatcaagcactctctcagaccacagtgtaatgaaactggaaatcaactccaaaaggaacctttaaaaccatgcaaatacatggaaattaaataaactgctcctgaatgagcactggtcaaaaacgaaatcaagatggaaattaaaatattctttgaactgaatgacaataatgacacaaactatcaaaacctctgggatacagcaaaggtggtgctaagaggaaagttcacagccctaaatgccgacatcaaaaagtctgaaagagcacagacagtttaagtcatatctcaaggaattagagaaacaagaacaaaccaaacccaaacccagcagaagaaaggaaataaccaagatcagagcagaactaaatgaaattgaaacaaaaaaaaaattacaaaagataaatgaaaacaaaagctggttctttgaaaagataaataaaattgacagaccattagcaagattaaccaagaaaagaagagagaatattcaaataaccttactaagaaatgaaacaggagatattacaactgataccacagaaatacaaaagactattcaaggctagtatgaacacctttatgcacataaactagaaaacttagaagaaatggataaattcctggaaaaatacagccctcttagcttaaatcaagaagaattagataccctgagcagaccaataacaagcagtgagattaaaatggtaattaaaaaattacaaacaaaaaaaagtccaggaccagacagattcacagcaaaattctaccagacattgaaagatgaattggtacttttgacactattccacaagatagagaaagaaggaaccctctctaattcattctgtgaagccagcattaccctaataccaaaaccaggaaaggacttaaccaaaaaagaaaactacataccgatgtccttgatgaacatagatgctaaaatctttaacaaaatagtagctaaatgaatccaacaatatatcaaaaagataatccaccatgatcaaatgggttttataagagggatgtagggatggtttaacatatgcaagtcaataaatgtgatataccacataaacagaattgaaaacaaaatcacatgatcatctcaatagatacagagaaagcatttgacaaaatccaacatttatgattaaaactttcaggaaaatcgtcacagaaggaacataccttagtgcaataaaagccatctatgacaaacccacagccaacaaaatactgaatggggaaaagttgaaagcagtccctccgagaactggaataaaacaaggatgaccactctcaccactcctcttcaacatggtactggaagtcctagccagagcaatcagacaagagaaagaaataaagggcatccaaagcagtaaagaggaagtcaaactgtcactgtttgctgatgatatgatcgtttaccttgaaaaccctaaggactcctccagaaagctcctagaactgataaaagaattcagcaaagtttctggatacaagattaatgtacacaaatcagtacctcttctatacatcaacagcaaccaagcagagaatcaaatcaagaactcaaccccttttacaatagctgcaaaaaaaaaaattaaattaaattaaattttaaaaaatttaaaaaaccttaggaatatacctaaccaaggagttgaaagacctctacaaagaaaagtgcaaaacactactgaaagaaatcacagatgacacaaacaaatggaaacacatcccaagctcatggatgggtagaatcaacattgtgaaaatgaccacactgccaaaagcaatctacaaattcaatgcaatccccttcagaataccaccatcattcttcacagcattagaagacacaattctaaaattcatatggaaccagaaaagagcccacatagccaatgcaagattaagcaaaaagaacaaatctggaggcatcatactacctgatttcaagctatactataaggccatagtcaccaaaacagcatggtactggtataaaaataggcacatagactagtggaacagaatagagaacccagaaataaacccaaatacttacagccaactgatcttccacaaagcaaacaaaaacataaagtggggaaaggatgcccttttcaacaaatggtgctgggataattggctagcctcatgtaggagaatgaaactggatcctcacatctcaccttatacaaaaatcaactcaagatatattaaggacttaaacctaagacctgaaactataaaaattctagaagataacattgaaaaaactttctagacattggcttaggcaaggatttcacgaccaagaacccaaaagcaaatgcaataaaaacaaagataaatacctaggacctaattaaactgaagagcttttgcatggcacaaggaacagtcaggagaataaacatacaacccacatattgggagaaaatcttcacaatctatacatctgacaaaggactaatagccagaatctacaacaaactcaaatcagtaagaaaaaaacaaacaatcccatcaaaaagtgggctaaggacgtgaatagacaattctcaaaagaagatatacaaatggccaacaaacatatgaaaaaatactcaacatcactaattatcagggaaatgcaaatcaaaaccacaatgtgataccaccttactcctgcaagaatggccataataaaaaaaataaaaaaacagtagatgttggcgtggatgtggtgaacagggaacacttctacactgctggtgggaatgtaaactagtacagccactatggaaaacagtgtggcaattccttaaagaactaaaaatagaactaccatttgatccagcaatcccactactgggcatctacccagaggaaaagaagtcattatttgaaaaagatacttgcacaggcatgtttatagcagcacaattcacaattgcaaaatcgtgcaagcaacccaaatgcccatcaatcaacaagtggctgtagtgtgtgtgtgtgtatatatatatatgatgtgtgtgtatatatatatgatgtgtgtgtgtgtgtgtgtgtgtgtgtgtatatatatgatggaatactacacaaccataaaaatgaatgaattaacatttgcagtgatctggatgaggctggagactattattctaagtataatgtaactcaggaagggaaaatcaaacattgcatgttctcactgatatgtgggagctgagctatgaggacacaaaggcataagaatgatacaatggactttggggacttgtggggaagagtgagaggggatcgagggataaaagactacaggtatgttgtggtgtatacatgggtgatgggtacatcaaaatctcacaaatcaccactaaagaacttactcatgtaaccaaataccacttgtaccccaataacttatggaaaataaaataaaataataaaaataaaaataaaaaaccataaaagagaatgatttcagtaactttcttctgataagagattgccaaccatagactggttctggcttgtttacagaggctgcacacctgagtgcctccatgtccctgctttagcttttgatgtatacggcctaatagtaattcatttaaatgttaagtctctaccctaatgttaacttgggttgtatgttacatacatgtttttcaatatgcatatttcaggaacccctttgtgaatattcataactcctgctataacccattaaatatgtatacttggccaacctgttcaacataagttcctcttctgctctctcctcccttaaagtgcctgtttccagtctttgctgagcggagtctatacttcacagcctgtggaatggccaccctgcagactataaacccttatacaaaataaagtcccctttctaaattaaaaacaaaaaacaagtagatgtcactgaacatatacttaaaacactcgagcaaaaagaagacaagattgaaactactagcaaagaattaagtctacaaaatgaaccaaacagaaattttgaatccgagaaattctgataaactgtactttgaaatagtgaactcaatgaataggtttaacagtagattaaacaacacagaggagaaattttaaggaactggaatataggtcagaaaaaaacccagaaagaagcatgcagaggaaaaggatggaaaatatagacgaaagagcaagaaacacacaggatactagcagatagtctaaaatataggtaactgaaatctaaaaggacagcagagagatgatggtgctacatcgaaagacatcaaggtatagattcaaaaagccctatgaatccaaaaggaacaaagcaatcagacatcagagaaaaaaaaaaagacaaaaacaacatcatcatccaatgaaggaaaaagctagcttaccttcaaaggagcaagagtcatattgacagacgacttcttaacacaaacagaaacaatggaagacaagggaatgagaacttcaaagtgctgaaaggagatatctgtcaacataaaaatatgctttaagaatactgttgtccagaggacttcatgactaaaacaccaaaagcaatggcaagaaaagccaaaataggcaaatgggatctaattaaactaaagagattctgcacagcaaaagaaactaccatcagagtgaacaggcaacctacagaatgggagaaaagttctgcaatctacccatctgacaaagggctaatatccagaatctaccaagaacttaaacaaatttacaagaaaaaaaccaaacaaccccatcaaaaagtgggcaaaggatatgaacagacacttctcaaaagaagacatttatgcagccaacagacacacgaagaaatgctcttcatcactggtcatcagagaaatgcaaatcaaaaccacaatgagacaccatctcacaccagttagaatggcgatcattaaaaggtcaggaaacaacagatgctggagaggatgtggagaaataggaacgcttttacactgttggtgggagtgtaaactaattcaaccattgtggagacagtgtgggattcctcaaggatctagaactagaaataccatttgaccccattactgggtatatacccaaaggattataaatcatgctactataaagacacatgcacacgtatttttattgcggcactattcacaatagcaaagacttgaaaccaacccaaatgtccatcaatgatagagtggattaagaaaatgtggcacatatacaccatggaatactatgcagccataaaaaaggatgagttcatgtcctttgcagggacatggatgaagctggaaaacatcattctcagcaaactattgcaaggacagaaaaccaaacactgcatgttctcactcgtaggtgggaattgaacaatgagaacacttggacacagggcagggaatatcacacacgtctgtcatagggttggggggcagggtgagggatagcattaggagaaatacctaatgtaaatgacgagttgatgggtgcagcaaaccatcatggcacatgtacacctatgtaacaaacctgcacgttgtgcacatgtaccctagaacttaaagtataattaaaaaaaaaaaaaagaatactgttgcccagacattgcagtttgccagcaccgtgaatatctgaacatcatggcaagtttttagctactcaggtgttacaatatctgcaatgcaaaaacactgagatcttatgaaccagagtataatcagagttgatgaattagacagagatagatcagcacagccttccattgtgaagtcacttattttgcagaaaggatcaaattatctacgtagaaacatttttttttttcttttgagatggagtcttgctctgtctcccacgctggagtgcagtggtgcatcttggctcactgccagctccacctcccaggttcatgccattctcctgcctcagcctcctgagtagctgggactacagatgcctgccactacgaccagctgatttttttgtatctttagtagagacagggtttccctgtgttagccaggatggtctcgatctcctgacctcatgatctgcctgcctgcgcctcccaaagtgccaggattacaggcgtgagccaccatgcccggcctctatgtataaacattcttaagaataatgaacttaaatctgctaatatgtcatttacaaaatagatgtgagactatatcctcaaaccccaagaaaagcaattttaaccaaaaaagctataattactctgtaagagttagcctcaagagttatctagaaggaggaatggaaagtacaatgtcttcagatgctcaaaaagattaagtaacagtagaataatgtgatataaattgagtctgaagagtgtttagtttcagcaagaggaaacaataagagcagtacttttagagaaataatcaacattaattgtataaaaccttgagtcctgccagtctatcctatatggcagtatatccatttgtatttctttttatgaattaaatggattttaagaaataagcagcttagagaaaggctgtgacttttgatcaaaacaaaggaagggtgaagggtttccaaataaatgaggataaatggaaataatgttcattgacgaggcatctaacattgatgattccactctaagtgtaaatattcatagtaaacactggaaaatttatgttaatttaaaaactgatattacctgttgaatctccttaaggtaaaatgttaaagcttttcaggcgtgagtctggtttttaaccaacaccagaatgaaacagtcatcttttatacatacttgtcctgctgcatttaattttagcaacttgtatctaagaactcattcaaagggataaaattacataatttttaaagccatattaaattgcaccaaaacaacaacaaacccttgctctactataaacagccctgaaagtcatgatatttttgctactcaaatgatatttttgtagtaaaattatcattaaagtaatatatggctctaacagaaaaaatcttattgtattacagaatgtcatattgacagtcaaaattttataatttgatacaggtatcatctaacttggatttgtacttccaaaagtcatcatgatttagaatgctgtattacggactggttatattaactaaaactaaactaaaattaaattaattttaaaataactggaaaagtcataaatgtttaataaacagtagatgtttgtatttttaagaatttcacatttgcctaacttatacaaattgccacgtgataaactcatgcttctctaatagctaaattctgagctgtctggttatgtgaatgaaaaatggttaattgcaacttctttttgaagtaattgtgatagctgatatatattttttacatgagtaactgtatattacttgactaatttgttatttagaagaataaatcccatgttaatgtctttaaatacgatagcatagcaaaagtgaccaaaacgaaccaatatgtaaaatgacactgtaactatttatttatttatttatttatttatttatttatttatttataatactgtaagttctagggtacatgtgcacaatgtgcaggtttgttacatagttatacatgtgcaatgttagtttgctgcacccatcaactcatcatttacattagatatttcacctaatgctatccctccccctgccccccaaccctatgacagaccctggggtgtgatattccctgccctgtgtccaagtgttctcattgttcaattcccacctatgagtgagaacatgcagtgtttggttttctgtccttgtgatagtttgctgagaatgatgttttccagcttcatccaagtccctgcaaaggacatgaactcatccttttttatggctgcatagtattccatggtgtatatgtgccacattttcttaatccactctatcattgatggacatttgggttggttccaagtctttgctattgtgagtattgccacaataaacatacgtgtgcatgtgtctttatagtagcatgatttataatcctttgggtatatacccagtaatgggatcaggggatcaaatggtatttctagttctagatccttgaggaatcgccacactgtcttccacaatggttgaactagtttacactcccaccaacagacgacactgtagctttaatttaggggaaatacttacttcacgtgtcagggggccaattctaaattcaaaaacaatcaaaaaatgcattttgttttcatttcagtgttgattactgtcaccacccccagacagagtttttgatccctggggctattgcttgcacagttcaaaggtaattagaggccgggcgcagtggctcacacctgtaatcccagcactttggaaggctgaggtgggtggatcacctgaggtcaggagtgtgagaccagcctagccaatatggtgaacccccgtctctactaaaaatacaaaaattagctgggcgtgatggctggcgactgtaatcccagctactctggaggctgaagcaggagaattgcttgaacccgggaggcagcggttgcagtgagctgagactgctctgctgtactctagcctgggcgacagagcgatactccgtcttagaaaaaaaaaaggggtggggggtgggaattagagacttcttctttctgctaggatagagtagttgcagcacatgaatgcttctacagctaactaagtaagctgattttaaaacaaaatgtttccaggcactgcagagcagtggaatctcagataggactaaaacttctagatgagaggtttctggtaacctgtaccccctttttcctggtggctcactagatggggcgagagttacagcacaggagatctcaaatacacaactggtttcccctcagacattcacaaatactgaagctttgagggcaaaagactaaaaatctaatcatgaaaacatttgaaaagtagaggcaaaattttccatctcttggtattgaggagatctggcagggagaggggccccactgaaagcccttgagaggggtcctaaggaacatgggatagccagagggagactgtggcttaccagaattggactgcaccccgcggagctcccctcttattggacaaggccatcagcaccccaactgcctagctgaggacatggcaaaccctctttgggagaagatgtcatcacctaaagtaactcaagtgtataatatttcatacccaatgtatggcaattgacagaaaattaccaagtacagcaatagatagaagcagggaaacagaatcctgatgctgaagtcatctggcaaagactttaaagaagcaatgatgtacatagaaaatggatatattaagtacagcctttgccagaaaattaaaaccaatagaaaagaatcaaatgaggattttattactgaaaaatagaatagctgaaattaggaactttatgcatgtgtttagcaggagatcaggtagagcagaaagagggttcgtaaaccgggagataggtcgactgaaaatatccggattgaaagaaggtagaggaaagaaaggggagaaagtacatagagaaaaaggaacagagggacacaatggaatgatccaccgtatgtaattggagttccagagaatggggtaaagccaacttttgagaagataatagcttctcattaagcttcaggataagccgtaggataaaaacaagaagctctggtaagcacatcatagttaaactgatgaaatccaaagacaaagataaaagtcttagaagcataagatgggggaagatagttaccttcaaaggaatgacaaaaagactaaccattgacttttcagaagataaatgacattcctaagtgctaaagagaaaaacacctaactttgagttcccgctatatatattgtgaaattactcttcaaaactataggtgaaatagtgatgttttcagacaaacaaaaactgagactatttatctccagtgggattgcactaaaagaaatactaaagggaactctttttttttttttagaggaaaatgatcccagacagaaacacagatgtgtgagaaggatgaagagaaacagaacagattaaaatgtgagtaaagctctgcttcttgatttgagcgctgtttacgtgaaagagttccctttctgaaaaattcataagctctgcacttaaatttgtgcacttttctgtgtgtgtgttgtgcttcagcaagaattttaccaaaataaagcaaaataaaaactgcttagaggaaaattgacagtctcattgcatacattagacaagaatggctacaaaccaacgagctaagcagcaatctcaagaaattagcaaaagaacaacaaattaaatccaaggaaagtagaaagaaggaaatgataaagaataaagagcagaaagtaattaaacagaaaacaaacatatatagaggatcaagaaaatcaaaagttagatctttgaaaagactaataaaataaaaaatccctggtgagggatatagaaggcaagagtgaagaatatgaagtatgaaaacagggcatcacacagcactgacgctgcagtcccctatcctggatggaaccagctgagtactttctaagcctatcccaagcattcaggctggaggcagggtatcccagcagtgtctcccaggccaacgacaagagcagcagtaatatcatcactgagtctagtgccttctgtgccacaaaagtccctaatcctagatcactggagtaggtctctgtgtttcaatctaagtggagagaataatcttggctggtcagatggtggaggactgagttgcctgaaaccagttttagctctctggcacacaggacatggcaactcaaagcacataaatatgccaggccatctggcatggtgcatattcaattggtagttgcttctcccagttgcagttgattcagattcagggtgcaggaactggatgtttgttccttctaaggggcccctgacactgcaaatgcagccttcacagcaagtgagtgtcttctataaaaaaaaagacattgtgctccattggtgtgggatttcatgaaactataatgtctgtaggtttagaatttgctggaattgttgcctcttgggagacaatgatcttggctattcggctgagttggagaggccatccagcaagagcatctgaagacactgagatgctgtgatgaagcaggttagtgtcagactgttagaagaaaaggtgagaaatgaagtacatgcacataccatcctgtaacacctgggaaatagtgtgtgccttcccacaacatgttgcagcatgcactggccacttggctgacctagagatgtcaccttggggctcttggccacttgactgacctagagatgtcaccttggggctctcaaatatatctttgtctgggtaggctcagagatgagtctatatcagatgactcaaacaactcaacaagaaaaaaacaaccacattaaaaactgggtaaagggcatgaacagacattttgcaaaacaggaaatacaagtggtcaacaaacacatgctcaacatcactaatcatcagagaaatgcaaattaaaatcacagtgagatattatactagtcagaatggctattatttaaaaagtcaaaaaacaatggatgttggcatggttgcagagaaagggggacactcatatacttttggtgggagtgtaaattagttcaacctctatggaaaacaatatggagatattccaaataactaaaaatagaactaccattagatccagcaaacccactactaggtacctacccaaaggaaaagaaatcattaattaaaaagacatctgcactcctatgtttattgcagcactattcacaatagcaaagtcatggaaccaacctaagtgtcaccaatagttgattggataaagaaaatgtatatatacaccatggaatactacacagccataaaacataaaatcatgtccttcgcagcaacgtggatggagctggaggccattatcttaagtgaactaactcagaaacagcaaatcaagcatcacatgctttaatgtataagtgagagctaaacaatgggtacacatgagcataaagatggagataatagactgaggaccccaaaagtggggagattgggagagggataaaggttgaaaaattacttattgagttcaatattcaatatttgggtgatgggtagattagaagcccaatcctcattattatgcatgtaatacccttataacaaacaagccatgtaccccttgaatttaaaatgaaataagagaaaataaacaagaaaagaaaaagtcatggtctgcacagagtcctgagagggaagctggattttctttcaaaagtccaaatcttggctgggagtggtggctcacacctgtaatcccagcactttgagaggctgaggtgaaggaccactagaggccaggaattggagactagtctggataacatagtaagaccccatctctaaaaaaaatttttttttaagtagctgggcatggtggtgtgtgagtgtggtcccagctactcaggaggctgaggcaggaggatcacttgagcccttgaggccgcagtgaggtatgatcccaccactgtactccagcctgggcaatagagtgaaagagagagagagagagagagagagagagagagagagagagagagagagagagagaaagagagagagagagagagaaagaaagaaagaaagaaagaagaaagaaagaaagagaaagaaagaaagggaggggaagaaagagagaggaaggaaggaaggagagagaaagaaagaaaaagaaagaaagagaaagagaaaggaaggaaggagagagagagaaagagagagagagggaaaggaaggaaggagagagaaagaaagaaagaaaaagaaagaaaggagagagaaagagataaagacagaaagagagaaagaaagatgaagggagaaagagaaagagagagatgaagggagaaagggagtcaagggagaaagaggaaaaatgaagaaaaggaaagagatggaaggaaggaaggaagaaaggaagaaagaaaaaagaaagaaagaaagagaggaaaggaggaaggaaggaaagagataaaaaaggaaggaaaggaaaggaaggaaggaaggaaaaagaaagaaagattccaaatattgtaagaatttgttttgtgagtatctaagtcattttggactgctataaaaatatcatagactgagttgcttaaactacagacatttattcctcacagttctgaaggctggaaagttcaatgtcaaggtgctggtggatcaggtttctgctaagggctctcttcctggtttgcagatggctgccttcttgctgtgttctcacatagcaaagggagagaaatcatgtgtctcttcctcctttataaaggcattaattccattaggagggcccactcacaaacattagtctatagcagcgaggttgtaaggtcaccataaccacttcatatgtgtcaagcagctagacttccatttaactggttctgatatttgaatattaattttttatattgagtttgcctgaaatgtatttttctctaatttgggaactgctggtgattaggctagcagtaagggtaaggcctgattgtggattattttgactacttttttctgcatgttcctgaactctttctgccttttcccttctattattgactgtttaaaaagaattgacataatctactcttccccttctgaaaaatatttcatcatattattttaatacttaaccttttcattgttgaagggttaggcaggttttaagtgtttaattttcaccagaaatttatgttctgtgttatagaaaattcatattgtaaaataagcctcttcttttcgagggtaaatatgaagaaaagaacagaagttccaagaaaaggctgtgtctgtaggtccaaatttctagactcggtatagagatagagtatttcatatgccattctctggtagagggtagactatttgtaactgtattttccccaaaggatatgagaagcataatgtcacaatttctcccctctaaggtgggttctctgatttgggatttaaattcataagccttggataacctggaagagactgacattcattctaatgacaataaaacaaggatgactttctcctttttcttttctgctttttgtctgcttactttcctcaggtaacacagctggcaacagcaatgtaagtctaaatatgtaccaggttctgcaaactctggttttgcttagagagaaggaacaaggcttagattagtagctgctgcaacggataagggttgtttgtgtctaaattttgtgggtgttggcggatttttcaatattcttaggtaccatattgactctagaattttgggaacgtgtgatacatgagacagagacatctgcattaacaacattttgggagaggttttgtatatttttgtattgtttggactctgaacactttcctggttgttgaaagctggagtggacaatgtagctggcaccatttgacaatggccttgcagttgactagagacctatcttgactgatgtcagaaagtcctgagagtgacctccgaattggtcctgggtagataagatgcacagaagctgcgaaagtactcaggaaggcacacacaatgttcaggcaggactttctgaagctccacagatctctgtcctcaccaaaaacagctgtggctatgcacaaccattgacttggctgaaacactcaataggttaaaagagagaggtataacgtaggaataaagtggaaaaagtgaaaattctccctttccactgcttttctaacatccgtttcctggtcccagtggagggaggaggagttgctaaactggttggtcagattcccagtgtggattgggccatgtttgacagagagcagagtcctctgttttcaaaggtggtaactttctgccacctctttattacaaggggaaggtagataggtcagttgactctgttatctccctgtggctgacccagagaccatctggccccttccctctgcccgcatttccctgtctcttcctctagcagggaaacccaacgttttgggctcaggggcatctataggaaagacaagatgtaatggctgctgtccttcagcataagtctcatgcttcctgcactggaatactgagcaccagcttaattcattcattatataattgaatacatacttattaagccttctaaggggaaatgctactagcaataaaacactcttctaaaatgttatctaggtgttgaaattatagacgatttttgctttgatcttttcctcaaattttctgtagggaataagtaatacttttataaatgcatatacaaatggaatccatccatacataacaaatgcaccaaaacaggggcgattctggatttacctgtgaggaagcgattgaaatcctgtgttgccttttcttttaatgtgactttctctacagctttttataggaggcacactgagctccccacttgggatcatctggatatgagaaagactgtatactaaccaccttgatcttccttccagacctccattttggtagaatgtgatagtctagtgatgtctgtattctctgatgccccccacatttccttgcctatcataccagggaggtaaggcccccaggaatgactcctacttcaaagttctatccagtggataagccagtactgagctctctatgggaccagaattttgcaccaatcctctgccttagtcatgggacccctactggcctactttggtctattggctaaagagcagtctctgaaggcaggctgtcttggttcccatcccagtcctatcacttgtttgttacctgtgactatgggaccggttgaattatcttcctctgcctcaggtttctcattaacaaaaaggaaaaataaaaatatctgccatctagggttccataaggattaaatgaggcaatatatttaaggtgctcagcatgatgccaggtacattgggatggctcaaagaagtttagctgctggtattattagtgttattcctctactcaggacagtagccttaccccaaacaacagcccaggggtcggaccttgcagcccatgtactgttccccagggatgagcacaggccacactcctgaagtgaccgcagccgcctttgctcccatctgctgtgtctgtctgtgtaattggacaccgtggtgatcagcttgccatgcccttcagacactgcctcacccacctggctgcaggtccagacacagaatcttagttaggtcagtgtcccttgtctgccccatattcttgcctgccaaatttggcctctcgccacacacacctgcaacaggcctttagagcaaggccccatttcaagaatgtggcctgtgcgcatgcctggggatctgtatccatctcatggagatcaaaatgggttaacagtcccttccttgggttgttgaagtctttagagggtctcagcagcccgggttgaggttccagctccgtgtgtctgtgattttgagcaaaagagattcattttgtatgtagagtggctttgaagaggaagaggagaagctttttatttatttatttatttttgtagagatccaatttcactgtaccacatctgtgtagatgaaaatcactcctgagttcttccaatttcttcttattatttctcttcttgttaggaaagcgggcactgtagaatggtcagcagaaacacatttcttcctgtctctttgttcccatcttgcacctgccacctgcgtcacccacacttctggtcatcccacccctagccagtcaagagcttctaggaaagtcctgtcccataactgttctctggatcctgttgcctactgactcctcatggccttcaatccatcaaactgcccttcaatgtcccatatctctgacattcccatgggctctgccatggtgctgaagcacaacagataatcctgacctcaaatcccagctccaccacctaccactctgaaccttaggcaagctgccatgatgctcagagaataagatttctcactggatacaacagtgatggcgtccacctcatggtaacatccttgccaagaacgttgatacctgtaagcactaagttaatgagagtccctatttttatggcctattccactcagtctataaacatgtgcaagctcaccctgatcttttttttttttttgagacagagtcttgctctgtcgcccaggctggagtgcagtggcgcaatctcggctcactgcaaactccacctcctgggttcacgccattctccagcctcagcctcccgagtagctgggactataggcacccaccaccacgtccggctaattttttgtattttttttagtagagatggggtttcaccatgttagccaggatggtctcgatctcctgaccttgtgatccgcccgcctcagcctcccaaagtgctgggattacaggtgtgagccactgtgcctggccccaccccgatcttacatggatgaagctagaaaccatcattctgagcaaactatcgcaaggacagaaaaccaaacaccacatgttctcactcataggtgggaattgaacaatgggaacacttggacacagggtggggaacatcacacacgggggcctgtcgtggggtggggggagtggggagggatagcatcaggagatatacctaatgtaaacgacgagttaatgggtgcagcacaccaacatggcacatgtatacgtatgtaacaaacctgcacgttgtgcacatgtaccctaggacttaaagtatataaaaaaataaaataaataaataaataaataaataaaagacttccctttgattttattcctcatttggttaccttctcagagccactgtcattgccagccatcccacaggactgctgtattcccctggcctcttctttatcagtgcagactcaccagagggtcaccaaccactccagcatgttcacgcctgagctttttcctgggacacagaactattagggcccaaaccaggagagttccagcaaaccaggatgaaccagtcactctatacctttcagcctacagtctttctcaccaactcctcgaactatttagacaaagcccatagcccccacatggccaccctccacaggtgacttctgtatcttctgtgactctgtggcgctcagcaggtcatattgatgacatccttgatggtttctcctcccttgacttccagggccttgctcttgatggtttctctggtgctctggttactatggctgtataatcatcaaaccaaaaacttgacagcttcagcagcaccctcttattatctctcaaagttctgtgaggtgtgggctcagcatggcagttctcctgcggatctcacatgctgttgccattgacagcagctagggctagacgtatgatgtggcctcttgcctggttgaggatggctggaaactctgggcctgccagcatgctcttgtcacacagccccgaacacagctagccagggcttctcccagcccagctgtctcagggctttaagagtgagtgtcccaggagggaggaagtggaagcttccaatatcttgaggcctaggctggaagttggtactttagtttggaaaccagcccaggtcacagcacccacccaggctcaaggggaggcgacatggaccccgcctctcaataggaggagcatcagggaatttatggccacccttaacctgcctaactccatgatctctctttctcttcttcttcctcttgctcctcgatggaattccgtcctcaactctcctcttctcacagtctgtatcagtcatcttcacatttacaggcatatcagaataacatggcatgcttattaaaaagaaaggctcttgcctatggaatctgcatttctaataaccaccctgggtaaacgactgccttgcaattttcagcaggctacactttgagaaacactactttacactccccctacacaaagtccttcacaccctcacttcacacagcagttgcttgttcctttcccatctctgtttcaaagccgggttcttctccttagcacgccgtgtccgggcaactgtgtgctgcatctttccagcccacagacacttcagcctgaacttggtgtcttcaatccccaaactcgccccctttctgacccctcagtcttggatgatgtgccgtagaggcagctgattctccttctgcccctttcctctccccaggcacacatccagttcctcaccaagccatgttgatcttacctcctaagcctctttctgaatcagccccttccatttttctcattccaggtgttctttgtttctcacctgtttttatgccatagtttcttggtggtctcaagcctctaatatcagcaccttacagtcttctcgccacacttctgccagaatgcagtttctagaatgcaagcctaatcggaatgctttttctacttaaagcatttgcatagctctgtgtgctctgcaggcatatgtctaaactgcctagaacctctgaccctgggctccttccctggaatgtttcttttccaattctgtctcacctaccccagcctcaccccttcccacccctgtatgccacttggccctgagcccagaccttccttcccaactggccgagttcctgtaacttggaggtgattaggtctttgccccaaggtcaggctagggctcctcctcttactatttcacacaaagcacaaaaagaagtacatgcttgtctccccagtgtaatgccagaaccttggcatgcagggacggagcctgcatgtctagatctgagcccctggagaccagcacgatccccagcaggcctccagcacaatagggctaagagagacagctgtatctgttatgttctcacaccgacttggcaacttaaggttaatccagaaaagtgtgactttgggttaatagggccttgaccctttatttatgtcgattgagtgttttcttctcattgggaagatctgacatgtatctgactggaagccggcaccatcgttttgtattgctgcgaatctgaatggaatgttccggttatatctttctggctgttttctgtaataacgctcagtcatgctttgttatttaatctgagggactgagacctccatgcactgcaggtcaattttgatgtcccccagatgcaatggaatccttgatgtgctgagaagtgactgcacgcctgcgtcttgtcttcccacgtgggctgggccctccactgccacacgccattgtctcattggccgtgttcagtcagattggcctctggcagccccatgcagttcagacagggaccagcagcaaccgcagcccctctagttcactgcttcttctgtgtcccatgttgcaggccttgactgggattgctgaaggtggatatgtttccctgaagttgccttgcacgaatagtcacaaacccttgttttttttgttttttgttttttgtttttaatttgagacaaggtcttgctccatagctcaggctagactgcagacctccccagctcaagtgattctcccatctcagcttcccaagtagctgggtctactggtgcatgccaccaaacagagctaacatttttaaatttttattttttgtagagatggaggtctcactttgttgcccaggctggtcttgagctcctgggctctagtgatccttccgccacttcctcccaaaatgctacgattataggtgtgagccactatgcctggccccaaatccgttttatcatgtcatcctaaaactaaaataataatgataataataataataataataataataatataaatggttcatagactacataaagtctaagcacttatctttcctgtacttctcagctccaccctgccgtgcctttaatcttgctctttaatcactattatgttctttctacatcccattagcacacaggatgcataatatctaatatatgatatcacatgatgcatgataacctcaaagggacaaaattatcactgtatgaatatttccaaccctttcacttggggctgctagagagtgcctatggacttggtagcttgggctccttcctctacccaggggatgcctctctagcaagattaattcttttgggattttaaagcaaaactggaaggaaataacgaagggaagaccaacatgagtacgaggtataaccagaggtaggtttatggagaagtttaggtggtagggacagcagggaggggaattaattgtgtggtgaaaggataaaaagaatttcaggagtatcactgtgaactctatattattttcctaaaatttaagaaacacaagtaagaatataagcaacacgaattacttcacgaccgttacacagtgcaattttaaccatgatttcaatttagcgtagtgctaaagtgggtgggcagcggtggggggagtcttggtttccacggagctctataaaaaaatcagatggcacaataatataaatacgcctattatcttgcagatatgtatatggagtcatactttttcctaacagaaaacctgtgaagcagtgcaatgatcacacctttacgttgcacaggtggggttcagtctcctcatgtagacttaaccttcttaagggcttagcgcctatggcccaagtatttattgtagcacagattgagacatctccttggaaataacacaacagtgattgaaaatggcagcccgcggtgcagtccttagccacactggctctaaaggcagagcagtcctggtgaaaacatgcccaagttgaaataaaaggctctaacaacatgtcaccttaaccatctggactgtggcctgatgaagcccctgtgtctagtcttggtgctggtgcctctggtcccagcgagcttgttctggctctggctgcttcgccgcagggaaacattgctctgaatgtcaagggagagaaggccaccggctcccctggagccctgcttttcctccagtgccctttggtctccagctttggctgcagagcagagggtttccccacagaaaactctcagcataaagccattcatgtctcaattgtcaccaagacaccaatatgttcatttccagagcagaaataaaaggtggatgtacgatcctgccctgtttcctctcagagtgacacctgtaattcctaattcacagccctctaattatggcagggggtctggtgttgactgagctcttactgtccctgacacatggctgggcacttctcctgagttttttcaggtcatcttcatggggccgccttgtggaggacatatatcactttcattttatagatgaagaaacagaatctcagagtccagagggcctccctgggcgtggggttgagccccaagtcaccgtggccatcatgctgcctctggcttagaagccactggctgaagcccagagtgaggaggcagatcccgacagcccctacctgtgtgaggttcacctcaccatggtcaaggggggagtcattacaaactgtcagtaaggttggctgcttagattttctgttatgtatcatcaggagcccctgtgtgtttttaaaatatgggatgatgatttaaatgggattaatgcccttgtaagagaggttgaaggggcaccccagcccctttggcccctctggtcctacgcagaaacagcaagagggcactgtctttgaagctgagcaggccctcagcagaagcagaatctgttggcactgtgatcatggacttcccagcctttagaatggtgagaaataaatttctattatttatgaattccccagtgtaaggtattttgttataacagcctcaacggactgagacagatggcatgatggaaaaggattttaaaatgaggtgctaaaaaggttgaggggcgttcttctgatgggtgcagggaatgatgagaccacagcgtgcagcaatctgggtgtgcatccagccaggtttccacacgaggaaacgaggggcaagacaggccgagcctaagactgacccgggaggtgaggtgggatccgggatgagtggtgctgactggcgggggcaggacactagggcaaggcacggaggttgaaaatgactcctgatttctcatttatgcctggacagctgtgaggaggcggtgcctacgacagtgacgacaacacaagggcgggggagaagggcagcccctttggcagtggtctctttttgctgtaatcagaggtcagtccagacacactgcccagttcttcctactaaaattggatgaacaaggaggtacacagagcagatcttggccagagatcaagacaggataccttcttttcaggatcacctcatctcagtgttctggggcaatccaagccctgacttggaaggattctgacaaaatacacaatgaacaaggactgtgctagctccctctgaaggtctgaatgggccagcggagcccaaatgcatgtattaaaaaatgataattgagttactacaataatacagtatcatatgactttataggatgggtcaacttaagatttcaccagttctgtcttctgtcagtgttcaagtttgtatctttagagttctcatgttatagccattgacactatggtcaaatagccaggtgcccactggagaaaaattatgccagagaataagaaatgattcaggctttattttctttagtatttttatcaggtatgttactccttggagagtgcagaaaatatttgtttaaaatattcctaatttgatggtactttcaaaatcagatttagtcagaccattaaaaattgtataaatcaatagcaattacctacttctaaattgaatcattatccccaaagaaaagtgctattagaaccctgcagactccaggtcatctgcaatatacatccaatctcataaaaagaaataacaaaaggaaaaaataaagggaaaaataaaaaccaaaataaaaggtacacctcattttattttattatgttaatttaatccccaggtagaaagaatgagcttctgttgtacttcaatgtttaaaatctggccaatttttaatgtttacaaaattatttttaattttaagagagtataatttaccaattagattaattgtgtttattactgccgggagactgcaaagagtcttatttttagttcataatagaagcttctgtaaccctttggatcatggctgggattctgcatttttattatagcaagagagctttgatgcttggatgtgttagggaaggatagccatatgagaacgtttcgtagagccaatctctccctacttgttaatttggcacctctcaatcatacatttttgaaagcactaattatttcacataacatgtaaatttatatagcatcttatatacaattttaatgcattcagatccctaaagctataattcattatagcatcttattttatttatattaatatatgtgccttgagttaatactctaatcatttgcaaactgaagctttgtctcaataaatttttactttttgacaaattatactacattagtttgatatatttgcaaaatgtaagtacctgcctttcccattgcactttcattgatattcccaaaacactgggacattgctagtccaacaggtatattgtggaccaacatcttctcaagtctgcacaaaaacattttacaatgtcattatctaaagtgttcaactttcagttatttggaatatgccttctgcaagcctttttttttcttttttgagatagagtttcactcttgtcgcccaaactggagtgcaatggtgcgatctcggctcactgcaacctccgcctccctggttcaagagattctcctgcctcagcctcctgagtagctgggactacaggctcatgccaccgtgcctggctaatttttgtattttagcagagatggggtttcaccatatgggccagggtgaaaccctaggttgaacttctaacctcgggtgatccccctacctaggcctcccaaagtgctgggattataggcatgagtcaccgcgcacggtcaagccatttgttttttataggatgctgctgcttgaccaagtttgaatatgctttcattccattatgccaatgtttatgtattataaagagatggttttatattataatgtatttttgtcgttgttgttgtgtttgttttatgagacagggtctcattctgccgcccaggctggagttcagtggccaggctagagtttagtggcactatcatagctcactgcagcctcaacttccacggtacaggtgatgcttccaccgcagcctcccaagtagctgcgactacaggcatacatcatcatacgtgactaattttctgcagagatggggtttttccacattgcccaggttggtctcgaactcctgggctcaagcaatctgcctgccctggcctcccaaagctgggattacaggtgtgagctaccttgcccggcctataatgtatttctaataatacttaaagtgtgttttcatactgcccatgaggacaattatatgaagtggttatttggaataaatatacaagaaatgttctatatatgttacagaaatctttcaaaactgctttgaagagaatggcactagggctggattaatttacaacacaaattccccattttttggtgtgttgggccatgcaaatgaggagatagtcaggagatcatatagtatcaaagtgtagaagagatgtggctttatgggatgtggtcactgccctttgaatctgagtcaggtatattgaaattcccacctaggatttcctcttccttaatatttatcttctggacttaaaaaagataaaaactttcaagttgtgtttgtgccagcaccattgagaactgctactttactgtgaccttaaaatgggttcttatgtctatttctcaattaattagaggccaaagggaaaaaattggtgcatggtgagagagaaaaacctctcttaccaaacttccattgtaggtttgtgcacacattcgagtattatgtctaacaatcactactcatgcaagtttgtatcctttccattcttcttgaactttaggaggtttatatcaggtaccacttgctggagccatctttacaccccaaataagcccatatttcctatgctgaatgatgctatttgttaggtaatgggagaggtcaacatgaccagggtgaagggtgtctgctggggaggatggagaagtagggctgtgggctgagggcgagtttatgttggggcttggcagctgagcagagagattgcagctgatgcaataggaaagaggatccatggagctttggggcagatggtagcaaaattgggtttaagggattttgcctggcatggattagagaggagaaaagccagagccagggagataagtaaagaaaagaaattctggccaggtgcggtggctcacgcctgtaatcccagcactttgggaggccaaggcaggtggattgcctgaggtcaggagttcgagaccagcctggctagcattctgaaaccccatctctactaaaaatacaaaaaatggtggcaggtgcctgtaatcccagctacgcgggaggctgagtcagcagaatcgcttgaacccgggaggcggaggttgcagtgagccgagattgtgccattgcactccagcctgggcaacaagaacgaaactccgtctcaaaaaaaagaaaagaaattctcttgctgggagttttattatgcctatctcaaacacaagagccagaaaccatatcttacaaaatcatgttccctctacaccctgatagcataaaaatttcctcgttgtctattcattctgcatgagccaacacaagaaagagctattggtgtcattgccgggagcggggataccataagtttcttcaaagacagacaccaggactttcatcttcacatctatagtccttgaaatacagcaggtcttacaaaaatgtttgtcaagggagtgaatgaaaataagagtgaatgaaaatgaaagcaaaatatacttgaggatatagtttttcctggaccacaagtcaaatgccaatggataacttcagattcctagccatgcatctttttctctgagaactggatagccggaataacagatcactccatttcctttctgacatgccacattgaatgaacatctgctaacaaccagaaagtgcatgaagaagtttgtccatgaaatcactccatacccaagtggaggagaaggagctgtggactgaaggtaagctgtgcattccctcagctggcaaatgtcaagcccataatctgagcttcgtatgtaggaaatacctacacacgaagcccacctaggtatttcctcatgcaatgagaaatacaccagtatggggacccatgaaaaaagcctgccataactctgataatgatttattttcaaaggcagaagaaaattttagaaaacatataaataagatatatgatagaaagtttatacattcagaaatgtcagtagattaaaaatcaaagaaacaggctggtagtaccaatgtctcacagccctccgggggagctgtggccagagccaaaggtcagagcaaaatgtggaaaatcactgacagactgggaccatgggcaggaagccttgaaggatttggtcaagcaaaggcaaaactggagggtaggatgcctgttgagaagacctggtctaactatggccacattggagatgcccccggaggagccatggagtgaaagttaagggacctgagccaaagggtcccaagtccagaggcttatgaataggaaccaactctttcttggtattaaaggggcagccctctgggctggttggctggcttttatccaactgccctagacctcaccacttactactgaacatctttttaaggatctctttaaatctacacctctcttttagagggcccatttcttagtggaggcagtgcaacgggaacaaataatgaaacagttgaattctgcttcatccatgtctgccaagccacaagaatggtaaaggtactcacgttccacaaagtacgagctggcatcgatcttccagatgatctggccccgatgagaaccattgactccacggtttttatagtccagaaagttttcggacaagacctcatctatattcccagaggaagaaagcagagcagagaaacatatcagtcaacagcatatttaggggaataaaagaaaagcaaaggatacaaatgctgcttccatctcaacagaagaaaaagcacctggaaccagagaatcagagagcaggaagcaccccaagacgccattgggaccaaacgctttttatgccgggatcgcctcccaaccccatagcactgctggcaggagatcatctagctggttctggaacacctccagaaacagagaaataattactgctatcgcggttcacttcacttttaaatagcttttctatgtgtgaaagctcagtgtgaaaatcttcctcctaaagcttctatgaactgatccctatttgagcctaagggcgagacataaagaaaaaatctccctttggggtctagttctcacggactccacttcgaatcatctctcctcccacctgggcatcaccaccatcctatacatggtcgcacccatgaacttatccatccatccatcatgcactcatgcattcattgttcattcagcagctgaaatctaaccatctgccagatgctggggaaggtgcaggggctgtggtgttgggcaaaaccagtatggtctcttctgaaccaaagcttacaaacaattgagaagacagactgtaaacactaagcaaaggaataaatgtttgattgtaacttgtgataagagatggaaaggaggcggggtgcagtggctcacacctgtaatcccagcactttgagaggccgaggtgggaagatcacctgaggtcagcagttcgagaccagcatggccaacatggtgaaacattgtctctaccaaaaaaaaaaaaaaaaattacaaaaattagccaggcgtggtggcaggcacctataatctcagctatttgggaggttgaggcaggagaatcgcttgaacccaggaggtggagtttgcagtgaaccaagatcatatccagcctgtttacatagcgagactctgtctcacaaaaaaaaaaaaaaaaaaaaaaaagaaaagaaaagaaaggaaaagaacagggtgctgtgatagagagtgacaaggaaggaggccggcgggtggggggcgggtggtcaggagagcactgagggaggagacgaggcctgggaggagctctgggtgacagtgtgctttcacctcctgctgttctctgctcatcactttgcaacctatcgatgttctctcttttttttttttttttgagacggagtctcgctctgtcgcccaggccggactgcggactccagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccgtgttacccaggatggtctcgatctcctgacctcatgatccacccgcctcggcctcccaaagtgctgggattacaggcgtgagccaccgcgcccggcccgatgttctctttaaaaccagtgcctggagagaaatgcggcattcttgaggaggacagatctgagaataccaagctgcctgtcacctccttggttccagaccccacactttcagtgcagactaagacagggatgtggctttcaccttgatcttctatggagcccttgtagtttccacttcaccagaaataatctgagctaggtggatctgaggctgtggggaaaaccaagttttgagagtccaaatccaccgtaggggctggagggacaacctgggcaagggcacctgagggcaggcccagagccccagctctgcagagagcccttttcatgattgcccttttctctcctgacaccctgcagttcacatgctgcatctggctggactgagaaaacagacaagagatgaagtgcaaaaagcactgagcttgaagccaaagggcccagctcttgccttttgtgccatttgccaatagtgtcacttctatagtctttcttcatctgcaaagtggggagtacttacaggggagcactaaatgagataactggtaagcctacttgtaatctgctatgtggattgcacattttaggctgccccttctctggcaaaaaaatgactgggcaaatgaacactcattaccgataagaactgtttgtatcctttggaaaatcgcttgtttgcaaaatttgcctgtctttttattcacagtgtgtgctcacagccctgtttgggttaccatgaagattgcataatacatcttttacagtaattgcctcatttctgcaaaaaggcataatattttcctagctccctgggtcttcagcagagatataacaagtttcacacccaggtagaaatttgcctcattatagcagttctccaagggatagtatttccccgaatttctccactctgatcactgggatattccctttaatagtcagggtcagggatttatagacaataacacctggaagaaggatgtccattcatgcatgagataatgggtattgggtactttgttctgttccagacatagtgctaaaccctggggatacactggtgaacaagtcacggtctatgttctcagggagtttctaatatatttggagatttattcaagaaaacaggtaatttcattagaatatagaatgtacaaaagggggttaattatcaaggaaccacaggaacatgaatgagaaaaggatgaaggggaggtgggaagaatcagcaaaggatgacgaggatggcaaacacacacacacacacacacacacacacacacacacacacacaataatgagaaaaaagtatattttgctgtacacatttaaacacaatatattttaaaggactggctgttagtcctgataagcatccccttccctcacactaacaataacacttaatcacaagtatcacacaagaaaaatagagtagtcagtattcttgcctgggctgagaggtcaaacccttccccaaaggcatttgttaccagttgttagaaaagttactagtctttgcttaggaatcaaactgcattgacagggtcagctgcagaaatccaaaatcagtctacatattttatgcagaaagggatttaatgcagggaattcagggctggagaagtggactctaggcagggcctctggaatcaggataactgcctaactggctctccaacgaggctgatgcctttgcctcactcgcaagggctgccctgggacctgctgaatatgaaaactcagtacagtcactgcaatctggagggcaggaggctgctgtccaggccatggcggctgtctctccaccggcgaagacagtgaccagccagtggcaagcggagtaggtcactgcctgcccccacccccactgcctgttggtgtccaggaagctagagagtagacacaggatgctgctgcagaaaagctccatttctcaaggccatgcttgtagcagccacaggcccaagagcctggtctaagaccactagctgtattagctcaaggaatcctttcaacaagattttgaggtaggtgcttatagtatttatccctattttgtagtgaatgattaaataaactgcctaagatcacatagtaatggtagatgtaagcttccccacatttcacatattcaccttcccgatcttgcacaggtgcagctaaatgaatcgaatttgcatccagaacatggctgcatgggagtctgggaaatgtaaatttagaggaccagattctgcactaggggaaggcacaggagatgagaggaaagaagagagtagaggggaggagacgggacgggagaggagaggagaggaggggaggggaggagagaaaaggggaggggagaggagaactggaatggatgctgtgggccaagccacactctccacctcagtgtggaatgggtgctctaggctctctaccaggaggctgttattttctgcattcttgtcatgatggaagcctctttgtgggagcaatattacatcccctttgaggcaggaagcttacatctaccattattatgtgatcttaggcagtttatttaatcactcactacaaaatgaggataaatactataagtacctacctcaaaatcttgttgaaaggattccttgagctaatacagctagtggtcttagaccagtgtccaacatctaataagcagctatttctgcttagaatctgggccaaaaatagggccctctattgcaaatccctatgacacttactatgtaaaaccattaataataacttgaagcactagctcacatcagtactgttcaagattttgtcatcgtacattttgtacataacatgtacagaaaagttcctcaggaaaagattacattttctgagtggtatgcatttcttctggtgtgtagaatcctaccacctgctcctcagtttataatagagaaaggatctttgtggattattataattttaatcagaaaggtctaataaagcttacagaaacagacatacctaagaaacaagtaatatattttctctggatttgtcttcaaaataaaaatcatagctatgatttccatgccataatctataatagaagagtggacaacaaacatgctattgctgttaagagtggaatgagcaagtgagcccataactgattaaaagagagaatcaatatactacccaggtctcctacacccatcagaaaaaagatatggcttccatttttcagagtaattcatgctttctgacaaccaaatcttgggaaaaaatctcccaggattctcccactgtggctggaccatgacttcactaaataatgggacagggccaggcgcggtggatcacgcctgtaatcccaggagtttgggaggccgaggtgggtggatcaactgaggtcaggagtttgagatcagcctggccaacatggtgaaaccccatctctactaaaaatagaaaaattagccaggggtggtggtgcatgcctgtaatcccagctacttgagaggctgaatcaggagaatcgcttgaacctgggaggcggaggttgcagtgagctgggatcgtgccattgtactctagcctgggcaacagagcgagattccatctcaaaataatagtaataatgataataataataataataataataataacaataataatgggacgggagatatggggagaatctacttgtctttcttactactaggccaatgatgtagaagcgccattctcttgcagaagcaggaactctaagcataaagtgatagaggagctcctaaaaatcaatgccactttctccccttctgtggcctttccttcatattgtttctttggacacaagaattctgtttgtgccttatacagcttctgctcttctagattctaatagggtgcctgatgtaaaggaaaaactttaattcttcaagagttgggttccataaatcagcagccacacttcaccctctacatccaggtatcttccccctcttatgtcagaacagtcctatttgctttgagagctctagaagtcctaccatgctgaaagcatcacaaccctggcctctgctggacatttgatggcacacggatgtgccatggcccatacccaacactgcaccacaatgctgtgctacccctgtggcagcatgagtcctgagccaggggaggcagctgtgtgactgtgggagccactgattcgacatctcctcattcatgaaatgacagatgagatgaaatcaccatctctacatttctcagcctagatctctgatttgatctctggcaaagcacggaaaatgtggaagataagctactaaggacttacacattattgacttttaagattcacagacaatttcggatttggaagttatttttgaaatgctatgccgttgaaagtgttggcattttgcattacataacttcacagttatatatgtgtagctacaatgagaataacaaactgtcaaattaaggttctaggatgataagttgtggttacttttgtctcagtcaaaatgtcatgttaacaccagatcttattcattcatggagtttcgtaatacctgatatggctacccaccccctcctctactaccctcttctttgttctctctagtctcctggttatcctgccccttcaccacctcctcttcttctgtttgagttcctcgtctgcctctcccctgccccctctcactgtgactatctggtgctctctttctatacacaacactagagtgagcttatccacccccaaggtgtctgttatcccaaatctacaaccctagctcggatccctggttgagcttcagaaccattcattcattcactcactgtggacgcacgtccctcaggtgttccacactcagtaattccatcttgagctcattaccttctccccaaacaggcttctcttccagtgggtacctaacttgaggaataacatcagcactcaccagctgcgggaagatgcccttgagttgactcaaaactagatctgggctgggcatggtggctcatgcctgtaatctcagcattttgggaggctgaggctgaaggatcacttgagccctggagtttgagcctgggcaatatagtgagactccatttcaataaaaaaccaaaccaaaaaacaaaccaaaaccaaaaccaaaaccaaaccaaatcaaaccaaaaccctagattcggagcctaaacctaattgcctcaagtgctaaacaaaagacactcatgatgaaggtccgaatgggtgggaggggactgtggcaacactgaaggttacaggccagtctagggagggtgcagacgcttaactccagctgattagaaccatgtggtatcacaggctcaggctgccaaattggaggcttttgtgaaagaagctagaaagttgtgtttcaacttgaaacttctacattttaagtgtggataatcaatcaaatttaaaacaaaacaatgtaaatgaaacaaaatatgcggccgagggcagtggctcacacctgtaatcccagcactatgggaagccaaggcaggtggatcacctgaggtcgggagttcgagaccagcctgaccaacatggagaaaccctgtctgtactaaaaatacaaaactagccaggcgtggtggcacatgcctgtaatcccagctacttgggaggctgaggcaggagaatcacttgaacccgggaggcagaggttgcggtgagctgagatcgcaccactgaactccagcctgtgcaacaagagcaaaactccatctcaaaaaaaaaaaaaaatgctctttaggctgttattttgcaatctctgttcttaatctatagtatctacttttattcaagaacaattttttttcagaaataaattgaattttaacttttggaaatccagttcagctagtcacagctatttgtgtaaaaatttcaacaatttatgtacctccatctttacattaatgtgtgtattataaacgcactaaccaagctgatggaaaaacctttaagagacccaagaatatttccctgagaactagttagtcagctaagatcccttttattttatcagaaaaactgtgcaggttgtaaactactcataacaatccattactttctgtgatgttaaatccggtgttgtgtgtctgaatgtgcaaatgttgcagagcacagactgaaggcagaaggcctggcctcggatgacccggtgttgaatctgttgactcttgtggccttccagcaattataactcgacttttgggtaaacacatcaatttccatgacagctgattctatcacataaaatagatgaaatacatttttcatttaaattggttttcataattataagattttcaaaaccaatccgtgggaatggtgaaactttcataaaaataattgcctcagcatccaacttatttgcataatttgttttgtttgcaaagacctgagaaaattcacatagaacaatttcttctagtaaactttcaactttggaactttcaaaattttgaataaatctccacctaaagtaaggcaagtcaactttctccaacaccatgcctgtatgcctgtgagtataatcccagcttgtctgttgaatacaaagcagtaagaatgttggaagagctggcaaagattatgctggaaactaaagtgaaattacctctacatacattggttgggcatatggtgttactttgtcttataagcacatagacttaaaaacaggctttgatattaacttattcacaagtagaagagcttctatagttgcaaatgataatgacatttgtgtttaaccacacctgactctgctatatctcatgattttcttccatggaatggagatggcaagagagaccttattgtccattttgcagaaaaacaaggtcatgcaacagtggtcttcagtgtgttagaatctggcatataacacagttgcttgtatattttaattatattgtagagtttattaaaatgtgacagcatatgtaaaagtgaattatgaataatacacttggcacattctactcaccaatgaggtacatgccaatccagtccccagcgtccacttcctcctttatgtcccagtggatgaccaggtcctgagagtgcccgatggaatagtaggagctgctgaccatgagcgtggagcggctgtccgaggtgaccaggtcagtgtcgctggtggagcggggaatggtgacgccatcgtgggggccgcccctgaggtccatgttgtggaactggtcggggttgtagctgtatcggagcggctccttgcaccggcgtcggctctgggagtttctagaaggagacgccatggcggccaggcctaaaaacctgttctggtacagattctgtgggagcaaagagacagtgagcagggtcagggcacgccggcaactcagtcaccgtcatcacacgaaaacgaaagatgtgctgggagacacgcgctgtgagtgagctgccctgctgggcagatatgaaacatggcatagagcatcttcctcgtgacaaaggctgcagctctgggttcacacggggacagcaagaacaaaaacacaagtgcaccagggtgtcctgcgtttccatgttttgttggagtctctgcctctcccggctctaacccacttgataccagaaggactgggatgtgcagaatgaccctgaaggtgtgactattccccaaccaaatgccatccctcgagttctccaacgtcaattagattggatctgattttatccttctttaaggcaaacgatgattatcattattaacctctgagtgatccctgcagcattcaggtccctacacacagcccagaattaggagtggtccctgctgggtgaggcagtcactcctccatttacatctttcactctacagaatgccttcgggctgtatgaagtttctatgaaggatttcaaacatcctagtactctttgaatacgatgattttcaataaaatccaatctcagaggactgtatctcccttggagccaatgttattgtagaaaacattgtacctgatgagaaaaaatgcatttttgtattgtttacaactttgagcacttaaaatgagccaacctgatgcagagcactaactcgttttgggcacagataactttgaaaatacagaaggacaggcagcaaatagaactcatgcagaaacaagcaagggtgattctgacttcatcaaagtatattaaaattgcgtttaaatgaacatttttggggggtcctggttattgaagttcatgttgttctatatgtagttttcaagaagagaagattaaggcctaaaaaagtgttgactcatgaagtttagatcccaggaactgtaacttcttatgcacctaatcaaatgcaaattattgactttttgtttaccagctatgatgagcagaccacagcaatagtctactctttcagttagatcaatctagttagcagtaatttaggcctgcactttttccatcctccaagaccaggatgttgtaaaaagtctattagcctgagaaagcacagcgttggcattctgagtcttggtcctctatggccatggggcaggcaggccctttcactcatctgtgtctcctgtttggaattcctttggccctactgatggttgctgcagaattatgacaggcagacaagacagactccaaaaagcatctcatcaccttattggggccatatttcttattttttcaaaatgcttgtcactatagcagtatgaaaatagatggaccatggtgttgcctggaaaccatccctcctctcaggaagactggcaaagcgctgaaggccagggaagcaggaaccacccacctatctcaaggcaccatggctattctgggcagttcagggaggatctcagtaaactgacagccctccaggaggctctgtccagagacctttgtaaaatccccaaacagaaaggctgctgcaagagcacaaggtttgtttagttcccacatactttaagtgggctaataccatcttacagtattacagagattcaaaataattatgaattagaccataatcaaagctgaggcagcatctaccagcttcccagctgtgggtctatcactggacaatttaatctttctggacctcggtttcctcctctgtaaatgggctgttgtcagaatttaatgagacaatgcaagtcaagttcttagtacagtacctgctcaataaataaaaatctcttgctaagatattactggtaatgctttaggaaggaaacctcactgagacatagggcctgggcactcagccaggctccgtcactgaacaggcttccttcatgtcaccccagagtcctcactcttatgaacttgcattaaattcaagaaaccttcaggttttcttacaaaatcaaagtgccaagggttacacagcctagtgtgtttgtaaaggtgctctatatactggtgctcaggggagaggctcctttatttgtaaggtttacgattgagtaggatatatttgcattcatgatgaagagcctaagataaagatttttatgtacgtggtttcaatcagggcctcaaaaggattgtagggtctttctcttttgctgaagacaattctgctattgtatttttaccaaaatcccctggaaactagagaactctcctgaaactgtcaaattacgccagtgatcactgtccacatggtgagagcaaagatagagaaggaaacattagtcaaagaagacgtttgtcagtgattactggattggaacgatgacatttgtccggggtaagcagggcagcctcaaagccgtcccttgcaccccaccctctcccaccaccctgtctttgcacacatcctccccattcctacttgcaggcaggatctgcacttctgcatcagaattatgctccagcaccaactctgctgtaaccgctccttgcctccttcccattcccaagagtggaactttctgctccatgatgcacaggaatcccattcccctgcagggattcttaggtactgttgctagttgatctgtccatgttcactcctacactgtgaagttttctcctctgtatatcccctgtacctggcataattcctgccatgaaaagcccccaaagctttaatttatagaaattattttattcagtgatatcccttcttgttccagaaagggtttaagatggcttataaaaatagataaaatggctgggagtggtggttcaggcctgtaatcccagcactttgggaggctgaggcaggtggatcacttgaggtcaggagttcaagaccagcctggccaacgtggcgaagccccgtctctactaaaagtacaaaaattagccgggcgtgttggcaggtgcctgtaatcccagctacttgggaggttgaggcaggagaattgctggaacccaggaggcggaggttgcagtgagccaagattgtgccactgcactcctgggcaacaagagcgagaccccgtctcaaaaaaaaaaaaaaattacagaaaggcatgataatttagtagtagatggtacatagaagaaaataaagatatgaacacaaagttatgtaggaaggagatgaacttaaaattgtattccatcatgtcctaaacagatgttttattaaagactcacaacagttgctcctttttatttttaatttcccagctttattgaggtataattgacaaataaaattgtatgacttttaaggtgtacaatgtgaagattttatatatatataaatatattatatgttatattatatataaatatatcatataatatatataaatatatcatataatatataaatatatcatataatatatataaatatatcatataatatataaatatatcatataatatatatatattatatattattatataaaaatatatcataatatataaaaatatatataaatatattataatatataaaaatatattatatataaatatataatatataatataatatattatatataaatatattatatgttatattatatataacatatataatatataatatattatatttatatattatatgttgtattatatataatacaatataatatataatatattatatatactgtatattatatattatatattatatgttctataatatataagatatacagtatatataatatataataatacatttcactatatgtgtgtgtgtatatatatatatatatatgtgtatatatatatatatatatagtgaaatgattaccacaatcaagttagctagcacatccatccctcacctatttaccccatttttattttattttgttttggtttgtggtgagcacatttgagcaaatgtcaacagttgcttcttgaacacagcaggtggatagagctgattgctcaacatgcaattcgtttgtggctatgtttctcccagacattcacaagtgtttctagcatatactatagactcatcagtctggaagaagcaatttaatcattctctcttcacatctgaactgtgggagatagatgaagctctgtcctgtttttaaatagccctggataaaaggccactgtcttcctagacagtgattccaatgtcttacaactccaccattcttcctaacctctaaagcagatctccccaacaggagacctcctttctctttcctctctgcaaagggtggccctcccaatctctgtatgtatgggaaatcaacggatatcactaaatttctcccagccttttctccaacccactaataactcaagtatcttttgtcttcttttccctttggtgatagacaatatgaactgataggaggaccacaagaatatcagcaatagtttcaataacactgtaattttccagttattggttgtaatcacgtggccctagttacgggctatgtcaagcatagattttagttgacgcttgaaaaaatgggtctgataagtgagcctctgagagcaatttaaatacactgtacaaagtgccctgctatgggagtaaaaaccatctgctggtttttttgtttttggttttttttcctatttgtagcagaagagccaccaatgttttgtttatttgttttgctttccaacttaaatgacatcgtaattgttgaaatgttttgaattaagtgatgtgctctttgttgtttttctttttttcttaatcttggaataggccttgtgggtttaatatgttttaagatagtctcatggagtatagcacattaacaaaaacaaaacctgtaaaaaaacagaatcttaaaagcagaaaatcatcacttctagggatggaacatgttattatgcatggattttttttttaagaacctggagacaaaagattctgctctgtcagtttttatctaactaagtcattaatagcatttctgtcttggaatataaagccgtgagtgagtgccatctcagaaatgaaaagaaagcagacaaaggcatgtctataatagagaaaatgactcttaaaaatggcctctacaccaaggaatcaaaaattgtaagcgaaatacacagcccttgaaggaagcttcattaaagtatataagatgaggttatagaaactggcattacttagttggaagaaagaacgtaatacttttttagtccatgagcagattttactttgatcaagaagatgcctgcagcttttgctatcctacactcggctttgttacgccaccaggtgggtaatgggatttaaaaaaaaaaaaaatcaaagcttatctttttctacaaaggatttgagaaaatttacaaaccaagaaatgtataataaaataggaaaatacaaaacagacagaaatcaggaagtagcaatatgaaggaagacaaaaatagttctgagcatttgctctatgcagcggactgttgtacatctcattaaaacattatcaaggccagacatggtggcttatgcctgtaatcccagcactttgggaggctgaggtgggtggattacctgaagtcagtagttcaagaccagcttgggcaacatggcgaaacctcgtctctactacaaatacacaaaattaggctgggcagggtggctcacacctgtaatgctggcactttgggaggctgaggtgggcggatcatctgaggttgggagttcgagaccagcttgaccaacatggagaaaccccgtctctactaaaaatacaaaattagccaggcgtggtggcacatgcctgtaatcccagctacttgggaggctgaggcaggagaatcacttgaacccaggaggcagaggttgcagtgagccgagatcgtgccattgaactccagcctgggcaacaagagcgaaactccgtctcaaaaaaaaaaaattagctgggcgtggtgacgggcgcctgtaatcgcagctgctgaagctgtggcagggagaatcgcttgaacccgggaggtggaggttgcagtgagccgagatcatgcactgtactctgtgacagaatgagactctgtcccccccaaacaacaaacaacaacaacaacaacaacaacaacaaaacactatccagtttcactattctcaggttgctagaaaacccagctcagaatgttaataaaaattctgaggtcatccatcgtgtggcaggaaatggggatttgagcctgtttatgggcgattataagagggcacttttatcattcttaagcattctctccaaattataaaacagatggacagaattgcagtaattgagattcagatacttctctgagcttctcggcagccaagaagataaaaggaaagcttagttcttatgatcagaatacagggacttttttcttcctccaagttcttaacgaaatgtttcatcttagactttctgtaggaaacacaatgaaatgtggtgagtaagatcttaagagacttttaatcacgattatagtggcagattcctggtacaaggctttgacaaaagccaaggtcatcgcaggaagagagttcattagggactgagcgactgtgctgtgttgccttccgaccacattccaaagtctacctggctcagtcacttctaggggaagctttaccccaaagcttccactctgaactcagtgactgttctcagtcccgcagcttcctctctggcctcaatggagatttcgatcagagcctgaatgagatgttctgtctaaaactgccttacctgtcaacttattttttgtcagtcccctctacttagaaggcaggcaccaagacagcagcccagcctagctcctttaggtctgcatttccagcaaaagtagtgcctggcaagaacatagatgatgctcagtaaatactttgttgaggctgggtgctatggctcacgcctgtaatcccaacactttgggaggccaaggcgggcatatcacctgaggccaggagtttgagaccagcctggctaacatggtgaaaccccgtctctactaaaaatacaaaaaaattagccatgtgtggtgacacgtgtctgtaatcccagctatcccaggaggctgaatcaggagaatcgcttgaaccagggaggtggaggctgcagtgagctaagattgcgccactgcactccagcctgggtgacagagtgagactccatatcgataaataaataaataaataaataaataaataaataaataaataaataactgtgttgaatgaatgaatgcacttgtgggtaacgtgtgggctggggtgcacctggacatggggctctgctccttgagctcaggaattcttgtaagcactaggcttggtgcccagaattgctcgaattgagttcctggttcctggactgcactgggatgggtcaggtgtccggatgcaggaccagcagaagcaccgggaatccctgaggcagtacaggagaagtggggatggcctgggttggagggtttggagacaggccagggcagctttatccagagctctacttgctgctgggccctgctggtcctaacagtctaaaagcagaaacctcctacccaacccaatggcaggcacaagagatcacaaaaatcactgcagcccacgcatttcctctgagtcacgactgttaagggaaacaattcgttaggctaaaaagaagggctccacctctctgggaattgccttcatcacctgtcaaataagaagaaagtgttgggatgagattaaatactgcccctgggtcctcctctccctctcacatcctgagatttgagtcctgcttacccatttgtacctctgcttgggaactgctgtgtatgagggatgttgtgggacaggggcgggtgtaggggctctcaggtgtaagggaggagagtgggaggtggctgctaaaccaccatctctgtctaactcttcagctcccagacacctgttcctgaaacctgtgcctcaatttgtgctttcagcctcaaagccatgtgctaaaaaagctttcttttgtgctggccattgtgtggaagaatatcacagaattacataaactaaattgtgtgggcttcttttctttgaaaaagaaataaaatcccactcattgctggctgaaagggaacattagggggagaaaattttaataagcaaatcaagccaagccagataatatccacacaggaagtcatgatttaaaatacaaggaacttgttaaaatgccagtcagacacattattttaggaacacataatgccttatcgctcataaaaaaaaatccaccaataagtgtaaggttgaacatcccctcccacttttgactctgcagccctttgatggcaggtgttggggggcggggggtggggtggtctttgctccttgtcgctcgcacaccattctcactcacacgtaagagaaaccagctggaggccaggctccaggaggggcatgattggaccattcactgctttgctcaagtctaggactgcttggtgcagctctgggttatttgggaggtttatgtttggaggcgttcagcagcgaagttgctgaaatctgggtggtttgtatgggcagaggaatgggcagggggctgtgggtgtgggagagggaggaaggtggcagccaggagggcctcgtcaggttagctggggcaaattcctgttcataatatttagcacctcctctggtttacacagaaaggaaaggtgagaactggtattcctgtgtgtgtgtgtgcgcgcatgtgtgtgtgcacgtgtgtgggtgtgtgtggtgtgtgtgtaagacacagagacagaatgaatgggaacttacagatgtgagaaagagacccatttttcccttctcaatgttaggaaatactgtttcttcctcaggaaggcactagcctgattgaaagtggaaaagtttcctctttacctactgatacctgcagaggaaaaggatatgtgttcacctcccagaaccacagtgcggctccaggggcccaaggcgcccagctccaggagccctgcggaccatacaggagagaaagggaggtggagctgctgtgagccagccacatcatcctcccggggcggccccgtaccgggcatttgtgaggagcccccatgatgacctcagcctcactccatcctgagcccagcagggcttgtgctgtgctgagtggggtcactgtgcctcttcccgtaaccagggcaccaccacctgcttggctacagtccagtctccaaaagccaacccacaatactgtgaatcacacaggaacccacagtgacagtcatgggagggttctgggccagcccctcctcttattcaccgggaagctgaagcctgagaagggcagctgcctgccctgaccacgcagcaggggagcagcagggccccaagtggaccttgagactccctgcggccagttagctgcctcatccatggcctgagctgcctggcttgggagggagcctcaggcttgttgagaagcctgaggagcctcaggctgttgtaagccagtgtgtttccctcctccattcatggtcgtgtcctcatttgcctgctattaggtgatggggccagacagggattacagttctaagaaatacacttaggagggtttcagatgcagtgctgagtttgtatcctcattgaaattaatactcaaaagcatgttatcatttgtcatggaggatcaaggtgctgtaaagatgctctcttttaaattcttatatcccctgggtggtttgacccagcatctttgggtttatttttaagtaaatcctgtctttggttttattctcctgcttcttttttttttttttttgacagagtttccactcttgttgcctaggctggaaggaaatggtgcgatcccagctcactgtaacctctgcctcccgggttcaagagattctcctgcttcagcctcccgagtagctgggattacaggtgcgtgccaccgtacctggctaattgttttgtatttttagtagagaaggggtttcaccatgttggccaggctggtcttgaactcctgacctcaagtgatccaccttgacctcccaaagagctggaattacaggcgtgagccactgcatctggcttcttcttccttcctttagcccagtcaatcaggaaatgtggatggagtctttagtgtgtaccaggccttgtgctaaatgctgagtatggatacagagaggacttaaacagtgctcatagcctcggagagtttggtgcaggaggcagacatttaagcagtcaactatgacacaatggtgagggcaataatggggtggtgggcatggtcccccctagaagggagagagatgctgggaccaccttcccagatgggaggacatggaagctggacctggaaggaaggggcaagagctgagggaaatccaatctaagcagaaggaacttctcgtggaaaagcgtatctttactagaagcatgctgagcttccagattcagcagagctcctcttagctgtctgccagacagtgttgggggcagctggaagtgtgtgaaaggggtctcccatggcacaccaagaaataagaccttctccattggagagtggggggccacggaggttttgttcaccttagaaacttcacactgcagcaatgagggggagagcaaggtggacagagctgctgtgtcttggggagcccaagtatagctctcctgaatgccaaggtctacatgcagggagaagctttaccaatcaagtggtccctcaagtctaaacaagtggcaccgtggcagaagttactgacaaagtagcaggggcggctcctgggcgggtgcagggacagtgtgcagctctcacatcagtgtgggaggtcatcgtacctgcttttccagatcacccatcaagccagaagaaggccccatgttggactgcagctctgataagtgtgccagtcattgggattatgaaccataatgcccatcatcagtacacagtggggttgaaccagcagcagcagcactttccttttgtgatcaaagtgccccggatgaacacggccatatctgatataaattcagtgttgatgtctcagagcatttatgagagcaacttagagccatgatgaagagtgaagcaggcatggccgttagcaatataaagtcatctctctctcctacatttcatacctatattggcaatataaaggaatctctcgctccttccacccttcttccaccctcttctatccctcttccacccttgaaaggagacaaagccagttcatattccagatggggccacaggtagcacgttccttcccaggttccttccctgtcatcactctgcccactcttgtgctctttctagctctaactgtcactcagttccaattctggctgccacacgccttagccacaccaggctgcaccatctcagcagcaggctgtgataggaggactggcagaggtggtttacctcaagagattcctattggaagaggaaggaaataaggaagaactggcaatatatgtatagaataggcctatctgtagtgatttaggatagaatgggggaattgaaaggataaggaggagaattaacccaccagcacctccgtcaagctctcaacattgatagaagaaagaaatcacaacgaggcaaagacaaagccttgctttttaagtgagccacagcagaatggacacctgtctaacagagtaagagctccatggggaaaagtccaacagcatcaagatatccctgtgatcaaaaccagcaaatcaggtgacctagatgagtggcatattgctttattagcaattattcaggggaatggtaaaagaaaggaacaattctattttgaaaacaaaaaaatgggatttgatactcagctctgacagcaaaggagaaatgatcactaagactctgtgatgtgggctgggagtgtggaggaatcacctcagtccaaagtttcactgggttctagaagaacattaaaaggaaggggacacttagctactatgatttcttaaacgtctcaggcgacacttactgctgaaattctttaacatatttaacagaaagtctcttctgacattttccacacagctaatctttctgatttttcagagctaaaaggaagggacaacaattgaggcagtttggaaacttttttttttaagtctttttctcaattatgcaggactaaacttggaacctttgaactcacggacaaaagctatagtctgctgtgggattttggacagtattttcaattttacagatgagggaaaaggcacggttttcgtgcagtccatctctattgcttagatgcccgtgaccatctcctaagcttgtctctgatacaccaaagatgcaccaaatatacaccaaagataccgggaaggtaccagccccacggcctctcccaccgattccggcctcgtggaatctttgctcaacagtgtagtataggttcacattaaattccatgagataaacagttgaattggtactacctccttgactctctgtagcaattatcagatggcaaaccgatgattatcatctcactaagacatttttcacttgtaagctgatgcttagacatctctggcctcgaggatacggtaatagattcaagggcactcactgccatttccactggttacaagacaagccatctatgtccagactaatagaaactcagaagtctcaatgatctggatattttagaatttccttttcatttgaggcttgaattaattattcagataacatctctaattttccattttttaccttgtatgcggaaaacagcagagattaaagtgcggtctcgctccagagaataagagctgtgaaaggagcctcgagatgtgggggcggcagacagagcctgcacctcgtggtaagtggtggcaacggagaccagctcattgcagcgaggcccctgacttgccattcacactgcttctcaggctttctacaaagctccaagagactaagtattaaaaggaaagtgagacaatgaaagtaatttgggtttttccaagaggaaacatcagtgctgaggaagctagagccacaggtacatgctactgagtcttaatgcctcacacactgcaagactagggctttgctctttgcaaaggacaggtctcattgccatcggttatcagagataaactcatcatgtcagtgcctcaattatgatccccagtcggaggctggcatatgactactgctttattaatactacttggaggcagttagaagcacatgtcagggggactgtaaactgctaagggtgcatttcccagcagggcttcatttatttattcagtcaacaaatgcacatgccaaaccctggaaaatgaactgaaatagaaatcatggcctctgccctggagatttaggacttattcgcgtgaaaatttaataactccaaatattctatggagttttccatacctaattgccaaaatgaggttgttagaagaaagcaccactgcagggagagagtggggtgaatattccagacagggcgaatggtgcactctattccaactagaatataaaggtaccagggcacatactctaagtcctatccaatctaaattgttttttttcctatttttccccagaaacagggtctcaccctgtcaccctggctggagttcagtggtgccactaaagctcactgcaacctcgaattcctggctcaagctatccttctgcctcagctttttgagtagttgggaccaccgtcatgtactatcatgtctggctaatttaaaaaaatgtttttctagagacaggtctctctatgctgcccagattggtcttcaactcctggcctccagtaatcctcctgctttggcctctcaaagtgctgggagtataggcgtgagccaccatgcctgacccaatttagtttttttttagaaaaatcactatgttgttttctagtgactccactgtatatatgtttaaattgccatcttataaacacactggagaagaatccttagagccaaacccaatgcagctgtatttttcagtcttagagtgtccatcaaaatctgggcagtaattttcatctcgattacaggagcagcggaggcatgatggatccttgctgtgactggtgcctggacatccctgccaaccaccttggagaatggcaccttctgagtgtgcctgaaccactcttctccttggctaccactctgagtactatccctagagactactggccacacacatccacagtctcaatgtccacagaagacattgttttgcagcatgcaaaaacaatctgaaagatgataaaaagcaattttcataattaataaatttctacctgctgattaggaagtgttagaaataaataaacaaacaaacaagtgtaattgtgacattttggcaagggttccaacttaaggactgaaatgtgcccttgctctgactgtatctaattcagttcaattgaacaaacatccattgaatatctattgtttgtaaagctctgggctagctgttgttcagcatatgatctctgttctcaggtcaaaacaaatgaggcagaaaaagctgaatgcatgagatgaaaacaaaattaaaaataaaacagccttcttcctggagattctaattcaataggctggatggggcccaggcagctatattttaccaagcatcagctcagcctggttctgaccagcaggcaagcactcagaaggaggccatcactgtctctaattggtggttgtcacaaaaagctgcaaaggggaggtatagtcaccttgagatatttcaacaacaactgcatgttaagtgccttgaaggcacaggtcagacttgggcaagtggaggacacagaagggggatgtttccagcaaggagcagagctgtggaggccgcaaagtgcaccctgaacggctggccctcttgagagatgtcaagaagaacgttgttggaacagttcatttctaaatgaactcatcagccttacttttttccattagttcgcatttggcctcatttctcaatccagaatgatgcaaaggagccataaacctgaattaagacaaacaaaagtgacatggataaattttccttggacatcagagcaccagggttgagagaggagagaggagggctcatgtttcaacttgaggcttccgcagctgcgtccacagctgcgccgccaagttcagagttgagcattcatgagtgtgtgtcttgtcatgaaccaggggcctcactgtcaccactaggaggacacaccatagaccttcctgggcaacaagaaaagctgagccacactctgcaaattccaaaggcctgagagaagtccagagtcgggacttttgaggaaaaccagtccatgctaaaaatttgaaaaatacagaaaattaagaaaaaacagcaaggccccataattatgtaacacagagactaccagaataattatgcagaaatatttcctgcatttttccttcatgcgttttacaagatagttgggaccacacatttttgtattctgcttttttaaatggttaactattatagtagaagaattcctcttatgtgattacaaatatatcacaaaattatttcaataaccataacattttaacacatgaatatttataatataattagcaaggtaattctatttttgtaactttaggtttctttaatttttctccattataagtaatgctaattaagcaggcatgaccatgggccaatgaaaatatctaagtcaaaagcagcaatttgtctatagatttgagtttttaaaaaatgattaaaaacaatacgtcaatgtcatagatgccactacttttggaaaacagtttattgcatctttctctgtttatctggtatgagtataaatgggcttacaatgaaaaagctcccttaccaaagtgatgtaggaattattgcttagagctatgagactgagagatagtgggatataaacaaaggtctcttctaaggtctttaaaggagctggaaaatacgtaggtcatgcagatgttccactgccgccaccagcccctcctccaccactcctcccctcccccttgggcctcttgcctccctgccctctggtcttgtcttcattctagggaaagtctccctccaacagcaggctgatccaggcccccctggggagtgggaccttctccgtattcagtattggtgtctgcatcaaggatggcatgacagtggaacatccctgaacataaagattgggagagtgaaaggaaaataaatctcaggactttaaaagcactaagccacagggaaaattcatgctgggaattgtcttgggccaacctgcctcctattctattcctaaataagatagctacaaagataaaaaagccatatacccccctcacaattataaaaaagctatatacctccctcacaactataaaaatgatatacacctccctccctctctcacaaaaggaaattccttgtggacaaataacaggcagaactcaaagtcgtccctctgctcacacgagacaatgcatacctgatttttttctttttttgccctattgtttcactaagccagactaaggcataagtgactattcctgtaaattgtgtattcagtgaaaagctaatcagaaactctaaagaatgtaactgtttttttcttatctgcctgtgacctggaagccccctccctgcttggcgttgtcctgctttccggactgaatcaatgtacatcttacatattatacaatgtacatcttacacatatagattgaagtctcacgtctccctaaaatgtataaaaccaagctgttccctgaccaccttggctcatgttgtgaggacctcctgaggctgcgtcacaggtgcatccttaaccttggcaaaataaactttctaaattgattgagacccgtctcagatactttctggtttatggggacaaaagcttttgaagtcagactgacctgggcttaaactctcttccacctgctgcacaatcctgaccaaagactaggctctcccaatgtcagcaggttcaatcaaataagtcctgaccccttcaggaaatgttgctacagccacaaaactggaagctgggactgggatggggaccgaggagccaagtattagccaggtgaataatctgcttttttctgactgcatccagtgagaccgggaggagctagttttacagcaacagtggcagctgattccccaggacttctggaaggctcctgggaggctgagtcacttcacctctctctgccaagaaaatgctatcttagaaacaccctccctctctcatcctcccccctccccccatgggaacagctagttgcaggactattgccattgtcttggagatcttccctgttgtggtcaggtcacctgtgtggatgtacacgttgctcttaaagccagttagtggacatgccaaaggcaccagagcctctgtggtcctaggagatgcagcaccctttttccttttgggagtgagcagctcaaagtgtttggaaaacagtgcatttcactgagaggtttccactgcaatgcacatgagagtttgcccctgcagcagcggtccccaaactttttggcacgagggatcgatttcatggaagacaatttctccaaggacagtgtgtgtggtggggggtgttttcaaaatgaaactgttccacctcagattatcaggcattacttatgttctcataaggagcatgcaacctagatccctcagatgtgcagttcacaatagggttcatgctcctacgaaaatctaatgtcgctgcttgtctgatgggaggtggcactcaggtggtaacgcttgcttgctgctgctcacctcctgctgtgtggcccagtttttaacaggccatgggctggtaccagtctgtgccccaggggttgaggacccctgccctaagggtttaaaggttatataatgcactaaaattaaagtttctaatttaaaaaacaaaatcctaccaccacactagaggctttcttcagatctggagcactcctttaggcatgtgatgctgaaggttgaggactgaagctacaagaaatggcgcattatttgatacacgtatctgaggcagcagaatagggtctggagacagggaacctaaggttgtttcatgccgacttcctaggactaaattgaaaggaaaaccctaactttccatgcttaagtaacaaaaggaccagaggctactccctttgaccttgtctgcactgcagatgggaatttggctgtttgtaaccaatcagactgattgtgggctaccacttcagttacaggaggtgagcatgaagtggccaatgggaaacctctagggggtatttgaacccaagaagattctgtattcgggcccttgaaccgctgctcgggtctgctcccacactgtggagtgtactttcattttcttttttttcttttcttttctttttttttttttttttgagacatagtctcgctgtgtcgcccaggctggagcgcagtggcacaatctcggcttactgcaacctccgcctcccgggttcaagcgattcttctgccccagcctccagagtagatgggaccacaggcgccttccaccacgcccggctaattctatttttagtagagatggggtttcaccgtgttagctaggatgatcttgatctcctgacctcatgatccacccgccttggcctcccaaagtgatgggattacaggtgtgacgtactttcattttcaataaatcccagctttcgttcttttgttgcttcattctttctttgcttttctgggcattttgtccaattctttgttcaaaatgccaagaacctggacaacttgcagtcacaaccctctactagtgacatatccagattttgccttgtactatcataggggctgagctgaagacaaagccctcacaccctgctaggaaagtttgcctcacatgcataacttcagagaagagccccgggtgctgggtgacatgtgctgaatggaagaggtatgtcaccaaaggtcaccttcctagctctgttcccagtcctcctctcctcacaccttgccacttactgctcagctgtcccctgagctccctctcaggctctgggccacacttgtgcttagtccttggtggggaatttcaggtgacacagcaaaaaatacaactggcttctattctactctgactttgtgaccctgggtattagttgggcttcagttgttcttataactacacctttgccctgatgccttgttatcaaggctggtttccaggggccttgtgatacagaggagagagcatgggctttgggtctggacagacctttgcacaagtgctggccgtaaaacttaactagcaatgtgttcttatgaaagctagttggcctctctgagcctccatttcatcaggtgaataaccatcctggctggttgtgatggggcttaggacacattatcctaagatatgattgtaggagaccagaatatgccaccccaaaatatgcctctttggcataaggattatttcgagctgtttattttgagaaactgcagatgcagagaagctctgaaactgttacccttttgtaagagaaatttacatctataaaggaaatctccatttgtaagagtttctctctctcagccccaggaagagaagggtgaccctgaatcactagagactgaattaatggagaaggcagggacttaaaactgcataaaaagccttacctttgtttaaagtgcttttcctggcctcctaatcttaactgggcctttccctaggcccttctctctttgtattggagaacgatgttatttaagcctgacttctaagataatactttgaaatctactcgagatttacccatttctctgagttttcccccatgaacagatgagatatacattattaaacttctgtttgtttttctcttgttaatgttaatctgtcttttgttagagggagtcccagctaagaattcataaagaactgtagaaagtaaaaagtttcctcttcaaagtttcctttgttgttgaagaataaatcgtaagtgttagaaatagtagtttcttttaaagactaacttccttcaagtttccttgctttgtgctaataactctttgttaagccctatcctatgtagctgctaaatataaaggaataagtacattctatgtccttgtactttaaccaagatatttgtgcaggacatgctcacaggaacgttccagcttgcagcctatgtcccttccctacttggcataagcaacttcctcttttcctttgttctcccttgcctttacctatttaaaaaaagttttaaactgttagccaatcaaattcagtttagattgtgaagtctagctccagccaatggatgcaagacacagcagtaaggatgatccaaatgcgtaaaggataaatatgtctgcttttcctttgttcagtgtactctcgtagcaagactgctagcaggtgtaccctttctgcagaaagtaaaaattgccttgctgagagaactaaatttatgttcgagtgctatttctttgcagcaccacggaacaagcattctgtttctaaataaacattgtacatataacagcgtggaggagaaaactatttttcccccctgcagatctaaacagtaaagggaactgaggtggggttctcttggcaatggttcatgttaccactgtgagtattctccatatgcagtcttctcttgatggaaacttcatcctggctcctctgggatggggtccctgcctcgtcctgctattctccctggactgaaaactgctcctggaacttcgttccaccatggctcttaggtctccaccatgacaacagctggcttggatcccaagcactgcctccctgggccccaccatgggcactcatgtgggggactccctgttggcttcagagaccctctgactgcatggactatcccctactacttgtcactggggctctggacgttatgacgtccctgtcaagctcctagggactgtaaaccaaaaataaaattcagacattgcccaactgacgggatggaccccctcttggccaggatgaccccagaggaacctgaaaaatggaattcccatccatgacaagaagggaggccagacatgcctcgttataccccctcccttctggagtttaggcacagctaaccagcattgaggttaaaaatcacaagacctctattttatagacagaacaggctctttgtggcaataagataccaataccaaattataaacaaaacctaaagccatgcaatgcaagtcacaccctacaaaccataaaatctcattaaacaggcttttaaaatttatcttggtgtcatgtggcttactttccaaactgactgtggtataacatcacatgacagatagcagaccctggagaaaataaaaatattttacccccaaatatatgtctttgacatcttttgaaatggccctgcaaagctgtcttttgagggggaaatctgcatctgtagagaatctacatgaatgcagacaggccttcactttccagacctttcttagatctaggagagattaagtaagagtctgacaccttaagttctgaaaagagacatttacaatctgtctttctgaagccttctaccgataaggcttcatctacataacaaaggccttggcctccacaacccgctttatcctaactcaagctttcctttctactgacttcaagtctttagacaaagctcaactctctcaaccaattgtcaactaaagaatccctaaaacccatctatgacttgcaagcccccacttcaagatgtcctgccttttcctgcctaaccagtgtacaccttccatgtactgatttatgtcctttcctgtaactcctgtctccctaaaatgtataaaaccaaactgtaaccacctgggccacactttctcaggacctcttgagattgttttccaggcagtggtcacttatattggctcagaataaacctctttaaatattttacagagttctgttcttctgttaataagaccacctatgggccaggccaatgggcatatgcctgatctaccaatggtggctggattactgtccccagggtcctcgttcctcctcttccacactagcccatgacctcctaaagtccaagctatcattcagacaagtaagaacatcagggaggtctcataaagagtctggaacccaacccctgtaagggtagagctgccactgcatgtagggacagcattagaaagtgctggaggctgggcgtggtggctcatacctgtaatcccagcactttgggaggccaaagcaggcagatcacgaggtcaggagattgagaccatcctggccaacatggtgaaaccccgtctttactaaaaatacaaaaattagctgggcgtggtggcacatgcctgtaatcccatctactcgggaggctgaggcaggagaatcacttgaaccagggagtcggaggttgcagtgagctgagatcacgccactgcactccagcctggtgacagagtgatcgatactctgtctcaaaaaaaaaaaaaaagaaaagagaaagtgttggagatggcactccattctttcactggatgggaattgggaaatgcctagtaccagccaggcactgttgtaggccatgggataaattggtgagttaaagagacaaaaggccctgcctgtgtggagcttgtatttgactgcgtatagcgcacctggatatccccgtaactaaaatataagaataaggcaagagaggtaggctggggccaggtctggggagccctgaatgtcagcagaagaatttgtctttgagctgaattaccaacagtgggtgagatgaaccactgcacatttgtcagaagagtggagaataacagggcaaaatggacttttagaaaaatgtctctgacaagagagggtgggtgaataatgacaacaaaacctttgcacagcattttccaatttataagaggctttatcagctatcacatctcacaatcctcctgggctctgggagtcaaataaaggctccactcagagacaagcctgggcactgagggaggaactagcctggggccacaggatgagtgagtggagagcggggcctcaaagctctgccttgtgacatctcatcttctagtctgtatatttccctttcctagcaaagactgtatttaccaaacacagtgcacattttctctttaaggagggtgttcaacttaaaattatggaaagctttattacaatgtttgcagaaaaatgtcaagagagaagaatactaccagtattgcctggggatttttttcaaatacacatggccaccttcctccctccctgctcccggattttgacagtgtcacttagatgtgtctaatttgcaagagctcctgtgactctactacctacagccttcactgcagcatgtccagctaattcccctcctcttctcattgagaaagttcagtcctggtggtttgggctgtgtgtttaattgaaaaagccctagagaaagaagagatgttaatataacactcttgatgaaacaagacaaggggaatatgtttcccatttgtaacacacagaaaatctaacaatgagtgctggtgggttgctttcctcaactatctctgtctacatggatatctaatatgcatctcaagcccacctccaaaaacaagttcttgattatcccagccttaaatgtgctcttccccatctccgtagatggtaactctattctttcaggtaccagactgaacacctagaggcatccttaatgattcttcacactcctcaggtacaatccagccaatgctgaaatgcaagctgtctaaatccagacaatgctggcttcaaaatctgccctgtcctctgaccacttctcagtctcccactgctatcttcccagcctcagccaccagtatctcttacctggtctatcaggtctcctgacttctatcttacattctgctctccacagagcagccagagaaacctttaaaaaacctaaatcagggatgcacatggtggcttatgcctgtaatcccagcacattgggaggctgaggcaggaggatcactctaggccaggagttggagaccagcctgggcaatatagtgagaccctgtctccaaacaaagaagaaaatgaaaagaactctaaatcagatcacatcccctctgccaaaccttccatgacttccttctcccaccattgcctccttttcccttgggtccagcaaccctggactcctggctcttcctcctgcccgcccatcacaaccctgcctcggggcctctgcactccctactcccactgccaggaatgtgcacccccagacatctctgggcctctggctctcccttcatcaggcctccattccagcatctccacagtacctgctcatctactcctccctaatcccctgtgtaacatcctttgccatgctcactctctttccctattccctgtattatttctctttacagaatttaacaccactgaaaacaaacatacactccgttagtttattgttcatttcctctcacaacaaggtacattccatgaggactttgttacgttcactactacgtacctccccaccacccccaaccatccttaaacaactccccgctacccccaaccatcattaaacaatgcccgggacacagcaaattactcaataacttttgagtggatgaatgagagaatgtcattgctatcattgtatgcaaattcttcaaatctattgactttcacatttcattagtatggacaacttaaatgatgacccatgaagttcagggtgcttcaacaaaaggcaggcattcatgtagcatatggagcttcctgaactctgtccacaattttcaaagtctatgtaggccgagactatgactttttagtagttataaggtgtgattctgggtgaggccttggttggtgatatccctcctcccaaacacctttgggggggtgggtggcagtttgaacttttaccgggcacaaaaatcatttaaaaagtgacaaacgaaaactgcatttgccaatagaagtagtaaagaaaaaataatagctgccatttttgagagcttatcatttgccagcacttttactaaatattcctttaaatatttactataatgaaactggcattaaatttactttcccagggtaaaaactgagcaatggtcaactggacaatcaggagaaaggaaaatgcagaagtcagcgatcctggttgcactacatctctgaaggtttgaggacccaagctagcctcaaaatcaaggaaggctgtcatagggcacccccatcataggcttgggcagtcttgatggcattatcactgggctgcatgctctgtgcttcatgtggtcccaatagttggatctcagaggtctcttttcttcaagggaaacttgtctgtttggactgtgctgatttctcatcatctctctgttcaattcatttctctacctgccctccctccaagtcatccaccctctcagggtcctgagctcctctcttgaaagcaagggcaataatgtacttaccctctggcttgtcctttccatcttggacatggctcgaaggtctctctgatctatctctgtggtctctgattttttgcaagccatatgacttactgacatagactaagacgtccctaactagttcttgtgtttagaccactggcctttgccaaaacttggattcctagtactttcagtataatctattacttcatgtctaagcattttcctgggattaaaaagagttagcttgctatctagctcactgtcatttatttattttgcccactcagtttctttattttattttattttattttattttttgttgagatggggtctgtcactcaggctggagtgaagtagtgcaattacggctcactgcagccttgacttcctgggctgaatagatcctcccacctcagccacctgcatgagccaccacacccagctatttttaaaaattttttaataaagatggggtcttgccatgttgcccaggctggtctcaaactcctaggctcaagcaatccacctgccttggcctcccaaagtgctgggattataggtgtggaccactgtaggttctttattttttatgactttgggtgggctcattcccgactgcactcctgatgaatggttacagtccaagtggcatatgactcatgaacttcagagatcctcatggacctatgcaggctgagttttgatttcctagtccagtggttgccaacctgggatgcatgttgaaatagcttgaagagcattaaccaatgcagatgtctgggtcctagcctccagggattctgacttaactggccagtggtgaggtctgagtatcacggtttttcagagctccacaggtgagaccctgatccagtttgtctacatatctaatcccaggaagctctcacaacaacctgttccatttcccccttttgtcttgagctgcattttactgtgtctataaatattgtcctagcaagacccagttagcagtaagacttgctctttttaaaaagagctggtccattttttacccaaaagttataataagttaatataactacacttaataaattcaaatatgagaaccttaaagcaaaaaaaaaaaaatccatacagaaagcacataaatgtgaataaagcacaaaaggaataaaatcagagcccttcaaagtttcacattataagacctggggcagtcctggctctgccacttgccagatctgcaaccttgggtgtttcttaacctttttcctccacaatttcctcattaataacatcaaatgtaaattatatgatttcccatgtttgttgtggaaagaaaatggaataatacttgtaaatgtacctcataaggttattattttattaagaatagaataaaaattatttcagggaagggaaattggggagatgttggtcaaaggatacatttgacaggatacattagatagaaagaatgagtaagttcaagtgatctattgtacaacagggtaactgtagataataacaaggtattgatcttgaaaattgacaagggaatagattctttctttcccttccttccttccttctgtttctgtcttttttttttttttttttttttgtagaaatgggtctcactttgttgcccaggctggtctcaaactcctgggctcaagccatctgctggtcttggcctcctaaattgctaggattataggcataagccactgcacttggccccaagagaatagattttaagtgctctcgccacaaaaaaataagaagtgtgtgagataatgcatatgttacttagcttgacttagccattctacaatgcacacatatttcaaaacaacatgtacatgataaagaaatatgattttcatttgtcaattaaaaaatgtttaaaaaagaaaattatttcagatctgggaaaaacagtcctcccatttcctataagattacctgtcactaggcagcctgcagagaaccaggtgagaagggtccccgccccacggtcctgctttagagtcacgtatctcaaacacaggagagccctgctgctggagaccccattattagcccaggcccctgactcaatccccacatctctacttcccttgtccttgaatcaaagggcagacgcatcctggtgctgggaagaggtgtggctgttccactcctgacactcaaggcagccgcagctgggggaagatttcagaaatgacacgctcaggtaggagaaatgacaatttaattaacttgtcaactgtttctctcagaaaacatggaggaaatagattgctgcattaaaaaagcatcctttcccagctgtgtccagtcttatgtttttcctcttccaagtcaaggtcctactttggggtcccactttgagggacgttttgcaatattgaacaatatatgttactcttacatcgatatatctgtaggtctaaatcagtgcttggtaaacgttttggtttcaggactgaccaacaatcttgaatattattgaggatgctaaagaacttttatttatgtggcttatatctatcagtatttattatgttagaaattaaggcaaaacatgcaaactatttatattggttcatttgagaacaataagaaacccataaaatggataacatattttatgcaaaataaatacattttccaaaattaaaaaaagtgagaattatggcatcatttaacatttctgaaaatgtctttaagagctggtttaacagaagacagctggattctcacacatacttctgacttcaatgggttgtgattatcacacttcatggagcttctgaaaaactccggtgttcactcgtgagataatgagagtgaaaaggtcaaataaaatcttaatattgcaatgaaattagttttgattagttttgaccttacagaccttactgaaggctctgggggccttccaggggtccccaaactgtacaccgagaatttctttctttctttctttttttttttggagatagtcttactctatcacccaggttggagtgcagtgacaagtgacatgatctcggctcactgcaacctctgcctcccaggttcaagcaattctcctgcctcagcctcccgagtagctgggattacagctgcttgccactgcgctcagctaacttatgtatttttagtagggatggggttttcccatgttggccaggctggtctcgaactcttgacctcaggtgatctgcctgccttggcctcccaaagtgctggtattacagtcgtgagccaccgcacccagccaacactgggaatttctgttcaagatatgctgtgaatatcatgctgtgaagcataatattgattctatacattgtcagttagatgactgttggatgctagagaggcaaatggtcttataataatatttaataaaatataattattgaaagtgtttaaaatcagctttattagtgacttgcatttaaatttggtattttatttaacaattttaaaagatatatttaatgatatctatttattatattttcttgaacagtttgtgtctcactttataacttccaaatacttaatcatatgttcggtctctcttcttattcttgctctgctctgggcctggcatgtagtgggatttgagacagcctgtgaacactgaacactaggcaagaaacatgcccataggggctggaaacgactttacagaaggcagatctgacccttgtcgccagctcctgtcatccggatggcatcacagggaaggaagttctcagcagatgagtgaagtcagcgaaaaagagtgtgatgcggggcccttgccacagcagcccttgccttgtcctgccacctgcctttcctcctgctctgttcattaaagtgatgcaccagccactgaactgggtttgcccattaagcatcctggctggagggacataagtgacccatgcacacagccgtaagaggcacattcagtgatctaagctgagcaagacattgctcctgctgtaaatacatgtccttcaatctagcagtagaaattagacctgtaactaaatagctgcacaactaatatctgaggcagagtgcaataaagtcacattgctctatgacagctggaaaggaaacacagttaagctggatgagggactcgaaaaaggctcatggagagagtgtcagacatgttgggacttaaaggatgcagggcaggactttgagttcttgcacatgcaggatgccataagaatccaattctgagctaagcatggtggctcacacccataatattaaatcccagctacttgggaggctaaggcaggaggattacttgaggccaggaatacaagagactagcctgggcaacatagttagaccttgtctctctaaaaaaaaaaaaaaaaaaaaaaaaaagaaagcaaagaaagagaacagaaaaagaaagaggaggatctaattctgaaggcagagctagaagaggcttagcaagcagtctggttgttagctgcagtgcatttgagggagagtggactgagagaaagaagagctgaggctggagaggaggctacagacttgaaagagcttgtgtttgaagtcaggtctgggtttaaactccagctctccccttgctattgtgatattgcacaacttctgaataacaggttttctatctgtaaatgaggaataattgtatttccacgataaagttgtttgaaaatcagggctaattcatgtatagagcttggcacacagcaggtgtccacccaatgtcagctattgttggacaccagctgtggagagcctggtgcaacaagtcgcagagaggggctcagtctgcaggaaacaggagataggagatgccgttttggagctgagcctgagacagtgatggccatgacgcaaatgattcgggctggggcttcctgcagtgacagggccaaaggctgctgaagggactctcagcagtgctctttgccacttgcttgggtgggcggaggtgaggggtgcagaactgctgtgatgagaagcagcgggtcagaaatcgcctcacctccactcccccagtcaatgagtgcaggatcctagaatcttaagccatcaaaaatcttaaatgccaattttcatggggggagaaacagccccaaacaaaacgggaaaagagaatactgtgtcgggaatgcatgaaaacctcagcatttgggttacatttccagtcttcctctaactggagacttcccctctcttaactgccttctccctgttcctcaaacccatttgctcctagtgagcaagagtgttattgtccacctgaggatatagttggctggggttcttttcttcaagtgtctcaaagtgttcttttctggcagtgtcttgaggtcctttgtgtgttcgttctctttccaacaaagttgtaaagggaatgagccgagatccatttcagatcacagaaacggggtgctggctttctcattgtactgggattatcacgagtactcatcctcctctcaaaagtcttctaagtgtgctattgtgctcttgcttaaatttgtaaaactttttctccttgtatttctgctcaccaggaactacaattcatcaaataaaagacaagctggcaaaacttgtcttacgtctcagtggcctgggattgaggtaacttaggttctagttgtcattctgcagttaactagctgtgtgactcggcattttaatcgcccttttttggagtggattgctatttcctagagtaaatttggaccaaatccacaaggtcctgcccctccctgacactggacgggtaaggtcacaggtgttcagtggtggaatcgccactccatcttgtgaccctgcactcctgcacgatgctatttccatgaggatcttggattaaaccaaaagtgcagatgggctctgtcaccactggtgttacctagaggaggcactctctccttggagcatctgactcctttgggaaaaggtgataagaattcctagtcctgacccagcatctgggacagagatttatcagaggatccagggtcccttcactcaccactccctttccatgctgagaccaccccaatcccattctgaccttctcctcttcagcctccccagtgagctgtgaagaccatctgtcttcagcagatgctctgtctcagaagatggtctaactcagaagagttccccagtgaagggagctcttggtgattcttgaccaaggggaaaggcccactgagcatctactgtaatagtcgctgcactgctgtggtttagacaaaacaagcaatggtccctgttctcaagcaacatagagtttcagggagacagtcaaggaaacaaatacaccaataaaaatatacttacaaattactataccccatgaaggaaaaaaatcaggtgccataagagaatcaaggtgggagatattttggagaaggtggcagaggagctatctgcagagaaaacacatcagcttcagaacaaatgaaatggggacaaggagggcgcacattctaggcagacgcatagcctgtgcaaaggtatgaagatgggaattcccaacaggttcaaggaactaagtgaagactagtgaggccccagcatagtaaaaaagaagagcgtggatggtcgggttaggctctagatgaggcagaaccttgcagctcaccgagaggatttgcaatttggcctaaatgccatgggacactttagagggcaacaggatctgatgaaagtgcagggcctctggcttatgaacaaatattttatttaaaatgcttcttctcactcaattgaaactgtaaggtaatccctcccacaccctaaaaaaaaggacacagagaagcattttgctttgtctgctacttgttcaaaattagttcataaaaataaaacttattcagtcagttcattatcacagagtccccacagctggaaggggaatgcccttacacatagcacaaattgaatacccaacctcaagcccacaccaaatgttgaatctgaaataaatgggtaggaaatataatctaacccagctcaaagaaataacactgtccttgctctcaatcactgaaaactgctggatgtattcatttatgcaactgacttcctgtaagccagggactatgctaggcactccagatacagcagcaaacacagacagaaatttctgtcctcacagagcttgaatcctaatggggaggagactacaaacaagacagttaggtaaattataatctatattagaaagggatgagggtgtggagtgtgaggcagggaagggagttagggagcgtgggtggttgcaattgtaaatgcggtggtcaggaaagacctcctaggggtgacttaggaggaggaggagaagtgacaacttagacctcaagggaaaaagcactggaagcagaggggagaccaagcctgacacccttaagcaggtgcacctggggagtggcagggaggccatgtgactggagtggagagagaggaggggaaggggaaagaaggcaaaagggggatcagatcacatagagcctcggaggccatggttggggctctgggagccatctgaggctctgaacagggaagtgacatgttccatgctttgagaaggcccatgctggggtctgtgatgagaacgggccgcatgggtgggaacaggaggagcaggtgggaagccgctgcagtgatgggggagctgccgcttgctagaaccagggtgggagctgcggatgtgccgagagacgatcagattccagatctatttttgaggctagaggtttggatgtggggtgcagagaaaggatgagtcaaggatgacaccacaggttttggccggagaaacaggaaggagggaatcgctgttcactgacatgaggaagattgaaatggctgatgatcagataaggatgttggctggaatattttaagtttgagatgcttataagacatcccagttgaagacctcaagcaggagctgaatattcaggggaacattcaggggcagggtctgaaatgggcatatacatttgggggtcacctgccaatatatgttatttcaagtcacaagagtagatgcgaccaccaggaagggtatggatagcaggagagggccaggtctgagcccaggggcagcccacagttaaaggtctgggggagtcagggaaagagcccaagaaggagcacgaatttggaaaaagaaaacagggaatgatgacttcctggaagcacatcaagctgcatttcctgggaggtacagtcaaccgtgtccagcacagaagatgagggctgaaaatgggccaggggaatttccaaagtggagatccttggtggttctaacaagaacaactttactgagggagtaggaaggaacttcaggcagtccagatgcttcttggaagaagttctgctggaagaggggagaagacaatgtgtggtaaatggagaaggaagtgggagatgacaagatctgggagaaattgctggtggatgcctacggaaatggtctaactgagggagagagaagctgctggaaagacatcctagcaggtggcaaagggcaaggcctggtgtgcaggtgggtcccagtcatggcggagaatacagtcatgggttcttagtttctatttttggttgggccagtaaagccccttcctcatccctcttatctgcttatcagtacagacagaaacgaaaaaccatggcttcaggctgctaaacacctaaaacaaaaccaaacggaacaacaacaacaagataaggtgggtttcacaagcttggacatgcgggccgttcacctgtcatataaaggcagggaggcagcgtcatggcggcaggtggcagtgggagtcagtggaagctcttttctgatccctgcaattgtctcaacaaagtgtgaagtagggtcatccattgcctgagtaggaggatggagaggagataagggaggtttgttcatcttcacattttacctaatgaatgaactgatttctctttcacatatattataaaatctgttcttacattagatagagaaagaagaggaggactagagaaaggaggagaccaaagagccctgagcatcctgaaaatccaagagaaaacccaaatgaggcttctggccaacactgagaagatccaacacatttctgagtacaaatataatctggcgaagtgggattagagacgcctgtatttctgctgaacgcactttctaagctccgtgagtgaaggagggttgcagagcattctgtatggttcaggtggttgacttcactttaggaaaagtaaaactaagaaaacagagaagctggagcatgtgccaaataaagaacttgctcctcaggagacaggaaagctgagctaattttgtacgtactataaatcgtcagtcagcttcagtttcagatctagtttcaaacctggagtgtgccagtggacagggaagactgcattggcctaaagcatttaaacttgcaaaaataaatagtatcatcaaataaataaggcacattttatcaggattaggcataatttataatgacataaagatgatggaattccacatgacacaggaaaagaacaggctacttatgatttttaaaagtaattgtaatgtgaatttctacctgcattttattttgaccagtatcttattacctatatattttttaaaatgtagtctctttttaaattctacaaacgactgtgtgagaaacttatccttttaaaatcaatgccatactgggaccagcatcactggaggtctctatttacttgctgggacataaggggaattctcaggggacccccacacacaaagagcttatgagtcttgacatggaaatcaatgtccctggccttttagtaactctaaagaacaggctatgctaggagtcagtctgctagattgatccaaaataaactgtccctggcatagttgttatgtaagatcatttcttaccatttctgatatcccttacacagacaagaaaaaaaatgaaaaggtcacatcttcccactgggcccccatcaacaggaaccagagcagagccatctgataaggggccttctgcacaattgattctttaaacctccttattccttaaacctctgcctctgtcttccagtacaagtattgaatgccatacactataatagatctcaatgtatgaaacaattttaaccacaaaaatctagtaagaaaattcaataagagctgacactataaaacaccataaatcaccagaggtggcctgtggatcaattagcaggatattggcaaaactctgtaaagcatttgattgaataaacccacagccacctatccagcaaattaacaatgactgaaattgttgcagggagtgagtgggggagggtgggagggtagtgtgtgtgtgtgtgtgtgtgtgcgtgcgcataagaacagactacttggtgagtaaatagtggaggaagatagtgtggatgaattaatgaccaggcttcaaggcagctccgtaatttggggaggtgattagtgcatttgcatctacattactctccctcacccctacttttctaaaacttaataccatttcttccatattcacagtttttatgataaaaacaatgcttactaattacaagtagtttataacaaattttttaagaagcattcagagaaaaccaaaaaccacctcaagcgtcatcaccccaagataagcactattattatattagagatttccttccattctattttcaatgcatgcatgtgtatttttcagccaacaaatactatgctgcatataccattaacattgtgatttacttatgtaacattatgttatgagagatttttattttattaaatagtcttaggagaattctttcataaaggctacacattattccatattatggtattactaaataggatttcaagtaaactttttgttggatttttaaagatattcttaattttacactattttaaatatatatataatgctgcaaatgaacatctgtatagcttattccttgcaccaatttctgagtactttgctctgttattctctgaggaccctgataactcagtgacaccatggatgctgagcaccaaactgcttgcaaagcacacgtagagacccctggacacttccctctgcactgagtgcccgtctcaggacatcttcaacagcattgagttgtatagtttttaatttttttaatatgataggcaaaatgacagtacttttcattagtttgtggtttgttttctagcatgagtaaatatcttctcattgatttcacagtctttttaaagtttttacatgtcctcacgtgtgactcacatctatcacattggctggtacaccataggtgctcaataagtgtgtatcaaataaaaacaataaatggagagatagttcgtgtctatttttgtaataggattttactgcgcgctctctctcgctctctctctctctctctccctccctcccccggggcgttcctgagtttatttggggcacacccggggcgaggaacctgcacctaaaagaagatgttgggcctcttggtggtgaagcgtggcccggcggcacttgttggctgcgatctcctccaccttcatgatctggatgcagtgggcctgggtgcggtgccggcccatggtggtcaggtcccagtattccctgtatgtgttgtgggtgcagctccgggagtcatagagcagccagacgctgaagttctttacccgcagggggaccttctcaaacacctgtccacagtagacaatccagcctgaagtcatcttcatcttctttaactgagatacaaagtaccagaagcgggacttggcgacgacatgatttaggcgcaaagattcgcatgcagtagaggggcagtgtgtggcatttgggggtgggcaaagagagaccaccaccttgtactcttttagtgcacccgaggccttcatggcgtcctttccgtgcctgccgccacccgcgcttttctccagcactttgggaggccgaggcgggtggatcaactgaggtcaggagttcgagaccagcctggtcaacatggcaaaaccccgtctccactaaaaatacaaaaattaactgcgtgtggtggtgcgacctgcaatcccagctattcaggaggctgaggtaggagaatcgcttgaacccgggaggtggagattgcagtgagccgagattgtgccaccgcactccagcttgggtgacagagagactccatctcaaaaaaaaaaaaaagaatcatattttacaacttctgtcatatattaagggaaaatgggaaattatccaccgttgttgtaaatatgacacaatttcccaatatttgcttatctttttattttgcttatttttttaacttacaaaacttcaacattttatattgtcaaatatcctgatttcttttccattgttatcattctgttattttaggcttaaaagatttctgtctctaacttatttatccatattttcttttgagtttttatgatttcatactttatgtttcactcaaatctatcagggattgaggtatgggtaaaagaggaaatatatcttaaagtttttttcaaagtagttaactaattgtattagtaatacttattgtttaatatattctttactcaaatattttttattctatcactattatttacgaaatttatattagggtcaatttctgttcaatttatatagttccactaatctgtcattatgttgctgcactcataccatttcaatctatttatttatttatctttatttttttcaacttttagattcaggggtacacgtggaggtttgttgcttgggtatattgtgtgattctgaggtttggggtacacgtgttcctgtcaaccaggtactgagcattgtacccagcaattagtttttcaacccttgccccactccctccatcccccttctagtagaacccagtttctactgttgccatctttatgtctgtgagtacccaatgtttagctcccacttgtaggtaagaacatgtagtatttggttttctgttcctgcactaatttgcttagtattaatggcctcccgctgcatgcatgttgctgcaaaggacatgattcattcttttttatggctgcctagtattccatggtgtatatgtaccacattttctttattcagtccacaactgatggacacctaggttgaatacatgtctttgctattgtgaatagtgcagcgatgatcatgcatttgcctgtgtctttttggtgtaacggtttgttttcttttggaaatacacagagtaatgggattgctgggacaaacgatagctctgttttaagttcttttggaaatctccaaactgctcttcacagtggctgaactaatttacattcccaccagcagtgtataaatgttcccttttctccacagccatgccatcatctgttttttgaccctaataatagccatcctgactgatgtgagatggtatctcattctggttttgatttgcatttctctgatgattagtgacacggagcatttcttcatatgtttgctggctgcttatatgtcttcttttgagaagtgtctgttcatgtcttttgcccattttttaatggggttgttttttgcttgttcaattaagtttttatagattttagatattagacttttgttggatgcataatttgcaaatattttctcccattctgtaggttgtctattcactctgttgatagtttcttttgccatgcagaagctctttagtttaataggttccacttgtcaacttttgtttttgttgcaattgcttttgaggacttataaattctttcctaaggctgatgtccagaatggtgtttcctaggttttcttctaggattcttatagtttgagaatttaaatctttaatccatcttgagttaatttttgcatatggtgagagatagggattcagtttcattcttctgcttgtgactagccagtttttccagtatcatttattagggtctcctttccctattgtttatttttgtcaattttgttggagattacatgactgtaggggggtggccttatttctgggtgccctactctgttgcattggtctgggtctgtttttgtagaagtactgtgctgttttggttactgtagccttataacacagtttgaagtcaggtaatgtgatgcctccagtgttgttctttttgcttaggatttctttggctattcaagctctttttggttccatatgaattttaacatagttttttccaattctgtaaaaaatgacactgatagtttgataagaatagtgttgtatctgtggattgctttgtgaaatacggccattttaataatactgattctttcaatccacgagcatgggatgtttttctatttgattccgtcatccatgatttattttatcagtgttttgtagttctccttgtacaaatctttcacttctttggttagatgtattcctagatatctcaattttttaatctattgtaaattggattgcattcttaatttggctctcagtttgaacatgtatagaaatgctactgatttttgtccattgattttgtaccctacaaccttgctaaaatcgtttatcagttctaatagccttttgacagagtccttagggttttctaagtacagaatcatataattcgggaagaaagagttcgacttcttcttttcctgtttggatgcccctttcatttctttctcttgcctaactgctttggctagcacttccagtactatgttgaataggtgagagttgtatccttttcttgttccagttctcaaagggaatatttccagtttttgctcattccatatgatgttgtcaattactttttaaacatacattaatgttcaatgtggatgtacatacatccacacttctttccccaaagtttcttggttaagttttccactcagtcttctagataatttgtggaattttagaatgaaatatatatacatacaacacatgtacatcaaattatataaatctatctccttgacatttttagatttgcattaaacctgtatattaatttgtagagaagtgaagttatctaaagctcagtgtttccatccagccacatgatgtacctctcaatttcttcccatctttcaggtcctttagtgaaattttatggttttcttcagagagtttccacatacttcttttcaaagttatctctaggtactttataactaagattttcttactttcatattttccaatttgatatcactggtgtaagtgaaatctattgatatctaccatacttattttgtatattgccacattatttaactctttttaattctaataatatttaagttgaatcagtgcaattttttagttcaataattaaacatctgcaaatgctatattgattttttctaataccttggtttgttttggtagagtttttgccagcccctgagatggtctcaattatccttaccacctgatgttcacagcattatgaagtgcccttccacactgaaccagagcttgtcagtgtgaccagtagaattcagcaggagtaacaatgtgtgacttctcaggctaagtcataaaggcactgcagcttctacctcagtctcctggctcccttgtttgtggagaggcagctgccatgctttgaggatgcacatgcagtcctgtggagagcccgagttgctagctgatacctccatctgacagtttccctagtttgccagccacactagtgagacacattggaagtgggtcctcctgccctagtcaacccatcagatgacagcagccccagctgacatctgacttacaaccttctaagagatccgaagtctaaacctgccagccaagctgctgctgaatgactgaccggcagaaaccacgagagactattaaatgattgctgttttgagtcactaaattttagggctgatttgttatggtttattattaagcaacagataacacacagaatttcaaaagaatgtaagtgaaaaaaatccaacaattattgagcacttactatattctagtaacagggcttacaacaatgctaatgtggacattcctatttcagagatgaagatatagaggctgagaaatattaagttaaagcacggcttctcaaccttgttttacattttgagccagataattctttgttatggcggttgtcccatgcattgcagggtttctagcttctacacatcagatttcagtagcagtcacccaattgcaaaaaccaaaaaatgcctccagacattgccaattgtctcctcagaggtaaccctaccctcacttcccgcccccagctttgtattcttgcatgcattagactacttgtgtgttatcagacagcctagacttttgacaacagttaaaaaggctctaggaatgccccagttttctacttcctggttattctgtaggctctgtggtggggtattcccagatggatggtcttgcctttcaattcgtttatttcctccagcactccaatcatcctctccagcttccttcactcctatattgaaactgtcttcctaacccaaatatgcttcaagtgtgaatttcacatgtgtctttctggttccgacaatagagtgttattctatgttagtgaaatgccatgggcgtgcatttgaggggcacccaggccttgtctcatagaaaacctcctggaggaatcaactcatccagtgaagtgtgtgtcagggaaagggatcgggggcaacttcaaactgctgcagacaaaaagagcagaatatgtgagggttctgtggccaataggagcatggcacatgccagctgtgctgtattcagtacaactaaaacagagaatatttccagcatgcttgttgtaggagatggcaaggtgtatgaatggcaggcaaactgaagaagtaagtagaagcctgacaaaggaaagcagtagatggtttccagagatgtcaagaggtagatggtcagaactttattaaatatttcagtggtgagggagaggatgaattaagaatggcactctgagctctgacatgagagagtgggtagagggtggcactgtttacttaaaaaaatgaacataagcctaggcaacataccaagaccccatctctacaaaaaatagaaaatagaaaaatcagcaagggttggtggcgcacactggtagtcccagtagctactcaggaggctgaggtgggaggatcacttgagcccaggaggttgaagctgcagtgagccatgatcacactactgcactccagcctgggtgacagagcaagatcttgttaaaaaaacaaacaaacaaacaacaacaacaacaacaaaacacaggtcaggagaagatgacacatttggagtttgtcatgcctgaggcacatgaagtggaaaagcccagtggacagttagaaatgtggatctgactctcaggagcccccagggattcatcatcctacagaggagtgtttctcagtgttggcactggtaacattttggggcagatacagctttgctgtgaggctgtccagggcacagtgggatgtgcagctgcatccccggcctctgcccactaggtccagtagcatgtccaagtcatgacaatgaaacatgtctccagacattgccaaatgtccgcgggggacaaaatcacccccaggtgagagcctctgggttaaaggtttcacagggaataaggctgctaggctgcagatctttgattcaaatcttggtggcctatctctaaactacagcccttctccactgagccatgtgtaaggatccctgccacacactgttacagaacactgcgagtctccttctaggatttatctcattggcttatgtaactaattctgtagctgagttggaaatgtctgtttccccgaggagaaagtaaccaccctgagggcagagactctgcacacacaggatgcctagtagagtctcttgcactttagagagactcaatgaatattttaaaataaatgcgtaaattataagttgttggttttgatttactaataatttaaagggattctagcaccaatatgaagtggcaagtgttctatatttgtctgtgataactatcaggtgaattttgtactgcttgaaagtttatcagtattcatttgtgaaatggtgtggttctgaaaacttcattaaaaattatctggcaagttttatagttatgttcataacttcagtgttttgaaattttctacttcttaagtatggtaattttctaaggaaattaactcatcaagtctttcaaatatattattaaaattctgaacataaaaatttctattaatatttctctttgaactatacataattttatattccttttctgattctaatcatgaatatttgttttctcttaattagctatgccagagtgtttggtcccccaagtaaatatttttagatttatttatcaatgccactgtttcactatattttgtttatagtttattaatttcttcttatattttagttatttaatttttctttccctaggtttctttggctgagggttttctaatttttttttacttgaacacagttattttcttttctttcatcttaaataataaaaacatacagaactgtgaatttttccctgtaaataattttagtcacatctgctaagttttaatgtataattattatattgacattatttcctaaatagtcaaattatggcttcaatttcccctttggccaatagtacttttcaatctgaaaatgtttgaaattttaaaaatcattaatgtctaattgtattgtgatcggaaaatgtgccttcaataatttctcctttttgaaatttattgaggatgttctcatgccccagtagtatattgctaattgtatagatgctttatagatccttgcaatgatgacatagtctatttcatggcaaaatggtcagtacaagttttaattgtaaatattatttgattttatgtaatattatttatcttttttatgtgcaaaataatgaattaaaactcccaacacaattacatacatttctgctaacttctagcagtttttgctttacctattttgattctatactattaggagtgtagaggatcatggtcctttgtcactgtagattataacttcatcaatacagaataatcaactttgtcccattaaacacttctcctcctcaaatctcactagatttcatattaagctgacatttatttattttacttttatgtctttacttttaatcattccttttgcgtgtctcttttaaatagaatatagatgaattttgtagtttggtccagtttgagaatttttctgttgttaggtgatatttatttacatttattcttgaaggaggtgtgcggtataataaaaatatatattttatttggtctttatttgttcctagttcctggcatagaagttcttaaaacatttcctgaggccgggcacggtggctcacgcctgtaatcccagcactttgggaggccgaggcgggtggatcatgaggtcgggagttcaagaccagcctggccaagatggtgaaactccgtctctattaaaaatacaaaaaattagctgggcgtggtggcagatgcctgtaagcccagctactcaggaggctgaggcagagaattgcttgaacccgggaggcggaggacgcagtgagccaagatcgcaccactgcactccagcctgagtgacagagtgagactctgtctcaaaaaatgaaaacaaaacaaaacaaacaaaaaaacacttcctgagtgagagaagtgtcttttgttactcataatcagccccttcacccctaccagagtttatggtaatgaggtagctcttggtaggtccctagacagcttcaggatggggggctgtcaacagaggaaacaaccatgtgacaagagggtggaaatttttagcccgccccttgaccttgggagaatgggaaggggtagagactgatccaacaatcaatggccagtgatttaatcaatcatgcctacataatgcagcctccataaaaaaccctaaatgatgtggcccaggggtgctcccgagctggtgaatacacctgggtgctgggagggtggtgcaccccaccctccagaatccacaccccccctcaagtttcctcttcatctggctgttcatttgtacccttgatgagaagctgtcatagtaagtatagttcttccctgtgttttataagtcattctagcagatcattgaacctgaggggggagttttgggaaccttcaaatttgtagttgcttgggcaaaagcatgggaatcctgggaaccctgttttcggctgatgcctgaagtgggagcagccttgtgagaatgtgcctttaacctgtaggatttgggctaactccaggagtgagtgccagaattgatttgaattgttggatacccagttggtctcagggaactggagaattagtgtggaagaccagatgtttggtgtcaggagtggtgtcagaaaaaagacaacaaaaggtgttttaaacttattagcatgaaccttatgaaattgccatttttgtaggtcaagatagcaaagtatgaacaattttatacatttcaacataaacttatgttatctgatattatagcttctctttttatgcttctgtaataaaatctgtgctcttctttaggctgtctgctctcagctacccagcacaaggcaggatgacacttcctggcccgctgtggttaggagggccatgggaccaattctggccaatgagttgtaagcagagtaggtgtagctttcatgctgaggtgtttaaatggctgtgcagaaccccagaattctccttacctctgagatggaaactggcaacctcagagatggtggctgtcaccaggaccaagagcggctagaatgagcagagctaccctcccgacccatagactaggacaatgagcaaaacatggtcacctgtttaagccactaaaatatgagggttgtttgtttccatgatagaagctagtgcatcctgacctactttctgtccattttgttttcctaatttcttgactatatgaaaatatacttttgcatccatattatcaagttttcacggtaaataagaaaaaatggaggagcaaattcagtattccaagtcatctagactaattatcctcagatattttagaaggggaagcagactgcaagaactatttctcgacaatagcaatttttttttttttttttttttaaaccgagtctcactctgtcgcccgggctggagtgcagtggtgcgatctcggctcactgcaagctccgcctcctgggttcacgccattctcctgcctcagccaccggagtaactgagactacaggtgcccgccaccacacctggctaattttttgtatttttagtagagacggggttcactgtgttagccaggatggtcttggtctcctgaccttgtgatctgcccgccttggcctcccaaagtgctgagattacaggcgtgagccaccgcgcctggctgacaatagtaattattttttacaaaagacagatgctctattgaagaaaaacaaacataaaagcaaaatgtagagatttatggctaaagtcagtgtggtatacatagaaaatggaatactattcaatctttaaaaggagtaaaattccgttatttgcaataacctggatgaacgtggaggatgttcaggttatatgttaagcaacatagccaggcacagaaagacatatgctgcatgatctcacttatatgtggaatctaaaaaagtcaaattcacagaagcagagagtagaatggtagttaccagaggctgggggaagggggagggatggggagatgttggtcaaaaggtataatgtttccgtcagttagaataagttttagagatctattgcgaagtatggtgactgtagttaataataaggtgttgcatatttcaaaactgcaaaaacagtagattttaaatgttctcaccacaaaaaataactatgtaaggatggatatattaattagcttgtctgaatcattccacaatataaacgtatataaaaacataacatttcatcccgcaaatatatatttgttgggataatcccacagttattatttgtcaagtaaaatttttaaaaattagagatttgtgcatttttatcattactttgtgatttgtgaatggtaaataataaaattaagaggtaaggagtggagaaacatgaacttaaataaaaacaataataatgctagaaagaatacaacaaatcctgcagcctcttcttctttctctttctttggtcccctctctctccctccctcccttccttttgtctccttcccaccttcctccctcccttcttctctgtttcctagtatttctccttatgttttccttcctattaacagagctcagggccaggagcagtggcttatgcctgtaatcccagcactttgggaggctgaggcgggcggatcacaaggtcaggagttcaagaccagcctggccaatatggtgaaaccctgtctctactgaaaatataaaaattagccggccatagtggcacacgcctgtagtcccagctactcgggaggctgaggcatgagaattgcttgaaactgggaggcggaggttgtagtgagccaagatggcaccattgcactccagcctgagtgacagagtgagactccatctcaaacaacaacaacaacaacaaacagagctcagattattttagcaattccatggcttgttctgcagtgctatgctgacaggaatatttgtaattttctttaattcttttgtgtttaataagttaatgaaaacccccatctctatgtccttaagaggcaaaaatctttgaagttttgaagcttttagatgcttcaataaaattcctgtttcctctctgagaaaaataacaatttttctctctttagaatgtggaaattgaactgtattcttttcatcgcacaggtaagtaattgcggaaaatgcagataagaagaaattatgcaaaatcctgctagccatcataaccactcttgtcattttgatatcaattcttttaaatataactattacatacaaatgtgtagccttctgttttcaacagacatgtgatgtgactgttcataaatgggtggaagcgacctccttgtactcagatcaagccatatatgtgtcatgtaagagtctgaggatgtgattgaatggcaggagggcctggggactgggaagtagggagaaggtggaagtgcaaatggacaaggatagtggcccagggctgtatactttacttatagaacatctccggtctatttatagtagctattcagaggaagcaaaggaggaaatggcattttaaatggtaaagttattatttttaatagtttgtttccccctaggaatgcatgttaacctcattactgcattgaagactctttggaggagaaaactacttttcatagcttagtttttgtgaggtaactgctaagtaagtaattatagattcatttgaaggcatcataacaccagggaaagaacatagttttaaaatcatgaagactgggtctgaatctcatctctgcctccatagctatagggtcctgggaaagcccaggacttatccctgcagcctcagtttcatcatatgtgaaataatatcatcaataccttgtaagctgctgtgaatgttaaattagatgaaatctataaagtggctgatatacagatatcattcaatgaattatagccattgttttcttttttcttgtagcctcaatatttattgatttctttaggttatacacacacacacacacacgcacacatacatatatatatattttttgagacagtgtctcattctgtcacccagggtggagtgtagtggcgcaatctcagctcactgcaacctccatctcctgggttcaagcaattctcatgcctcagcctcccaagtagctgggattacaggtgtgttccaccatgcttggctaatttttgtgtttttagtagagacggggtttcaccatactgtccaggctggtcttgaactcctggtctcaagtgattctcctgccttggcttcacacagagctgggattacaggcataaaccactgcactggaccaggtttgtaattttttactgactaatttggttaagcaagaaataagtaacactgaaaaattaaaaaaaataaaaaataaaaaataaaaaacaaaacaaagcaaaaacctgccagttactcttttgttatgagacagaagcactcattgatgggccccttactgtcacaataaagatatgattgatatggccaaaattcagcaaccactgaaatctgaattttcgctttgtcagtagccacttggtaaataacatcactgtcacagaacaaaacgctttccagtttgtcccctgctggtgtgcttatcccgtgtgtttaactgaaggtaccatgtaattggggtggagtccgtgccacatgttcctggagttcagagctgcccggtcctgtaccaggggcagccaggtcactctgcaccagctgcatttaacccccaagggtttaaactgccttgcacttggggcagagcttccaagggccactagggggcagcaaacatgtgagaaagagcaaatagaagagaacaaatccgacgaggaagacatggaagtcatactcctcaggaaaaaggttctgccctcttcaaagaacatgcttgggatgctactcacagcacagcaacagaactggagctctagacataaggctcctgtttaaggggaaaaaaaggcaatttctttacatcaagacaaactacttttcctatgccaataattttcaaatattcatcactagccataacttctcttatcagttccaggtccctatggccacttgaatgcctcagtctcctgcgactcatcctcattatacttccttgtaagcaacctagtgcagagcccaagaacttgttccctggagccacactgtctgggttccaatcctacttcagcatttaccaattaatgctttgggcaagttaattaatttcttaatttcctcatctgtaaaactggggcaaaaattgtaccaacctctcactcttgtaaaagaggttaatgtttgcaaactttcttagaatagtgcttggcacacaataggcactatgtgaatgcttgttgaataaaaataaataattcttgctccttttcacagtttccttcatcagtaaatggcaccttcatccacccaactagatgaaacctacaagtcagtcttgatacccctgtgtccctcatctcccacatccaagcaatgactaagtcctatgacttctatctactaaatcactaaatcaaccttacatctgtccacctctctccatcttcacagataccatcaactagtccaagccaccatcatttctcacctgagccactcctatggcctcctggtatctcctcagctactctggtgcctctctactttatccagaatttttcaaacacaaatttgctgcttcatgacagcagaagtgatctgcacagcttaaaacacttgaaaatcttatttttcttagaatgaaaacaataatccatattgtgtcctataatggctagtgtggctcatctcttttccttgctccctgtgttgcacctatcttgccacttttcggtctttccacgtgaagtgttttcttttgcaatgggggctttgcatataccaggaacatcttcccttctcagtgcctacttaacatctcacgcttctgatcttagttcagatagttctttcttcagaaagcctgtcttgatcccttaaccagattgtaccctctattatctgtcctcagagcatggtgtatacatcctccacaaattctttctcaactggggatgcctttccattgcctttaggcattcattgttctgataagaagtcagccataattttttgtcattattcctctatatgcaacatatcattttttcctgtggttgcttttatattttctttatctttggttttcagaagtttgactatgatgtgcctgggtgtggttttatttgtgtctctactacttagaattcactgagattcttgaatctatagattgatattttctcattgtatcccatatatttcagctgttatttctttaaatatgttttctggcccattctctctctcattattctaggattgcaactactcacattttaggccatttaataggtcactgattgatgatgggtaaagtgtttttaaatattttttttccctgtgctttagtttgaataatttctattaaccattctttaagttcactaatcttttctttcagtttctgttctgctgttaagcctattcaatccattatttacatcagatgtttatttttactctagaatttcatttgtttcttttttatggctcccatttctctgttgtaatcccccaactatttattcattctggccatctttttctgaacatccttgaatatatttacagtagatgttttaaagtctttctctgctagttccagtatctgatccatctgtgggcctgcttctgttgatagtattttttctatttatttatcatattatcttgcttctttccatgttttataactctaaaaattatatattgaacggtttttttttttggacatggagtctcactctgttgcccaggctggagcgcagcactgcgatctcagctcactgcaacctccacctcctgagttcaagtgattctcctgcctcagcctcctgagtagctgggactacaggcatgcaccaccacacctggctaatgtttgtatttttagtagagacagggtttcgccatgtcggccaggctggtctcgaagtcctaaccttaggtgatcccccctcctctgcctcccaaggtgctggaattacaggttgagctgctgctcctggccaaagtggacattttttgtagaagaatagtgcagactgaagcatactattgtttgttttgttttccttgagagtgctgactttttcccatatctgggggctaaggtaaaagagatcattcatatttcactaagagttgaattggtaaaaacaaaaacaaaacaaaacaaaacaaaaaaaacaaactggggtgcacttcccactgctagatgtagggattttctatccaagctttcaccctacagaagccattccctaccatcagcaatgtaactgttgcccaactcaagacatttgcctctgttagctccaacaaataaaaatatgtctctttttgccaaccaaaaacgacagggccaacaacaactctataagcacaggcaatttaacaagtacgttttcagttagtgccatttttaattctaattatcttctgttaggtaaagtggaggatttctagctttgctgggccaatacattaaaaaacattccaagtctgtcctggttgtctatattcccattcaagtacactggcttaatccagttttggagacattcttgaccaggatctacctgtaaatgaaatatataattagttccataatctggtatccatacgcctctcagtcgctttattggcacgctacactagaaaaacatggggcttggggttaaactaatgtgggtttgaatgctagctccactactttttaatgggtaattctttttttttatttttttattttttttattttttatttttttgagatggagtctcactcttttgcccaggctgaagtgcagtggtacaatctcggctcactgcaacctccgcctcccaggttcaagcgattctcatgccttagcctcccgagtagctgggactacaggccatgtgccaccacacccggctaatttttttgtatttttagtagagacagggtttcaccatgttggccaggctggtctcaaactcatgacctcaggtgatccacctgccttggcctcccacagtgctgagattacaggcgtgagccaccacgcctggcctttactgtgtaattctaacatcgcattaaactttctgattttcaattttattatctataaaatagagaagacaatatcagattcataggattgggaagactaatgagcatttaataattaatgagcacttaatgaaaacctgccaagtgccaggaatgtgaagagtgcttcacccatgttatcccactgaataccactattcttcttcttatttctaattgcatatgaataaattaagacatagagaggcaaaataacttgcctcaagtcatctaagtcagcagtggtaaaacatggatacaaacctaaaaactctgagctgagagtctatactctttagcccttgtgctaaaattcctggtactctgttgagggtcacctcaacacactgcttttactagtaataattaatagtgttaacattaaccacacaaataaaataaatcccccatcaagtctgcttggtctagaggatggtgcttggttttggtttttcacctcctctccactggaggtttgctgctacccctccatcagagtgggaatctgacccacccaaaccccatgcctcttgcttcgggccctaatctgccttactaatatcagccttcttaccttgaaggcagaaccctgttttactgcctacgttagtgattcccagagtgtacccaactaatcatgagttactaggtgataggttagaaaaatgtgatataaatgctgtgtttcaaaatccccttcttgccacatattagactcagagaggtcctgcagcaaatacatcagatcaattctgtttaacttggtgtttcccaaatttacttgaccacagaactctttcatgaccaactactaatagctcactttggaatattaattaacatatacactgtatttgtgtgaacatctctttgtgtcttgtgcattcgggtggccccacagcccttagtacaataatcagttaaggctcacagaatgaatgaatgaatgatgaaaaggatgagtgagtatctaataacaatcattgtgacactaactgttaatttgggaacggagagagagtgggcatttttcttttttgtttcctgatttctgtatcaatattctaaaatgcttagctctcaagttaaaattaagtcttacttggcataaatagagttgaataagtgattgtcaatacatggtttatataccttactttctttcttttttgtgagggaggttgttgggggaggggaagccagatgcagagaagggggatgaagaatagcaggttctgttctaggaaatattgcttttagtgaagtagcttttacttatcttatcactcccttggcacacattaagctaatgtactacttattaattattccagtatttcaccatgatattattaatcagaaattactttgatgttcatcttttcttttctttttttttttttttttgagatgaagtttccctctttttgcccaggctagagtgcagtggcgcaatcttggctcactgcaacctctgcctcccaggttcaagcgattctcctgcttcagcctcccgagtagctgggattacaggcgcctgccaccacggctggctaattttgtatttttagtagcgacagggtttcaccatgttggccaggctggtcttgaactcctgacctcaggtgatccatctgccttggcctcccaaagtgctgggattacaggtgtgaaccaccgtacccagccgatgttcatctttactatgtttttacttggcttgaactataatgctcccttttcacagtgctccatgagatcttcaatgacaaacacagtttcaaaacccacatactcacttttcacatttactattttggattgtatgataaagcaaacagccaatcattattctttgccttaaagaatctcaaaacatttacgagggcctactatggacctagagcgtgagttacctatccaataatagaagatggtgtgtgagatggtgagcagcacactttaaagattaaaaggacagttttagccatgacaaactttagcttgttttatttttcatacctcttcatattaaataattaggtcagattttcttggaagcagatgacataactttttataataaggaaaagaaatccttccttctcacctaattaactacaactcacattttagttccttaacttcagtccaaataaagtcctccctcctccctcatgcatgctcatagagctgtcttctttcccttcagaatatccacatttcctgtgagtggaatggcttttctccttcactaaactggagtcctgttaataagctggggctggcttggctcatcatgtcatctcctgcacctggcacagtgcatggcccagaagagccacgtcacaaatatttatgaataaatctgttgaaaaatacatatttattgaataaatcttgtttttttttttttttttagacagagtttcactcttgtcacccaggctggagtgcagtggtgcgatcttggctcactgcaacctctgcctcctgggttcaagtgattcttctgcctcagcctcctgagtagctgggattacaggtgtgcaaccatatccagctaatttttgtatttttggtagagagggggtttcaccatgttggccaggctggtcttgaactcctgaccttaggtgatccacccacctcagcctccaaaagtgctgggattacaggcatgagccaccaggcccggcctgaataaatcttattttatgcaacggtgactgaagttatcaaaataaggtaatgtagtacctggaacagtacttgactctctccagctatttttatttcaaactcttttgcttggaagtagaattccagatgaggtattagcatagttgggttagctccttggatcacattgggcacacttgtcaagtttttgatgccctaattcttaaataacatagagtttgtgttctaacatctaattgtcttaattgactagggcattgtgtttcctcttctaaacttgtaattatggatcactggactgagtgtaaagtagctattgcacagcccagcaaggaatgacaaagctatccttagtcaacaatagaaaaggtgatgaggggagcaaaccaagatggcagcccctagtgggggtgattcaacatcccttcttctagtgacataaaagaaggttagggtgtataaatgactctagcaaagacaagtttagatagatacagttacagttggttctgtggttttcaaaagtagagagtagccatctctctgggcattacgaccagtgctggaagcgaagagagatggtaattaaactgaggtgcagctgaggaaattcctggctcctcatacactttcgtatatcatatctaagaaagctggaaggctgaactctctgctgacaatggtgggggaggcaagggggcttttgttgaggttcctgctagtatggtgtcagcagattgtatattgacttaatgtttgatttgtgtgttttccagtacattctcctgaactccttgacataactttccagtaaaagtgcttgtctagtaagtcagatatttccaggagggctgggaaagtggaaccatgccacctggcattatttcataaaattaattacctgaacgaattcatgaaaaattgcaaatacaagtgctacaatatagagttactgggccatgccatatttcttctctctaacaattacctgtgttattttcacttaagtggggcttcattattttactctcagtggtcattgattctccactggaaaaaaaagatcttctgtgtttggtctcctgggatttgaaaagacctgacgataagactaaattggagcctgactcaggaaacaaagacgcttcccaggcaattgttcatctaatctggggatattcattaccagtcaatcaagatttgcctggaaaatttcccttaatatgagctttagatagaaagactagcagtcagcacagactcagagtccagagatctaaacctcactcaaggttgcacagtgggcagctttaagcaagcccctcacttctctaagcctgtttcctcagttataaaatgaatgtattcatgtgatatctctgcatatctgtctttttttttttctgagacggaatttcactcttgttgtccaggctggagtgcaatggcatgatcttggctcactgcaacctctgccttccaggttcaggcgactcttctgcctcagcttccccagtagctgggattacaggcacctgccacaatgcctggctaatttttttgtatttttagtagagatggggtttcaccatattggccaggctggtcttgaactcctgacctcaggtgatccaccctgctcctcggcctcccaatgcacatctcttaacattggagggaatgtcaaagttgatgatatatttaaagctcttggaaaactgaaggcacggaacaaaactaagtcagagttattaaaaggtggaatcaagcttagaacagagctatcagcagccataataaaataatagggtttattctgacaatctatgtttgtgggcttctaaacagatgtgtacataaagtaaggcttgtatttgagaaataaaggaggctagatttgagtttattcagtgagtgtgtaaatggagcctgcatcctcgccatcaccaccaccatggtcatcaccgtcatcatcactaccaacaagtgagcaacaactatgtgtaggcatgtggcaggactcttccttcccttcatgctaccgttcagttctctcaaaaactcaggaggcttctctgttactgtcctcattcaagaaaggaggaatgagaggctccaagaggttgccagtggttcccgaaacgggctgtgcatcaaaatgaccaggatttttttttttttttaaagtgcggatgtttgagccttgaccagctactgaaccaggtaaatcccaagcagctgaaaatccatgtccaagctccacagatgattttactgagcagacagacttgcaaatgactgggctaaataacttctccaaggttacgcagctggaagcaaagttgaactctaaccaaggttggccactggactcccgtgtcagctcttaaccacttttgtcttgttcgattggtggttaacagtgtatttaacaacaactgtcttttattgactttaattagtttttccacattctacatctactgttaaactacactgcaagactactttcccccagtaaccatttaggtgttttataataaatgacttagcccccaaggatcttttatagtctggccaactgctagttatatttacctatagatggagagtgtaactatccatgatgaaggttacaaaatgcgtgggtatgactatgggaactcataaccaatgatcaaatgacatctgtacattggtgaagggagtttttaatgagaggctgggatcaatgggcccagaggtagctgtgaaagcctctgcatggcttgggccatggtataagccagggtgttcccaacttaaatgtctgcatgaattacctggaaatcttattaaagtgcagatattgattcagcatttctggagtgggctctggagtttactttttggagctcccaggtgatgctaaagctgccagttcttgggtgtaagtacacatggccctaagacagctatgaagagatccactctcagcagaagaaccacaagccctgggagtgagcatcagacaactcctcactgacacggatactgactgggggcagaaacctgggaaggatgctcagaggtgagctactgaaagacccacgtagcaggggaaggcattgcccagagaaaaacctattatctatcatggagtaaggaagggtgatgagtgtaagtgaaacacttatatgctgagtagagggctcgcaggtgtatggttctgatagtgatgcacatttggaaatattctgtgtgttaagggagtgaattctagaccaacattggttgaatcagcagaaacaggaggaggatactgctggatgctgagattcttacaagtcaagccaaggaccccgtggaatgtacccccccagagcactgggtccagcttggatgaatgacactgcctcttgcgattgctgaatttctacacctacctgtcaggtaatagcattctactctgaacagccacatggaaataaataaacagtaactggagcaaaataacatgcgcttcagctaattccatttggggaagaaagagtctgagaaggactttgtgggtggaattgtataagggagaaaagaggaaataaccagagcatcggctgggttttaattaggcaggagtgtaatgaacccgtaactccaaaagcatcttagctatttagacctgtgaatataataagtagaaagaaactagattttgtggccaggcatggtggctcacgcctgtaatctcagcactttgggaggccaaggtgggcggatcacctgaggtcaggagttcgagaccagcctggccaacatggtgaaaccccatctctattaaaaatacaaaaattagctgggtgtgttggcaggcactggtaatcccagctactcaggaggctgaggctgaggctggagaattgcttgaacctgggaggcggaagttgcagtgagccaaggccgcgctatcgcactccagtctgggtgatagagtgagactccatctcaaaaaaataaaagaaaaaaagaaagaaactagattttgtgcatccacattcagtcccctgtcccactaggctaggcaaaaggaatctgggattgcagaaggacagggctcattcttcgacagacagcttctgtgacttggcctgggactctgatagcttggcaccttcaccaccccttgcagccctcaaggagaggcaaacctcaataaaatgactgggagagaaagccagaggaggaagcatccacagggcccatccagtaaggggggtggggtccctgacaccagaagcattgctgccctgggagaagtaacgaatgattgtagggccagcaacaaaataggctaaaacacagctgccttcagaggaggtgagctaagtaggagttgtgaggatctgaaggtcatatgccctccggcctaacagggccctcctcactcagctctgtggctaagcagagggtgggcccaggactgtaggagcttttgatttttttcaagagaagctaagattctgaatttttacataaaattgcctgtttttatttaaaaaatcattaataaaatcaaacctaaaaaatcaaaaagcaccggcagccaaataaaataaacttgcaagggagcatgagttggtgacctctgggctatttttttacgcaagttcagagagacagcatgggtttttagattgtacccagaggcggaagtacaaggcagggcaggtacacacaggacgttcctggcgctctcttctccaccttccttcccctgtcctctcttcttagcacttcctagggctttacattgtgttctacacttgtgtgggttcttcattttctgacactccttctcacagctagaataaaacctccaggaggccagagacctgtttgctaacagctgtatctctcattttttgactatatctggtacacagtaggcgctcaataaatagtggcccagttgaaaaggaatgactggtccatgctcccatctacaacatccaagccaggctgagttggtgtcacagacccctcatttcagggtctgtcatcgaattcagagtagttcatgaggctgctgtggaccagagtgacccagcataatccctatccagaattttaagacaaatacaatgctaccaaatccagttttattttgtatttctgtgtgtgtgtgtatgtgtgtgtgcgcgtgtgtgtgtgtgtgttttggttaaaaaaaatctgcaagagaggaagaaaaatacacatccatccgtggcgtatattcagctgtgatcatgaaaatactgagttattgtctgaaatcgtgtaaagcaagaacctgcattaagaaagcatagctaagcaaacaggcccgggacccatatctgctgacataccgtgctatcctgagactgccgcagaacatttgcaaagccgtgttctctaagaattctgcacagtgcaaacaggcatgaggggaaaaaatactactagggaacttctagttcttgctgaaaaggaaaattttgagctctaaatctagcactaccaagcaagagaggcatctgtggctgcatataaagctggtactcctttgcttgaacaaaatccctcagtatacagtacttaaaataaacaaagctcaaaacagtcagctacacacgcatgttttttggccacatgctgcctgaagaaaatagctatgcagtgtgcatgccctagtttaaaccaagcctgaataccgcacagtctcattcctctcccggtctccttttctagacagaaatacatttccctttaatgtacaagtgagaaaaaaatatgtttaaaagacagtccaggcccttgataaaagcacttactttgaaagaacaggacagactacgtattcaaaacaagagcgccttcttaaagtgcaggctcagaagttgttcaatggccaggaccttcatttgtgctggcagctctggtcctgctgggcatggttaagggcgaggctcgcagcccgcacggcgtggtccttcaggggtgctgcgtcaggctgacgctccggaacagttactgggacaggctgtgagcgactcaccaggacagttttatttctgtgctgagcttgctgcttcctgctgggaaaatgttagtggcggagtcacacccaggtaccgggccgcagccaaggctccgcagatgacccgagttctgatggaggtggggacgggcggcgcccggcacctagggggcagagggcgagcaatcccggaagaagactcacgctaggcgattggtctcctcacgggagctcctcgaccctgccaagggcatgactcagctcacccagggcagtgctggaccacactatttatcccctaaggtccaggaaagccgagttcaggcaatgactggcgaagagctagaggggaggcagggaggcccctaagtcactggggtctagaggttgtggcctcacatgcacacagattcagcccctttctctttggtagctgttgcaatagagtggcctaggactccgaccctgaaaactatgaggagggggaggggaaacaggaggagaacggggagatgggggaagagggacaggagaaggaggaggaaaaggaggaggaggaggaggaggaggaggaggaaaaggaggaggaggaggaggaggagggagagtaaagcagccggccttacaatggaggttccaaatcaataagtgtagagaattaatgatgtcctgattttctgttggtgtcaggatgacaaactgcagagttagaagagaggcttctcatgactttgtcaatttatatctgcacaacattataaccaaaagcaagccggagattagtggaagtttagggaagctggctgtggttctacacctctgtctcctgatacgttctagacccaggatgtgtctagatgaaggatgtggtggggcggggtatggtgtagggaacctcaggatcgttttcagtttggaagatttaagcaagaacataaaagttctggagccacagattttctttattgtgtagagtatggggtgaaggagactgatgtaacaatgcccattctgtgtcaggagaggggtgttgctgtcaggagccctggggctccacctcagccctgcgatctctgggtgatctctgatgacacacaacctctctgggctcctctctctttcttcttctttctctcctctcctcacctctcctcctctcctttgtctttctcttccctccctctctccattgttttccctccctccctcccttccttccttcctctctccctccctcccttcttgcttgctttcttctttctctctttctttccttccttccttcttccttccttctttcctttctctttttctttccttccctccttttttctctctcttttttcctctttcccttcctccctccttccttccttcctctctccctccctttcttgcttgctttcttctttctttccttccttccttcttccttccttcttacctttctctctctttcttttctttccttccctccttcttttctttttttctctctcttttttcctctctttcccttcctccctccctccttccttcctttcttccttccttcttccctccctccctctccccttccttcctccctccctccctccctctccccttccttcctctctctctctctttctttccttccatagcatcttgctctgttgcctaggctggagtgcaatggcacgattatagcccactgcagcctctaactcctgggctcaagcaattctgcctcaaccaccagagtaactgtgactgcaggtgcactgccatgcctggctaaaattttatttttattagagatggggtctcaccatgttgcccaggcttatatagactggtctcaagctatcctcccgctatccccctcccaaagtgctggattacaggcatgagccactgtgcctggtctgggcttcactttcgacatgagaagttgttatgatccctcaaattttagtgccctattcttccatgtcctgccatctagcacatgccctaaacagaaggaaatcaaatgaaccaagttttcctgcatatttcttccattgtcctcccttcattcctctaccttaaggcagtaaattccaccaaaggatcacaccttggcattgtagtcaaaacagagctaaactctgaacagcccagaggaactgattttctagtctttggagagtatagcagacatggagctgtgcttctcttttaagaacagattcattgcctagttgtcaggatgctgtcagctgacagcttccagccaccaactccttccactccacctatgtatggaggggtgctcaggctctctttagggtgccttggcctaacattaagctagttggggatgcaggggtctagccattcccacccaacactgggtctctgaacaggcagtttttgctcctgagagtccactgggctggcagaggctctgccaggctgcagcccccacacaattccacttcctccctttccctgtcacaaacgttagttctctcttgccctctcaggggacctaacagacacagagatgccagtcatttgcaatgcatgttttgttttttctccacagagggcctttgataggcttagaaagccatctttgggtgacaagatacttgtctttgtagcataaagatcttcagcacagatttctttctcattctcttattcacagatgtggaaaggcttagttcccgtcaggtctagctagtgtttctcaaccaggagtgcataccagaattacctagagaccttttcagtgtgcaactacacaggcttcacgtgcagagctagacttggtggtttgcgatgtacccctggttgagaaccggtgtttatagcataaaattcttccttgtatgagcctctcccagagataagcattcatcctgctaaggatcattccagaagctgaaaatacattaagtggtcaattaaatgatccctagtttatttcctttcttttttagagacaaggtcttgctacgtcacgcaggctggaatgcagtggtgccatattagctcactgtagcctggaactcctgggctcaagcgattctccctgttcagcctcctcagtagctgggactacaggcacacaccatcatgcccagctaatttttttttttttatttttcatagaaatgggatctccctatggctcgggctggtctcatactcgtggcgtcaagtgatcctcctgccttagcctccagagcttatttccagatattttcataagtccacctagtagtgctgcagactcatttcagagcatgatgaatcttcttataaaatattaggggaaggtgtagggaactttgagattatttttaattttgaagatttacatgaaagcacagaagttatggggccatagattccctttactgagtaaggtgcggggtaaggagctttgcatttaacttccaggaaacctggaaataaggttgctgcatcctgtcctttcaggttccctgtgtcattgcaggaggctgtactgatgctcatgttttgtttcacaagctaagtccttgacagcatcagctgggatcccagtcttctctctcatgttacccagtgagaactcactcacataaatgtcaggggagaatacttggccttctgtttcctggatcactgaataaaatcccctatgatgatctgtgtgcgtatttggctttgctgtttggttccaggagttttatttcaaggcaaagcttgtatctgaagatgccatgagctgagattgtctaggactgagaagccctaacttcccaaggacactagtcctggaaagaagaaagaggcggcattcttcctgaatgtgaaatgcactcagaaggaactgcttggtatttaaaaactacttctcattctatctttaaagccaaagagaaaacaccgaagtccaaggggaatgcaaacagactgagtgctatggaaactttctcttagcaaaattaacgccttccccaagggatggctggagggtggagtaagctgagtgaactggggaaatcaaggctttgctgagctctgagttgtgaaaatggtacagaggaagtggctcctgagcgcacaccaagctgggatactcaaggagataaaggggaatttaagtgactgtgctgacactgttcctggatgtttggcagcacaggattaagtattaatttaatgcttccttaatccaacacatgctatgctcattctttaagtgcattaggcagaacttgtgaattaagagagctgccctctgcatgagtaggcagcagggccctgtggcagaggagaagctgcctctgcatgtgagcgtggcctcatcttcccgcccgctgacgcgtaccaaggcacacactgaacatctcagggcgtccctctccttcttgcagggttatttcaaggattagctgaatatgcatgtggatgtgcttaataaatttgcaaagtgctatgcaaatgtgggcttttatttcctttttagagaaaagcctcacatcaggattggctgagtattacccgagcagcacagggcccagtggatggactccagctcagacaggcagacctcagtgggaatcaatgctcctcagttacccactgggagacttcagagcagccactcaaccctccatgacccagttccctcgtacatcaaatggggacaatgatcatacctacctctcaggagaggagctcatggggagctcattcggcacaaaccatgattcatggtgcccagtaaatgtgagctgtgatgactgtaaacctgggctgtcaccaaaagtaaaaccatgacacagaggaaggaggaccattggcaggaagtcttggggagctggtggaaagtacttccagggaaagcaaccctgctgcaagagcccatcctaatgagccatcagcctcccagaggatggcctggctctgagtcaggaggagaagctgttgctcttgtctcaaggcctatttctgtctgtccatatcaactgtacagcaattacccatagacagcggagctctcagctgtaattctggaagtagcatcatagaatgtttccaggtacaaattcacttgtaacaactgtacgttcacatcacacaaggaggactccacatgcaaaaacatcatctcaaaatggagcacagtcgaattctggggtggatgcaggtggtggggagggagggtgatggatctcaaatgtccagccacacttgagataattcctgggctgggcaaccgcaatggccctaggctgaggcacattccattatgagtggagtgggtttataatggaatgacatggatggtttcttataatcagaaaagcacactgaccttcacactacacaggtgcagcagcataatgacccaccacgtgtacgcgcatcaattcctggggaaaagtccaacgaggttaacttagcgtgtatcccaagcaaacaaaatcagcaacattacccacacaaacaacattgtttcccccacccccgccaagatacctggcctgggcaaccgacgtgcaaaaggaaaaatcacacaaggaccacactcattttgataaagtggataaaaagttgcaagcaacattattctgtgccataagtaatttgatttgattttaaattttaatttaaggaatgagactcatgagcctagaatttttttttttctttttcaagaaacaaggatctggtgtgggtgtttgtggggaaagagaagttctgctctcccagccgtctgagaaggccagcgaaaagcatcctcacatatgatccactcctgaagctccctcaaccacaaaggaaggggaatctacagttaaactgctgaaaattcactgcctgtttcagtgcccttactccctcaggcatttactcagatgggaaagactcaagaagtgccatccccttccacttgttgtcctgcggagtgactgtcaccacaataaacttggcatcactggtctcaccattggcactttagagctaccatgtccaaaattagcatacaggacttgagcagagatgccaggcatgggacagttgctgacggcatcatctgtcagggccctcttaatccaggtattgttttggttcatacgtctttattctgattttataacctcatcttccttgggagttacagtcaccatgaaaataatcaatgtggcctgattccagaaaaaagcagtctatgatgtcagcattcccaaaccccgatgaaacctgaagctttgctgacaaatgaagtcgtgtaagaaacaagtagcaagcttgcattctgggtgcagagattatgttctcaaccctggtccaagcagatctgaatagaagacggagagaattcaacatctacgtactgagatcctgctctgtgtccaacgccctggtggacgctactggacttctcagtggtgacgcacaccgtgcagcacccttgctccttcccgctccctgccacagccactggcttcctggatggttctcaggctgccccagctctgccccatctgcaggctcccctgcactgccttcctccttggagaaggtccaactaggaaaagacgcaagaaggaacacactagggccatgtccctgcctctggccttagttaccatgtgaacatcgccaactctccaatttctgtgataggtcagagcactcatctgatgtccagacccagtccccatccactggagctttgcgcagccacccaagcaccatgcaagaaaaactcaggatctttattcctatgcccaagcttcccttaaaagtctagccttagtcatggttcctctgccgcttagagctccctgtcaggaacttggacagctttctttctccagtcctctttcttcatcctttttgtccaaccaagcactgagttcgtctgctcctacctcctaacggttctagaattcatctgcctctcaccatttctgcctcctccagcgtggtccaaacctccctctcccactcaactcccatggagcctaaccggcctcctcgtctgcacctttgctcttaatacagtctccataatggacagaacactttattgaaaaaggaaacctgatgtcgcccttccttgttttagtggcttcacacttcctttaggctaaagctctaaataccagtttgagacttactttatacaaacatgcaaagtggatctggtcctccctcctccctgacctcactgctgcctccctcctcctgacctgtgacactctggccacttgggaatcctacagtctccagaggcacttatttaccccttccttggagatgtcagtgtgctgtccctgctgcctgacctgagctgccgtcagcccttcttcctccacaccccccactccttggcctcccctgtgcttccccttcccccatgacagaggcctgggaatagtaccctgtagttattattttttgacagttttaaaaataattctaatgaactgtttatgtatatatttgtttaatgtctatcttgcaaaattgactcagaattctctgggagctggggctgccatcctcagcacttagcacagagcctggtatagggtgtgctcactgtcctaagccaaatattgatccaattaattaaacacacacacacacacacacacacacacacacacacacacacacatacattaggagagtaaaaagaagaggaaaaaagaccactcaaatgggctgtttagacattatctatttagcacttagtactggggataccggtgtatttcactttacagtttactgtaaattatttctttacagtttactaattgtttaactgcaaagcttgactctggaaataaaaaaagaatgagagcagaagtggagacttcataaagaaagtgaatggggatcaaaaaggatccagctccagctcctggaagcttaccccaccccaccaaagagaacctggatggaaccctctttcatcaggaataaactggagcccaaggaaatgaaggaatcagatggggaccaagtgacctgtccacacaaaagccatctgatgagtgcttctactccctgctcgcagcccaccttcagctacacagatctgcacggccccttgcttctgccatatgggatccagcctgacagcagcgaatgagtgcacagatttcaagtagaggaaatccccaggaaatggcaagggacagtattaggaatcgacaaagtactactttaaaataaccttagattagatgattcttccttcaaaggcacaactggtttacacacagctatacacagccagttcctctgttggactcaagtggccatgaccctcaggaaaatcctctaggagtgctcggcacagggcagcaggaagtcacgtggggagggtccctctgcagacccttgtggcacagcaataggagagcagggcggtgttggaggcccagccctgcctgaggccacttcttcataggtcctggctgccgcaccctgcttatgccctgcaaacccctggcacctctctaaagccctgtgaatcaaccatctgacacggcctgtcactactcatcaacgctgactggcagtgacaccacctctgaggcctgatgctctgccacagctgctaggtcacctgagtagagttaggattattaaaaatcaaatgaaccaagcaggatgtttctcctgggcaaatatttatctgtccctacccaaatgaactaagattaaaaaccaaatattagaaagcacgttacccttcagaccatactgtgatttatcataggctaaaacaaattgtttcattgttttgcttccctcctctttcattcggtctgtcgtctgataagtggaggattttttgaggaagaggtcaagatcattcatgggtggaatacataaaagctagcaatataaaagatgacatttatttatttattattactttatttgagacggagtcttgctctgtcgcctaggctggagtgtagtggccagatctcggctcactgcaagctccgcctcccgggttcacgccattctcctgcctcagcctcccgagtagctaggactacaagcgcccaccaccatgcctggctttttgtatttttagtagagatggggtttcaccgtgtcagccaggatggtctcgatctcctgacctcgtgattctcccgcctcggcctcccaaagtgctgggattacaggcgtgagccaccgtgcctggcaaaagatgacatttaaaaaaaactttttttcctaattatagaaacaaagtacatttgcttttgaaaagccaagccatacggacgacaaacaatatgatgaaaggtcactcagaaccccaccctagaagaaagccagaagtcctggttcgggtaaggttctcttttttatggggtggtttgagagaggcccagccagtgtgccgccttctgggagggacatgtccctacaggtctggggctgtaagagcgcatcacagctaagaagccctggagtggctggtcctcaaagggggcttgtgatatttaaaaataatttacacttattttaagtgggtgtatctgacatccccagaaatctggtcagctggggcaagtgcccctcacaaaagactatcattgtgactgtcaattattttaagttgtcctaagtatggacaattggcatttaggatttgttgagttccagcaggaggtgccaagctgtagagatatttaaagacatacaattcctatttcagtgaccccaaacccctcaaggaaatttacggcccgcctcttctatctttgccctctagggcaaagaccctagcacagtgtgcgccatctaataactatttgccgacagaccaaccaacccggtacatgaaggaagggaaagcctgtgtgtgcattcccatatatgtggttaattcctgaaatgtcacactagacacccttgcaaagacaaagtaagctcagttgcacatattttgaaggggatttttaaaacttgcttcttcttagagaccagaaaattacatttgctaatttaacaaaactattctttgttgcaagagcccaagaggtgggatgaagagtttcactagatcgtctcccttttggctgatgtcacagcaaatattcatcagccatcagccagactggatagcaggccaaaaacgtggccgtctggtctcacgttggaagttctgttttaaactttgtgaccttgattccatcagcatgagttggggtctgactgattttgttttgtcccaatctattgtctttcagtcccttgttttgatccaacatcaattttcaggagatataaaatttactgttatataacattatggtgttattgtcactgaattcattttcctgggaggaggtctctttatgatccaatacctaatagcatcatttcctgtcagcaatgacttacaatgccttccaaattcccaggcccctcctctatgacagaaaaaccctcttacattagagggaaaaaaaaggctttgacaaatagtccaggctttacttgaagagcatgaacttagtggtatagccagtgggctattcctttttaaagatatttattttactcatatatttttcattttcattcattcatacattttttcacttctctagcatatccatacggcgaaacaatgacacacagggagaacataaagatggcttcactttaaacttccacgttccctaacttcccatttgacactttcttcccaagctgagggagccatccttgtttgtagatagactggtccaaagatccagtttgtccctagaggaacagttctaactccataccaggcaacataaatatgaccacctgtgggtgtggccacctcctccccaggccttactcctcagactccaatttctgagcaccagagggaaaagtcacatgagaagtcaagctgggtcctggagccaaggtggtaagaacagggatggggacagcttctggacagcacccactctggtgccagcatcatggccatgagctgggacccctccccaccagtgccatccctcccaatgcagcgctttattgctgctcagcccagagctgtttgctttcttccctaaccttcatgtttcatctgaggcacatctgtggtgggcaaacacacgtaatagaactccatccttgaataactccacaacagagctgtcttctaagaataatagctaatcctagggtgttttcattaaaaacagatttcagtgacagactatcaaaacattttccttttacaaaaagcaatatgatggggcagaattatgcaaaggatacaggcttcactctgccctgagcaaccaagggccctctcccatcggcttcagtatctcatttaactttcctgtcatggatatgcaagcagactaagtcctactcagcgcttttgcaggctccaagtgggggcggcgggggggaaagactggtgaattgcatttctgcctctattttcaaaatctgtcaccagttatccttgaggggtggtttgcttgtgttcttagggagttggagaggtattatctagcaaagcaggctcagagtcacccaacatgcattgactgtctcccacatagctggcattgttttgggagctgcagatacaatggtaaatgctcatcttgctttacacatattaacccatttgatcctcacaataatctagcgaggcagttcctataactgtctacactttacagaggaggaaactgaggcatggagagtcactgtaatatgcccaatgtcatgcaagtagtaaggagcagaaaagcagattcagagccaggcacctggctccagagtgccaatgctcagtggtccactctgcaaagattagtgtggtccctgcccttcaggaggggagacacaccgaacagatgagctgaacacacaacaagatgttacagcattccatttaagagccgaggagggctccaggcaggtcttctccagtgatttacattttattttggtcagaaatacctttaagacactggcagcaatgtcccttttccccagaacctctgaagccccagcttccattaggcaaacagtcacactttacctacctacctacctacctacctacctacctacctacctacctacctacttccttccttccttccttctttttttctttcttccctccctcccatccctgcttcctccctccctccctccttctcctccctagttttcactttacctttatagtctcttctttctgaaattaatcattgggtatagttagtttttttttggtttcatttactattgtgaaaggaaaataaatctcgggacccccaaatcactaagccaagggaaaactcaaggtggcaactatggcaggcaaacctgcttcccattttattcctaaataaggcagctacaaagatttttaaaaagctacacaactccctcataatgtgcccacaaggaaatttgttgtgggcctcatgatctttaccctaaaacagttctgttgaatttcaccctggcaatgtaaactgatagctaatcttcacagctcacctgagacaaatgcatatttgattgcttcctctgccctactgtttatgtaaaaatgcagattcaccgagccagactacattgagtattcagcgaaaggctgatcaaggactcaaaagaatgcaatcttctgtctcttatctacctatgacctggaagttcctgcttcaagttttcccaccttttgggaccaaaccaatgtacatcttatacatattgattgacgtctcatgtctccctaaaatgtacaaaagaaagctgtaccccaaccaccttgggcctcaggacctgacaccgtcaggagtgcagccttaaccttgccaaaagaaactttctaaattgactgacacctgtgtcagacactttgaattcacactatttcatttgagcttttcccccccatgaatggtttcccaaatcacttaataattttagtaattacttaaataatgatatagattaagtaatcacttaatatatcataatatctgaaatttcttattaacttgtgtctatttcaggactttactcctattgctctttccattcatatgcccacacatgaagttttagtgtttgcatgtgtgtatatacacggactagtgcatataaacatatttactgtatatttattatatatatcacattgggtagcacaggtacctccttcattaattttaatttctcatttctataaaagaaacggagtctcactatgtcgcccaggctgttctcaaactcctgggctcaagtgatcctcccctcttggcatcccaaagtgctgggattactggtgtgaaccaccgtgcccggcacttcattaatttttgaaataagttctcttagctgtgcttgcatttttatccatctagaatccagagagctggttactgtgggcccaggggagtgtgctgggtgtgtaggagaatgccacccacacccatgcccacactcaggactccccaccaagatgccagtagagcccaatactgagacccactggccatcctccagaacataaagattcacgtatcttgttagtgggattaaattaaactaacaaatgactatgggaaagttttgcacattaagttatcccatccaggagcaccatgtctctgtatggattaaattcctgttttcatttttaaaatgaatcttcatagatttcctcatgtagctcacacaaagtcctggctgcttggtagtccatgttttctttttcttgagttcaaaatgttttctgaaattatcataggcttgggccaaggatgcctctcttattccgcagttttaaagaataatagtcccttattcccttctgttgtcttttatcagtctagtatttgttcccaagtattatctttaaacacttttcctggtctgaagtgcaggctgggaggacagaggtcccccatcaaggagggccaaacctcctcctgctgtggccactcctcagagcagggggtactctctgtggatttcaccccaagtaaggtgatgggtgtgggggccggggaactccacttcttcctgcagggtccccagggacagagctccgggctcccttggatatggctctgccagttccaggggaggctctcctgacctggccagccccaggtgtgctctggctggcttccaagggactagtgccatcaagacttgggtctggaccacgggtctggcaggggattggccggatttgctggtgattcactattgtgaggcaatgagatagggaggagaggcctgcacagggacccagatagtcatgaaaggcgaccttattcagcatttatttcatttgctgtgcacatatttcctttcagggcctcatgtggagggggcttttcattcatgcattcactcagcaaatgtttgtggtgggccaacttcataccaggcactgtggatcaggcaatacgtgagtgagcaacacagcctacaggccctggctgtggagctcgtgttgagggaaagagagcaaccaaaaacacaataaataagtaaactgcacatgttagagatcatgcaacttcaagaaataacaaatgagaaatgaaatgttaagacgtgggtaggagatgaaggtttccctgggtctccaggaaaagcttcaaagataaggaggttttgaataaagacctgaaggaagaaaaggaagtgtccattcctgcccaagggaagaatattccaggcaaaaaaaaaggcctgaggtgggagagcatctgcagaggccagtgtggccagaacatggggaacaaaggggaggacagaaggaaataaagctggggatgtcacaaggggccgggttgtgttaggcttctagttcactggaaggactctggtgttcacacattgcaaggtgggaagtcactggtgagccctgagtggggaagcgacatgatctggctggcagcgagcaggggctctctggctgctgctttaggaacacactggaaggatgaggagggaggaagttgggagaccttgcaagaatctaggccagacacggtggtgtgaacagggtgggagaggtgtgggtggtgagaatttggcagaattgtagacagaagagagctgtcactggcagggcggtattgcatgtaatttgtaaagtctgtggataaccttttgcttgtttagcaacccgtatattgcacgctgctcttgcagactgtggagagaagctggctgctcctcacctgctcatctcgctacctgcgatgaagcttatttctggatgatatgaagtatcttatctttcccgtaccagaagctgcaatctatttccatgcctctctctctctgaatctgcctttttctattgaggctatcacagcttctattatgcccattgtgttgctatacctacttccagctttgctgcatttttgggaactggagagctccaataaacacaggaagagaggagcaagtggaggctttgagactgactggtgcaggcctggagctactgaggacaggtgaaatgtgcaggtaggcagaggtctgggctgatcttcagagtccagttgcacctttatcctggaaatcagttgtggagtcagatataccgatccctatttctagcttccacaaaagtattattttgcaccattttggaagctttcataaaactatttttatggaagttattatttgggggaaggagaggcatccaggaaaatctatcatcggcctgctaaatggactgcaccaccaccttttccaattacatatttttccactggataatattttaagattctacagacacatgagtgtctaagacattgaaaagcaaacagcagcatctttcaacataaatatattaaagcccataggcatgcactgacttggatatatgcgactgtctgtggtcaactcttgtctttaccataatagaatctaaaaagtcctggagactaaataaattatgttagttggtgataggatatggagggctaatgaggcaagaaaaattataatatccaaattgtgattttttttagtaactgttgtttctacattgaatatatatgaaaacattaagagtttccagatgtgatattgaacatagaaatagaggttctgggagatagtaacaaccagctagggagaaggagagaagttagattttggatccagtctctatatgtcagtcaaaggagaatatgtgcctgctgagaactatgagccagaggggcactcatctccacaactctgaaaactgggtctctacaactaaacacagtaatcagaatattaaaaagcatgagtgtcatgaaacaatgttccatgaatatttttgtgtttttggtgttaatgatttctgagcaaaggcacatgggttaaaggacgattattggctatcctaaagatagagacttctggagaaatataaagtcttctctcttctggagatggtgaaagcctagagtcctttgcctcctctccccagagaggattattttacattccagagcggaggtctggctttggccaattaaatgtgatgttcactgtaagcaagaagttttaagaggtatcatgagtttcaccatccctcttgctactgccccttttcccgcaagaacatcatgttcagttctagattgggctatgccttcagcctacacttcagaagcacatctgagcccaaaccacaagaggaaggaaagctgcagctgacccacagccaaatgtgatgtgagtgagaaataagcttttgttgtggaagccactgagattgtatgggtatttatttcacagcataaccagcaaaagcaagctaatgcagttgcacagccagcctccatttctactcttcttctgaattaaattccactgctcggggcaagatggcatgtcctgattcttttatgccaccagcacttggcttttccctaaattgacctactttgaaggagggttcttatagttcaccagtggaggacgggttctggcacaaatagagacttgtaaggttgcatttaaggatgtctttcttctttcctgtggcccattcaaactatcccaatcaaccaggtcctctactttttctttttgtatttgctggtttctttctttcattgaaattccaagctctttccttacaatcagttttctccaattactgtcaactctgggatcaaattcctccaagaggttcctttttttttttttttttttttgagatggagtctcgctctgtcgcccaggctggagtgcagtggtgggatctcagctcactgcaagctccgcctcccgggttcacgccattctcctgccttagcctcccaagtagctgggactacaggcgcccgccaccacgcctggctaatttttttttttgtattttttagtagagacagggtttcactgtgttagccaggatggtctcaatctcctgacctcgtgatccgcccaccttggcctcccaaagtgctgggattacaggcgtgagccaccgcgcctggccccaagaggttcttatgtcagaatacattttgtgtgccctcctcaatgctgccaccgggacttggttcctgctgacgacagctgaggatctatgttactggtataagcccacagctgaattcctatatcttcaccccaagcattgaaaaccaggggaagtatgtctctggcaccatccaaggtctacatagtcaccttgaatctactatcttgggtccttttcaatctctttagctggcaagcagtgagtctccgtgaaggcactaagttccctaactggcatccaatagtttgaggaattctaaggtggaacatgattttaatggtagcacactgagcaaagcagataacatgccttggtggaaatcaattcagtgaatccacgtcatgtgaaaacaccaacagggatgctttcagatttgtaaatgcccagaaaaaaagacttacattcaaggggctgtgatgggagggacatatgattcccagctgtggaaaggacagaagtgcagagggaggtagagaagccccagttcaagtctcattctgctactttctggctgtgggatcttatggaagttagttagcctctctaaatgttagtttcttacttgtcaatgagaattagaattctatctacttcatagtgctgtcaacagattttggagggaaaataaatgcagaggactaaagaatagcaccagacacatagcatctattccctacagaacagacagaggattcagtgttgaaaaaggcatgtcaaactcaggagctggagggccctgatgatgtgctaatgcttggaagagctgcaaccaacagtccctttctgctttaatttattttttttaaatcttggcatactttcagacttacagagaagttgtatgaatatgacaatgaattccctaatatatttcactcagattctccaaatgttcacattttgctgtttgtttttcctttttctgtctctctgtatgtgagagacatataatttatatacgtatacatatttatacatacatatgtgtcatgtttttctgaaccattcaagagtaatctgttgacaggatgctcccatactcctaaatactatgatgcatatttcctaaaaacaggacattcttttatatacctacagtacaattataaaaatcaggatattaatctcaacatggtcctattatctaatctacagaccttattcagatctcatcaatgttctcaataatgtcctttgtgaaaaagaaaaatccaagatgcaagatcttgtgttatattgagttcagttgttttctttgtattccatgacactggttgtttttatttatttatttttgagacagagtctctctctgtcacccaggctggagtacagtggtgcgatcttggctcattgcaacctctgcctccagggttcaagtgattctctggcctcagcctcctgagtagctaggactataggtacccgccaccatgcccagctaattttttgtatttttagtagagatggagtttcaccatgttggccaggctggtctcaaactcctgacctcaagcaatcctcccgcctcggtctccccaagtgctgggattacaggcgtgagccactgtgcccagcccactgatggtttttaagggtataggctagttactttgtacaatactgcccactttaaatttgcctgatgtttccttgtgataagagtcaggctctgacttcagcaggagccacagaagccacgatgaaccctcaatgccctgtaacaggaggtattaggctggtgcaaaagttaccgtggtttttgccatcaaaagtatggcaaaaaagacccacaattacttttgcaccaacccaatacaagctgcactgatgatggcaactcttggttaaggtgctgtctgtcagatttctccactgtaaagtcactattttatcctttgtaaataatgagtatcttgtggagagacactcggaaattacataaatatactgttacttctcaaaatttcacccatttcctttaccatccattaactagtttttgcttgaatcagaggccgctttatttatttatagcccattaattttttttttaacttttattttaggttcaggtgtgcctgtgcagatttgttgtacaggcaaacttgtgtcacaggggattgtggtacagattatttcatcacccaggtactaaacctagtacccaacagttatcttttctgctcccctccccctcccactctccaccctcaagtagatcccagtgtctgttgttcccttcttatgtgttcatgagttctcatcatttagctcccacttataagtgagaacatgctgtctttggtttttttctgttcctgtgttagtttgctaatgataatggcagaggtctctttttaaacagagttttgaattctatcgtttaagaaatattttccatggcaatggatcttaggagactcatcaaagccattatggtgtaaagcatccctccaaaaaaatgaactcctatttggtgtcagctgattgcaaagacttcaacatagggaaggaggagagagctcaacaccggaaacgtatctaatttaccagaaagcgaatacaaattaaatgtctcttgaccttaaggtacagcagctatctcacatctggtttaaacagagcattaattgttcttcctttttattacaaaaataattcattcgtactgtggaaaatctgaaagctataaaaagcagaaaacagaagaaaaaaagacactcatgatgcagaatctaccactgttaaccaatttggtagattcctcgttgtcatttgtttttccttttcttttgtcttaagacatattgtatacgcaattttatattccaattttaataactggaattcattgaaaattctaacatagtttcataaattttaatggatgccttttataagcatactaccatttagttttttgataccattttggacacgtagattgtttatatttttgctattaaataatcgtggagaagcatctttgcacacacacaaaatgtgtactgcattttgcttcatttgtgtaagaaatattatggcctgaatgagcatagctgagtgaaaggctatgaatacatagccaagtgaacttacaaaagggcctaatttatacccagctggtgatccatgcaagtgttcttctcccccaaactcaacaacattgagtgttcccatagttctttgcacctcctgacggtacattttcaaccttctcttagccaatttatattgccctgttgtgagctgtctgatcttgttctttaaagccttatctactcaagcttgctattattttttacttaagtatatgagctctgtgaattctaaaatatcaagctgcttttttttttttgattttgtagagatgaggtctctgtatgttgcccaggctggtcttgaactcctagactcaagtgattcccctgccttggcctcccaaagtgctgggattacaggcgtgagccactgtgcctggcctacaagattttgtctaacatacttgttgcaaatattttccctgggcgttatttgctttttaattttgtgtatctggctgttaatggaagatttccaattttatgtgttaaaactattctttctggttcctcctaacactttaattttggaaagccctgcttactcacccttcccagccagatagaggtaaacattatttctacacccatctagcatgtgatagcactattttgaaaacatcagctcttagatccatttgtaatttatttgggtgcatgtgaataacatacttcttccttactggtaacctgcttcccccttatcatgtatcagatttttctgtgtgccagaatttactctgagttgtgcagtttcatggatgtattgctttttctgtagtcaggatcacattttgttcattatggtagctttaaaatacagtcgtattaatcttatttcattcctcttctttgccctcttgaaatgtacctcttctggactattcattatttcagaatattttaaaataatgttaataatttcaagtaagaaaaaatgtcaattaacagaaaaatagaggatattttattaataacatcataaactatatatgaattaacataaaatgtaactttacaatattcagttttctcatgaaagaacatggcatattggtagattaaattaaatcttttatgtttcttagtaaagttttgtacttttattacatactttctgcacttagtgattaaagtatggatagtttatattttcattatcattgaaacccagacgctttttaaatgacttaaattttatatttgaatactgttagctttgtaaacttatattaattcaaataactagatattttccttacactttacaggtataaactcacacccctaaaaaaaaatgaccatttgttctccttaaaatagccatccctggagcttttgcttcacatattatttcagtagcctgaatttcaagatcaatgttaaataatcactaaaaacagtggtcaatttcatattgtttctgtcagtgacaggaatgcatttaacataaagcaggacactgggcattaaataatgaaataattaatgttaataatgagacattaatgagagaggcattgacttccagattatattgtctagatgaatatattcttttaatatgtcattttgctaaaaataatggcaaccatggtcatccaaatatgacaggcagttttcatgacgttgtgacagccgtgaaaatgtagtgcgtagattttggacggctggagatggcccccatcctgtgttctggagcccccacacgcaggccatcctctgcaggctgccctgaccaatgactgaacacagcagggatgcagagggcgcccatgtgcgggagacgccaggctcttcggagggcagcattttagaaatgatgttgctgcctgggggcttctgctccaccctcctcccttgcactctctttcaggagggtcaggccttttcccctcacaggctctttcctcacccatctcctgcatgtccagtcccaccctggcacccgcttcgtcaaggatctggaacgacacagaccctaatggtttggtctgtgaatagaaaagccaggctgctttactgtcgttttcgacctgtcagttgagtgacaatgttattttgaaatctcttacttccacgagatgaaaaaagtaaagcatttagacagtgaattattagtaacaagcgctggagggcacttacatgtggcagagcccctttcctgataccatctcgtgatcctcaacatcatcaccccactggggaggcagggtagatattcctgacttcattttaagacaaaccaaccaataatagaagtctcaggttgtttaaaggatatgagcaaaattacggaaataagaaggacagagtcaaggctagagtttgtaacatttgaacttttatcaaaattttttccattttaaccccgatgttccgaacctaaattcatataaagcatgatattattatttggtttacaaaagcacatatggtatttagtggcattttgaattttcatgtaggcatctaaaaataataagatgcaaatccaaatcaaaggtctattcaactggccaggcatggtgacacctataatcccagtactttgggaggccaaagcgggaggattgcttgagtccaggagatcgagaccagcctgggcaacatactgtgacctcgtctctactaaaaataaaaaaaaagttagctgagttggtggcatgtgcctgtggtcccagctactcaggaggctgaggcaggatgatcagtcgaagctgcagacagctgcgatcatactactgcattccagcctcggtgacacagtgagaccctgtcccaaaaaaaaaaagatctattcagttaataatcatggcatcctatgtagattctatattgatctcatagaaaatcagcagcattttctatcattattcatggtttttaataattttttggtagcatgaatagtttcataatcataattttaaaagttcctcacattataggaataaaattcttatttgggatacttacctacattaatataggcatctcgggttttctggtttaatctttctataatatttccttgatgtatattccaaaatttatttatctgttctcctacagatgagcatttaggttgtttccagtttttttattttgctatttcaagcaaatcgctttcttacctacaactggttatacatatgagtggtttccccagggtatgcacaagcccacgtctcttggtgcagtaagtcagcccatcctccactttgctaggtggggccttcgtgctcaccaaagggaagggaagagttgattctcccaccatctgtgcagttcacctatttttacactctttccagtacttgctatcgccagccttctttgtttttaactcgatggttgtaaaataatttaagtctccagtcatggcttcaaccatgaaaaacagtccagccaccatctgatagctgggtgagtccctcgatctggctcagtccatctccaggatctccaggcccctgacaaacctccaatgtgtcacctgtcatcttcccccacacctttgctacaggatttacctgccaccaatctaatcatgtcatttctttgctcaaaacactcaataggccccgagttgcctgcaggatgaatacaaactcaccagcacagcaaacagcctgaaaagctggccttatccctgccctttttccaggcctctcccagccactccctccactacacccacgtccctcctgctgtccagcaatcccagagacacttcctacgtgggtcctttttctttctttgtttggttttcatttgagacaaggccttactctatcatccaggcagtggtgcaatcacggctcactgcagcctcaacctcctgggctcaggtgatcctctcacttcagcttactgagtagctgggatgacaggcgtgtgccaccatggccggctttttattttctgtagagccagggtcttgccgtgttgcccaggctggtctggaactcctgggctcgagcaattgcccacctcagcatctcaaagtgctgtgattacaggcgtgagccactgcgcttggccttacctgtgccccttttcacatggcacagtctttgttaaaggtgcattctttttctttgcttgggactcccattctgcacaagtacaaatgccacatccccgaactcagctaggttgtgagtgtccccctgggctcccagggcatctgattttgagctacaagtacacggatcattttgtattgtgcttgtttgtacatcagtgcctccactaggctatgaacttagagatgcagggataatgtcttactgatattccccaactcctggcatgggcctggtaagcactgggtgagaaatgcatgatgttttacattaaatgcagttcgatgttctttggaatagcaaatacatctattcattcattttatgtgccttttctagatgacagaagacagcagtgactaaaataatcaaagctcttttttccacagtcacagagcttacattctagagtgagaagacaggcaacgaataaaactaatggagtcctgtagtatagtagaaagtgatgtgaactctggggacaatgatacatgaatgtgggagcgggaagaggggatgggaggctgttgaaagggttgaatctcagaaggggcaatcaaaggagagagaaggtggcatttttgcagatttgaaggagggaagaagtgagacctggggattcacagccagggtaggggagctttcaggcagagagaatggcacaggcaaaggccctgaggcaggagtggctggagtggccagagcggagacccagcagcaagggcagagaggcagagtgagaggtaaggagagagcacattaggtggcaccttgtaagtcacagcaaggactctgattctactcccaaggaataggaaaccactgatgggatttgaacagagaagtgacacaacttggcatatttttttttttttgagacggagttttgctcttgttgcccaagctggagtggaatggtgcaatctcagctcgcttcaacttccacctcccaggttcaagcgattctcctgcctcggcctcccgagtagctggcattacaggtgtgcatcaccacgcctggctaattttttgtatttttagtagaaatggggtttcaccatgttagccaggctggtctggaactcctgacctcaggtgatctgcccgcctcagcctcccaaagtgttgggattacaggcgtgagccatggcgcctggccttgacaaatgttttaatgggctgtggatatactgaagatgaccaagagcaagcacaagagacagattaggagcctttgcaataggtctggtgagaaatagtggtggtctgaaccaggatggtggtgagaagctgttgttggattctagatatatcttgatgataaaagcaaaggatctgctgctaaactgaatgtggagcaggatagaaagagaaggatgacttcattttttaacctgagtgaactggaagaatagattggccacgaactaagatgaggaagtagtcaggggaggtttggagaagaaaaacaagagtttggtttcggacattttctgtttgaaatgcttcttagacatccaagtggtgatagaaaaacaagtctggcattcaagaaggagatgtgggatggaaatgaaaatgtatgtcaccaatgcacaggtgaaataggtcataagatgggatgggatgaccagggcagggagtggagacaggagagaagatcacagccctgagccctgagacggcccaatggtaagagctcagggaaaggaggagcctgcaaaggaaacaggcatccacatggtgggggaaggtcacctgtgaccatgggaagatagactgaatgctacaaatctcacacatgtcaggtttccagactaattgaataatttgaaactccggtgttagcaagcttccccctactgaatttggctctctatggaagaagaacagtatctttagactctaattcagcagtagcagctgaagaaaatatgatcaaaagatctcaccccagaaagatgcattgtacatttcttgtgctcttcctcaaggcacttcaatcctcttcagagtcaacattttgaaaacatctgatcctagattagaaaggccccaaatgcaatccctcttatacaaagtaccttctggacatagaacagtccataatctttcaaagattgtttgcataatctt

SEQ ID NO: 296 - DNA, 1929 bp, Homo sapiens
cggggcagttgcgggttgtcataacggtccccgccggagtgaggcgaggccgcgtcgctcagttctggccgtctagggcccctgtaaggatgagagcgcagaggacgcagggccgctggaggcgcaggtaacgaagctagggtgcggttgggaccgcggctgagctttttccgggacccgtggtgctgaatggagaggacggagacgaagccgagccgcggctcctagcggcggcgccgacgctcgagctgtagctgccaggcgaggatgtgtggagcgcaggcggcgcggggtaaatgagaggtctcgggccccaggacccccggggcccgggatgagttagcgagggcagccgcgggggccagttccgaccgtgacaggccaaggcgacggccgccgcccgcccgccccttccgtgcagaagcagctgctcctttccgcgcccgcccgcctgcgctcccggccctggagaccatgaggttccgcatctacaaacggaaggtgctaatcctgacgctcgtggtggccgcctgcggcttcgtcctctggagcagcaatgggcgacaaaggaagaacgaggccctcgccccaccgttgctggacgccgaacccgcgcggggtgccggcggccgcggtggggaccacccctctgtggctgtgggcatccgcagggtctccaacgtgtcggcggcttccctggtcccggcggtcccccagcccgaggcggacaacctgacgctgcggtaccggtccctggtgtaccagctgaactttgatcagaccctgaggaatgtagataaggctggcacctgggccccccgggagctggtgctggtggtccaggtgcataaccggcccgaatacctcagactgctgctggactcacttcgaaaagcccagggaattgacaacgtcctcgtcatctttagccatgacttctggtcgaccgagatcaatcagctgatcgccggggtgaatttctgtccggttctgcaggtgttctttcctttcagcattcagttgtaccctaacgagtttccaggtagtgaccctagagattgtcccagagacctgccgaagaatgccgctttgaaattggggtgcatcaatgctgagtatcccgactccttcggccattatagagaggccaaattctcccagaccaaacatcactggtggtggaagctgcattttgtgtgggaaagagtgaaaattcttcgagattatgctggccttatacttttcctagaagaggatcactacttagccccagacttttaccatgtcttcaaaaagatgtggaaactgaagcagcaagagtgccctgaatgtgatgttctctccctggggacctatagtgccagtcgcagtttctatggcatggctgacaaggtagatgtgaaaacttggaaatccacagagcacaatatgggtctagccttgacccggaatgcctatcagaagctgatcgagtgcacagacactttctgtacttatgatgattataactgggactggactcttcaatacttgactgtatcttgtcttccaaaattctggaaagtgctggttcctcaaattcctaggatctttcatgctggagactgtggtatgcatcacaagaaaacctgtagaccatccactcagagtgcccaaattgagtcactcttaaataataacaaacaatacatgtttccagaaactctaactatcagtgaaaagtttactgtggtagccatttccccacctagaaaaaatggagggtggggagatattagggaccatgaactctgtaaaagttatagaagactgcagtgaaaatcacagttacaaaagcgacagtcttctatttttgatatttgtccaaacaggacatacaattgaataaaagagtttaggaactggaaaaaaaaaaaaaaaaaaaaaaaa

SEQ ID NO: 297 - DNA, 247592 bp, Homo sapiens
gatcagaggtgctccttttctggaaagaacattatagaaaagatattattggcacaatcaataaactctaaggtctgtagattatagtattttttttttttgagacagtgtcttgctctgtcacccaggctggagtacagtggcatgatcatagctcactgcagtgtcaacctcccaggctcaagcaaccctcccacctcagcctccccagtagctgggaccacaggtgcacaactacatgcctggctaaattttttttaactttttgtagagatggtgtctcactgtgttacccaggctggagtgcagtggcacgatcatggctcactgcagcctccacctcctgggctcatgatcctcccacctcagcctccacagtagctgggaccacaggcgtgcaccaccacacctggctaaattttcttgtattttttgtagaaatggggtttcaccatttgcccaggctggtcttgagctcgtgggctcagggatgggcccaccttggcctcccaaagtctaggattgcaggtatgagccaccacgcctgggaaacacttgtcggtgtccgtccttttgaacagagccatcttagtgtgaagtggtatctcatgtggctttgatttgcatttctctgatgactggtgatgtcgagcatcttttcctgtgctcattcgcctctcgcacatcttatttggagaaatatctattcaaatcctccactcactttaaaaattgggtcatttgtctttttattgtgggtttttgtgaggttcttgatatattctagatacaagtcccttatctgatatataatttgcaaatcttctatttcattctgcgagttgtcttttcactttcttgatagtaacatttgcagcacagaactgttcaattttgatgaagtccaatgtatctattttatcttttgtcacttgggctttgtgtatcacgtttaagaaactattgcctgatctaaggtcatgaagacttacacctacgttttcttctaagagtttcatagttttggggcttgcatgtgagtctttaatccattttgagtgactttttctgtatggtgtgaagctggagttcagcttcattctttggcatgtggatgtttagttaccccagcaccgtttgttaaagagatgattctttctcccattgaatggtcttggtgcacttggcaaaaatcaattgaccattgatgtgtgggtttatttctggcttctcaattctattccatggatctatgagccttttcttatgtcaataccatgcagtcttgattcccgtaggttatcctaaagtttgtatttgataattccactatgggtctatttctgctgctttcattcatattgccttcactcttcatatgcctagttatttttattgtttgctgaacatttcaattgcaaacatttttatagtgataacttaaggacgagggcaatgtcaccttcctccagagaagatgccacttggctgtcccagcttctgaggatgccagcaatctaagattagttgccctaatccagttttgggtattgagaggctaaaaagctagctgaagtactaggagactttccattgctggatcacctttactcctagagaacagccctacagggtccccaccgaaatgagagagatgcaccagggtgctccatgagcagggtcctggttcccgtgcctgtcctgatagccccaggagctgtcaaaagccctggacagtttgtactccccttgttctcaatctccaatcaccctcagggcgtgagcagctgcaaacactggcctcgcctccctagcatcctgccctggaagttcttcatcctctttttgctctatgatgccttcaagcaggtgacttttatatttttccagcttttctaattgccctcagtaggacggaggcatgaattcactaatttatcatgatcacaagaggaagtccttcactgaattcttaaattcaactaccttattttccacttttaaaagtataatttggttcattttcatatatccttggttgtttcatagaatgctgcctttttgatattttcaaccccctcttcgatttctcccaatgtattaaacacactgacgttatgctctgtagctgataatcccagcgttggctgtgggagctgtgctctgctggcactcacccatggagcgctttcctgtttcactcgtgtgtttggatttttttactggatgtttttccttctcaggtcttcagagtgggaatgccttgagacctggttgaaggtgggtccctccagagaggatttgcattgccttctgacagttttccggggcactttaacccagaaccttttttttttttttttttttttttttgagacagggtctcactctgtcacccaggctggagtgcaatggcgcaatcatggctcattgcagcctccaactcctgagctcaagtgatcctcctgcctcaacctcctgagtagctggaaccacagatgccaccacacccagcttttttttttttttttgtacagattggggggggggggtctctctatattgtccaggctagtcttgaacccctgagctctagtgatcctcccatcttggcctcctaaagtggagggattacaggtatgagccaccacacctggcccagaagtattttaaactaaattctcagtttgaggagttaatggcctatctgggtgttgtaaatcccagctgcaaagccatgtgctgctggtttgtgagtacaaatactcaagaggaggtattttcccctccccctcatgccaggcttagaaatgagcaattctccttgaggcctggtgatgaagaggtagtggtcgacatttgcagttcatcctgacgatgatgacaacaccttttatggtcccaccttccgagtagctgagactacaggtgccaccatgcctggctaattttttatagagacggggggtctcactctgttgcctaggctggtctcgaactcctgggctcaagtgatcctcctgcctcggcctcccaaagtgctggcattataggcattagccactgtgcctggccttaaaatcatttttctaaatgcaccaatgatatggcagagaagtaaggaattcccagagtccaaaaattaagtcaaagcaggaactccgagaggtaaccagaacagtgaggctaactgtcaccctcgggcatttgcagaccctggtgactttgggcttcagttttcatggcctcatggattgtggggacagaagacaaggcccaacacttgcagaatgagaagtctaaaaggaaccacccccccaccaccatctgcatggttctctcttctatcagttaggatgagattcagctacacagatgaccaaatatatatatatatacccatacacacacacacacacatacatatgtatatatgtatatatatatgtgtatatatgtatatatgtatatatgtgtatatatgtatatatatgtgtatatatgtatatatgtgtgtatatatgtatatatgtatatatatgtgtatatatgtatatatgtatatatgtgtatatatgtatatatgtgtatatatgtatatatgtgtgaatatatgtatatatgtatatatgtgtgtatatatgtatatatgtatatatgtgtatatatgtatatatgtgtatatatgtatatgtgtatatatgtatatatgtatatatgtgtgtatatatgtatatatgtatatatgtgtgtatatatgtatatatgtatatatgtgtgtgtatatatgtatatatgtgtgtgtatatatgtatatatgtgtgtgtatatatatgtatatacatatgtgtatatatatatgcaaacgaatgggggagagggagggagggaaggagtcctacagacctaacaagaatgggtgattatttgtaatagcaaagtactggaaacgacgccaccatccatcagctgggcctgtttgaacaagctggggctgacctgcgtgttggaatactatgcaactagagtcagcatgctgccctgggcaccccagcataccaagatacacccaacagtgaggcacacgacaatatgccattttttgtataaaaatgtggggatatgaatacacatatattgtttaatgaaaaaagttttccataatataaaaaatcaaaaagaaagatcactgccatccctaagaatcaaacaaacagaaacagatgaaccaaaccatataaaagttggcggcataatcatatatagaagtatttcaagtgtcttgaaacacagtattttggttgaccggacgtggtggctcacacctgtaatcccatttactcaggaggctgaggcaggaaaatcgcctgaacctgggaggcagaggttgtggtgagccaagattgcaccactgcactccagcctaggcgacagagcaagactccgtctcagaaaaaaaaaaaaaagaaaagaaaaggaaagaaaagaaaggaaaggaaaagaaaagaaaggaaaggaaaggaaaggaaaagaaagaaaagaaaagaaaaagacaagacaggaaaagcagtatttttattgtacacacctggtgggatatatgtgttttttttgaaacacagtcttgctctgtcacccaggctggagtgcagcggcgttgatctccgctcactgcaacctccacctcccaggttcaagcgattctcctgcctcagcctcccaagtagctgggactacaggcgtgcaccaccatgcctggctaatttttttctatttttagtagggacagggtttcaccacgttggtcaggctggtctcgaactcctgacctcaaatgatctgcccacctcggcctcccaaagtgctgggattatagatgtgagccaccatgcccagcccagagtcagaatattcttaattgtgggtcacttgcagaagttgttggggactggcttgtgactctgaagggtgatgtatagaaagaagactcacatggctatctggctattcctgccccacctgttttttatggtgaccaaacagtcgatgagggaaagctcttctgttaccgaattccaactaggaaatgcaggaagaattatagaatcgaatcgaaaaatcaccatttttaaccctaaataatggatctaggtgataaaaacactgggcaaaaggatactagagaattctataaaggccagatcaggccgacaccatctgaatctgctgatcagtcttaccgtcgtcaagaggtacacgaaaaggggctcagcatcaccagctgttagggagacacaaatcaaaaccgcagtgcggtgcatcacacacctatcccatggctgaactaaaccacagcagatgccggagtgggtgtgtggagaaaccagcgctcacccatcgctagtggatatgtcaaaccgggcagccactcgggaaagcagttggcagtttcttacaaaaacacacatctataaaggggtagcacggggtagcagagtggtgaggaaaccgctctgtaatttgattgcactggcagttccatgaatgtacacagtgatgaagttgcatagagacgcacatacacgagtgtgcgcacacaggagacacccgagcatcgatgtcgcgtccaggttccggttgtgcctcgggcgttcaagtagccaatgtcagagggacctgtggggaggggccacagcctcccaggcacttcttaccaacgtcctcgtgaatctaacagtttaaaaagaacaagttaaaaaatattccggcagaaaaaagaaaagtataaatgaaaaatgtgggcgaactgttgatgccagctgatggatccacagggtttcatgaactctgtctttgtttatgtttgaacttttccatgataaaccatttcttaagagtcaccacgaaatgagtgtctggtgaataagtgaagcattcatgaatgactgcagtccaactctgtccttccagagataatgcgagcgagatcccgcaaggggagatgattgctcaaggtcacgcggaacagtcaaggctactgagattccgtctagctctttctcaatgtgtgtttttaactttacacaagcaggacattacttttaaaggaaaagtgaccataaactgagggctgcaacataggaggggggaagggcagagggagacccaggatgccagcttcgcctaggggcaggggcgaggcagacagcctggggaggttagaggctctgctgtgagagggtttctgcaagatgaaatcactcaaatgccggctgtgtttggacatcttgagagaacatttccacacacggatggggtctagggttgagttcgtgatacgagcaaacagctacccaaaggacaatgattaactcctgggaaaacaaaatgcagctcgcatggccccaccgtgagcagcatttatgtggccgcataatttccaagcatggggataggaaggggtagaacagcaaaggtttgggggatgggactgatggaagccttcgaggaggcccccaagacgtgggcggacccttgtcttggcacactcctgcccctacatccttcgggccccagagctccctgacaccactggacccaccgccccccaccactctgcttcctgccagccctccagatggcctgtccttgccccctgtgtttgctccctcctgaggtcagcccctctgcaaggacaccggcccttcccctctggctaggttaggtcaaggacttggcctctccaacgcccactcctctcagtcacaaacagggacacctcaggcaccaacctgtacccgagctcagccacggacacatctgggcccccagaagggccctcagctctccagagccagagcaggcaagggcgacagagcgtgtggctttggcggctgggccaggaggagggaggggtccctactgcagggtttagccctttcacacttcagcagagagcagccgccccgtcagcacccacctgctgctgtcctcagaaatggggtgcctgtcggggtgtgctggtccccaaaagatgtgtccacattctggagcctgtgagtgggacccttttaggaaagagggtatctgcagatgtgatgacagtaagcctacatgacggggggcagggggtgccaaatctaatgacaggcatccttctgagacacaggagagacagagaggagaaggccgtgtggagatggaggcagaaattgaggaagcctggagcccccaggagctggaagaagcaggaaggatcccccctagagactcggccctgcgcacacctggatctcagacttctggcttccagagctgtgagggaagagattgctgctgtttgaagcctcagggtccatagtcatttcttatggcaaccatgggacactcatttggtgagaaaaagccccttgaaacacacaagtggtgggtgccgtggatcaagggccgccaaccacagtcaagccccagggccgctggctgggcagactggaccccacagaaccaagccacatggaacaccccctgacctggaggacaggtccctgtcagaactggctcaggaggaactcactgactgcgagggccgggctgggctgggccaccgggaggaaggctggggacacagccaaggtgggggagggacaggcagactggagccccctccagctacaccctcttgctcacaggaccgtgcctcctagccagacttctggaaagtcttcttgacagtcacctgccccaaccaggtgtcccccccttctccttcaccccctttggacagttcccttctctctcccatgaccctcctccatggcctggtgcttcagctccatgacctctggcttcaagtaagggggaggggcaggagggactgggacggcccagcagcctgttctcagaggctggcaccgtgagcaggagaaatgaagggcaaagccaggagacaccaaatgtaggttaactgcaaggaaggagggaagggaaggccatggcagaggctccattgtgcagacccaccccactgaaggctacaggctggccagagccccagcgcctcacaggcctaggagcccgggcttaccatgaagcccagtagccacagtttctggaccccagggaggtctcacggctgtacaggcactgccacccagggtcctccaggtgccagaggacaagaggttggcgagtcaggaacctgccacagccatgctcgtgctaaggggctcagaggatgcctgggcccaggtgcaccctggcttggaataacctgaccttcattcaggtaaccttccgactccccagctaggatatcaaagtcatggcgacagacacttggtcgagtccactcttctatcaccagcacaggtgcttcaatatgtgttgaatgaatgaatgaatgaatgaagaggttcagtatttcctgcagggagcagagggtggtctgggcagcctctgaaatggacgactgttgttgaggcatggctggcgtaccctccccctctttgaagggtagacggggtacccgggggaaagagccttccactcactgccctggagccaaatctcttcctcttggtcagtcttctcgcgccacccctccgggcattggcccagaagccacttgcaaagcggccactgcccggcaggtcagcagtccagggggtgagacagcccctggcagagccaagggaggagaaagagctggagtgtgaaggtgggtgaggaggggctggggaggaagagtcggggggtctgggagcggggagttcccctctcctccctgggtcccggccaccccctcccagtctggctggcctggctgccccccagctccagtctcccgttctcctcttgtcccaggctggcccacgatgggcaggcgaggtagccggggcacaggggagcaagcgccgtcccacagctgtggtcctgcccgctgtgctgggggcacctgccaggccagaggcagctccctcctggggacaggtcagcagcaggcccccagaggcccagcagggaagtccagggtgaagccaagctgtccatgggaagtgagcgagtcccccaaaggactgagccagtgggaaaagaccaggccaaagggggctgtgagccaccttcacggcagggcgggagccaaggcagcacctccccccagggccaactgtggagccacatggtctgaaggaggtggaaggagagttgggggaccctcctctgccttaggctggctcagctggccaggctggctgcgggatcctgggggcagaggcctttcccacactggcatctagttgaaaaaggaggttcaatgagtttaagcgtcctgatctggaggacagggacgttagggctttgcattcaccaggcaccggtgtccccttaatataccgagggttcagcgctcccatgtcccagccttgcccacccagccctggctgctgggagctgagcatgagttaggtgcccccttggcccctgagaaaccagagctcaggggtttcttttcttcagagaccctgggccctggccaggagcacttggcccacagcaaggagccctcagcaggcctgtgctcccaggacgaaagccgtccacccagggcttaggggaagggcggggatgccgctcagggaacctccggctgcagggagcagggcccccagggggcccagtgcagggacagcttcggagcccctttcctcaagcagaggcagggaggtgcccagtggccttcggctgtgtgtcctggtgcccaagcttgccccttcaccggggcgctgtggctggggcctgggctgttgagacgttgtggggtgactggtttgtgcccccactgaaagatacatccatatcttaacacccaggccctgtgatcagggccttatatgcaaataaagggtgtctgcagatgtcattaaattgaggatgtggagatgagagcaacccagatgatccagggggccccaaatccaaggacagtttccttagaagggacaagagagagagacacagagaaggccatgtggaggcgaaggtggggagtgcccagggcccccagaagctggaagaggtgggtggatccgcccccagagccaccggaggaagcactcgattctggactccggcctccagaactgggagagtcaattcctgttggctgaagccaagcggtttgtggtcatttgctgcggcagcccaggccactccgacacgagggaatgagctgagcccagagtcctcctgggccgtggaggcggggggcggggggacctttgcacccgcatcgtccagtaacctggtgggggctggggcgaccttgggaaggcagctcccgttgtccttggctcatttccagagagcatgagcggccaacctgaatggaggctggggagtgagccccttaggccgggggcccctgggagtgcaccccacttccaccgcaggaggaagggccgtgtgcagtgggctgcgggtcccacacaagcctagaaatgggggagcaggggccaccgtgtgcaccattgttggcaccgcgtgtgtggacacattggtggtggaggcagcagcgcggtcagctgaagagcgcgacgcctagagcaagtgaagacgaccttgacaagcccatgatcctgtcaggagatcaatctcccttccagcatgttttcagttttttactgtaaagaattgcaaacacatgcccaacctagagaggatgacagggcacaccggccccgccggcggtcctcacacagccctctctcctctccactccccttaatgtggccccgaggcctggggcctcctgagagaggcacctccatctgccttaagcagggacagggccttccaggcagcaaacccgggttcagaacctggacccttgtctacaccagccagggctggaggttggccctctcagcctggggactcataggggtgcccgaaactccaggaatcagccccctgggcccccactgggccaggtcaaagtcagtgtgggtgggaggtatttgcaagatcgccatgcaggaagtagggtcccagggagaggacaggcccagacagccatcgccgcaggcatctgcccacatggaaagcaaggcggtaagcagaggcgatggaatgtgtgtcaacaccgtgcaaagggccagtgtggccggggctggggcagcgagggcggcagccaggggcctcaaggggcgggcaagaggcccgggaggctgggactgccaggaaggaagccagctgctcagcctggggcgccctccccgaggcctgcccgctccctaccagccagacttctagccaagctccagagctgggagcccagctgcccacctagcatctcacagggatggccttgcacactacacacctccacccaagtggagcaattctgtacattcaagtacaattcagttgtacaattctgtacaattcaagtacattctcaagtgtacttgagcaatttctgatgccgagctcccctgccgcgccacatctatagtggctccaggtgcggttgcctcttctctccacacccctcccgggagcacacacgcaggcatgtaggctgctccaaggggttctggaaggctctggccctttcttcttcagcaacctcctaaggggctgggtgaggagtgagcggccaacacacatacatgcatacacacacacgtacactagcctctgcatttcatatacatgtgaaaatcatttgctccccaatgcaggtaacatgagaggctgggccctgcagctctgaggctgtctgcacaaacagatcctgagagagaatagcctcaaggggtctgtcagcctgtggccaagtcagatggtcacgtcctgtttgccctgggtgactggtccagaggtgggcctccccgtgaggactcgactgctagggccagcaaccagcactgaatgcccgtggcccaggtatggggcagagtgcctccctccctcccccagcaggcctgcctcaccaggaccctctcacccacactctggagggtacacagggccaagagccgggggagggggcaagggaagggattagccccaggcagccagctaaaacggggtccaggagcaaggcggcactgaggggcctcaaaggccagcagcatcaggctggcaaggacgcatacatgagcacacactcggaacacgcgggagtgcctgcctgtgtgcctgcaggcaggagtgtgcaggaggccgtgtgagagcctggggagggctgcgccagtgaacaaggcaggcccatgtgtgtgtgtgtgtgtgtgtgtgtgtgtgtgtgtctgtctgtctgtctgtctgcctgtgcatgtctgtgtctgtgtacacacataagtgcatttgtgcatgacccaggggagcaagtgcgccctgcctcagggactccaggagccgagctggcattcaggaagcatctttaggctcttgaacaaaagggcagcctctgctgtctccctccccacagctccctcctctgaggtggcagccgtgtggcacatcccggctcttcaaccttcagcctcatttttatcctgaatatctacacacttgcgtgcacacgcacatgagcacacgcacaaacgccctgtggtacagtacactccaggaatactatggaccatctttctttcttttctttcttttttttttttttgagatggagtcttgctcttgtcacccaggctggaatgcagtgacactatctcggctcactgaaacctccgcctcccaggttcaatcaattctcctgactcagcctcctgagtagctgggatcacaggcgtgcaccaccacacccggttaatttttgtatttttagtagagacggggttttaccatgttggccaggcttctctcgaactcctgacctcaactgatccacctgcctcggcctcccaaagtgctgggattacaggcgagagccactgcgcccggcctacagaccctctttctaggtccctgagcaggggaagtatttctgtgcctccgtgctcttgcccatgctgtgcccccagcctgctacgacttgctttccagagccacctggtgaactcctactttgagcggcagctcagtggcctgccgtcttcctctgcagagccagtggctttccctggtcctgtcctacctgtgggtcttgtgagctacttgttaaaagtgagtcacttgctcctgagacctcagccaccatcccagtaactatcacagacctagattgtccccagaacccaactgaattggttcatccattcactccacaggcacggattgggagcttactgcatcatgcttctccctaaagataagctcttagttaacatcaccagccatgaattactatactggaatacacactcaggaaaagccataatgtagaccaggatttaaagaaatgccatttaactaagaaaaaactaaggaccttgtttcaatatcagccatgagctgccactgcttgttaaatatgagtctatgtcagaggcagaataaacaattcatcaaacacctctttaaggagttacaagtttcttatcaaaacctccagccccatttgtgcttctgttatatcggcatctccaagtggatgagaatgttcactggtagctttgtcccttttccatggtgaggggcagagggaggtgcaggctgtccttcctcttcctcagtctcggtctggaatagctaaagaaagcaaaactacctcctctgagttgagtctcttttcacggagaccctcttctgttgccaggcgccaaatatcatgaaaactgtaactggttaaaaaaaaatcacctgcataaaaatctttaaaattcatttcaacaacaaaactgtgtatgataaagggtcattccaccaagaaaacatagcaatcttaaatgcgtatacaccaaaccacagaactgcaaaatatgtgaagcaaaaactcataaaactggagggctaggtgcagtgactcatgcctgttaccccagcactttggaagactgaggccggcagattgctttggctcatgagttcaagaccagcctgggcaacatggcaaaaccccatatctacaaaaaaatataaaaatcagccgggtgtggtggtgtgtgcctgtggtcccagctacttgggaggctgaagtgggaggatcaccggagcctgggaggttgagactgcagtgagctgtgattatcctactgcactccagcctgggcaacagaaccagatcctgtctcaataacaaacaactctaataaaactggaaggggaaatagacaaatccacaattatggttggagattttaacacacttctctcaaaaattgacaaaacaactagacagaaaatcagcaaattataaaagaactcaacattaccatctataaacaggatctgatagacatttacagaacactctgcccaacaacagcagaatacccatggggcacatcccaatatagacgatatcccaggcaaacctcaacgaatttaacagagctaaaatcatacagtgtgttcactgaccacaatagaatcaaattccaaatgaatcacagcaaaatctccaaacaccaggaaagtaaacaacatgcttctaaatagcccatgggtccaagaggaagtctaaaggaaaaactttttaaatacaccaaaatagtcaaaaacaaaactacaaaacaggaaaatttgtgggatgcagctaaagcagtgccctgggggacatttatagcacaaaaagaaaggcaattttttctctccctaaaaaggaatcagtttctcagaggcaggttggtgcatgggagagggttgacttgaacaatatctggagagctcaaagctttcaaaaaacattaaaccctgaatatatcgggaagctggaagatgttagagcacttacatttactttcctggatccagacttcacatcgaagagtttaattgaactctgggtctacctccagctggctgaattagtctgaacaagaacaagtcattcagatgttcagagtcttcatttcctcatctgtgaaatgctaagaccctcaacttcacagggatctttttgagttaaacgatagagcacttaagaaagcttcccgaaactcccgaagcactgcattcatttgctagagctgctgtcaaaaaatgctgcacacgggatgtgtgaaaacagcacacatttattctctcccagctctggaggccagaagttcaagatcagggtgtcggcagggctgtggtccctctgaaggctggagggaaaggtccgtcccaggcctctcccctggcttctgtcgggttgtggctgatctttggtgttctctggcttgtggatctctgcctccacagcaagctctatactaaggctgtactagaaagtgttagccttgtctctattgtatcctttgatatatatatacatatatatatagctcaaccttggctgcctccttgccagttggcctacgtggctgagaggcgttctgctgtccccgtccttgtgaaggtatatgcacagctatgtgtggacatagtgtggctgctctggctccggacagggccagcttcctcactgcttccagccccatctcacccagggcctctgcagccctgggagcagccaggctctcggcgcacatctctgagcctgcccaggaggattcgggcagtcacccgagcacctggtccctcacggaggcgcactctgcctgaatccctcctcccagatgacgagcgctcacacgaggcttcggtttcctcagtaaccaaggcctgcagctgactggtcacagaattccagggagaggtgtcccagggaccaccattgtgatgacatggcagctggccctcctcctgcccctgtccccccttattcctctagcgcacgcctagccagcccctggggggtggccagcccgcctcaggccaggccagctgagggagactgggaggcctgtggccagcctggccctggcagccacactctgtgctctctgagacggcgcacagccacctggagcatcatgaaaccatgaagggtgcccaggtgccaggagaagggagcagggctaggccggggctgggctgggaaggccggaggggcctccaacagaggtcagggtgcatttagagaaagggaatggcagaaacaagggactgacagcagcaacagggacccagcgggctccctggagcagaagtggggacaggtgggcaggtgagaggcagggggagaaaaggctcagtgccctcgggctctggggcacgccagtgcacgggagaaagggattccacagcaggcccatgggcctcacccaggaattcccagtcttttcaagacaggacaaggccacagaaagaacgaggccgcatggtacacaccaagatgagggtagggggaggacctgggtagggggaggacctgggcagggaagggactgcggggtgtgcctcgagtgccacctgcgggcatgggcctctctgggccccaatagcgtagccaggcagaaagccgccccagttcgccatgctccactcagaactcggtacccagtgcagtggctcgcacctgcaatcccagcgctttgggaggcccaggcaggaggatcacttgagcccaggagttccagaccagtctggacaacatagggagaccctgtctcaacaaaaaaaaaaaaaaaattgattagccaagtgggtggtgcgtgcctgttgtcccaactacttggagggctgaggtggaggatcgcttgagcctgggggttgaggctgcagtgaactgtgattgatccactgccctccagcctgggtgacagagtgagaccctgtctcaaaaaataaataaataaataaacaacccaccagaaatctgtgcccaggcccgatgccaggcaccctggagcacagaggcatctgcagtgcccatgccctcaccagctggccgatgccacgcgggagggaagcagggcacctgaggggcatgcccagcactgtggggccaacagggaggaggggaggacactgcaggcggggaacacggtgccaggacaccgagccaagaagcaacctgctgaggggggtaaggaccatgcccactgcaggccaaggggtgcctggagggagtggggcatcttgcaaaggctggagggcccctctcaggccaggacatgacacgaatgtggggttccgcatctctctgtcagtgcgccccacagcccatcagaggccgtgtccagctgctcctccaggccccaagcctctcatcgtcatctgtcatcagcggcatccccctcgcacaaccctgtgctcatggacagatgcccactctctccaccgagaaagcattgggagagcactgctgggctggggacaggacctcaaggggttgatttctgctctgcatgctcaccccctcccctcctcctttgggggacaccccaaccctgcccatctccatctcaggcaccccctcccacaattgtgctatagcccggcttcctccttcagtgaagggtggagggagcgcagggggccaggcagtggcccaggagccctgacccactccccacccactgccccatcctacctacagacacagccgcacagggccaccagagcagggatctcaggctctttaattccttccctcctggggtctacacacattgctacggccccatcccagagccaggccgggtgcaaagccctggagacagatgccgctcctccaaacgtcccgtctgctcctcagccaaggacagcagtggtccggggcaagcaggacacaggcattctgtgttgggtggtcctagcaaaggaaagaaaggactctcgtgccagcaccagcattgaggggaggctggaaagatgagtgccctgccaggcagatgtggggcagcgtgtacagcaggagggtgcaggcacataggcaaagatgtgggtgaatgtactttgcacatgtgatggacatgaagtgagggaacagagagaggactgcagcacgctaaacagtgcccccccaaaatatctgtccacctggagcctcagcatgtgaccttctttagaataaggcaagggaacacgcgatatcctgcttcgttctggcaactgcaaggcgcgagttggggctggaatgtgggcctggaggaagtcggggagaggactccggggaagcgagcaggagccagatggctcagggccgtggagctggactttgtccttgaggccacgaggggccactgaagggggctgagaggagaagtggccaggcatctgggcaaggacacttcctctggccttgatgtggaggatgggtgcgaggctggggccgtcgtccaagcgagaggggacagggcctgggtgaagagaaaatccagcaatgtgaggggtgattatggagagagaggaatcaagggcacccccgagtttggggtgtggagggaagaactttgggacatccaggcagcaatggagctacaggcatggaacccaggagacactgatgtcacagtcgtcccccagaagagggacataagaaagagacttgggacaagtggccagagtgagggaaagaaaaccaggagggggtgggcatgaggagggaggccttaggaggggacccaagcaagcaggggcaggtggaggaagagccttgcaggccttggagtttggcaggaggcagatgagtcccgtctggaagccgccacttctcaaggaaggcgatgccagctggcctgggctctggggaggcgggtgggagaacacacagcacccaccggcagcagctcaggagaaaccaggccaaagggggctctcaacttggaagctgtggggtggcacagaacaattttgagatgctcaggccttttagggaggtcaggatgggcaggctcaaggctggtggccaggggatgagggccagaggatggaggacacggggatgggaggagccctgggggataggtgggcttggctgaggagaggacgttctgggcactacacgtccccttttcctgaagacagcctctggacacttctctcccttgcggcctacagagcctacccaggcagacccgatgtggctgtcactgagataagagccctgggcttgtgtctgggacacgtgagtttgagaagcctggaggtcacccaagggaacccacctgggggcagctgggcccaggagcctggggcagagacctggtgtcacaggccagtgtatgagcactggagtgaagtcagccaggcggtgggctaggaggtcccgacactcatccctcccccaaaacaacaatcaataagcgacatgctcagagaaacaggatggcagtctgctgaggatcaccagctcctggtcctacaggtcttcgggcaacatgagaagtgacaagcgacaggtagcaccgacccaaactatgaggacacaaaagacccttcagaggccgagcaagggccttcactgtggctcccttggggcccttgaggttctggctgagctgggccgagaagagggaagtgagcatgcaccagagacgccgcctgccaggagacccggcccaagagcttccaggcagatctccctgccttgcctgtgctgagctccaaagaaccacccaccatccaccatagggcaattctgaccacagccagccagggggcagtgctgggagcaggccaatcctcagatgccaaggagccagcttcagcaccagccatctgtgacacctccctctggctgggctcaccactgcagcgggtagcacaagaaaggcagcagcctgcggcttctgcttggaccctctagagacgggacgcacacccctccaggaagccagtctcaagctggctgccctgccgactgggaagtccacctaggctcatggtcctggggatcccatcctcagcctcccctgctttcccctttagggctgagaagaacaggcagccatggtcctcatggctctggccagctctccaaccacgcatcctgagagctgagccttacaggctgacagactggaccctgggtcaccctcatggtcccagcccatgtcagccacagccgtccttcttggagctcaaaaggcagtgaagaacgagtctcaggccctgctccaggtggtgacagcagtggccaggactgatgactaactcccagagccgcctgtgtgcaccctccttttctctgtataacactgacatggcagtgggcatgcagtgtgcagtggtggaagggagatggctgtggagatggttaccctgtcgttgcaggcagggcagtaagaagccctggaaggggctcagtgacctgccacagcctcccaccgggaaaggccaggctgcatgcctgaccccacacaaggagccttggctgtccccttcccatccatggcatctctcaggcagaggcccactggccctctccgcgtggatgcggttgatccctgggacgtggctgccacctttctcaccttccccctcctctccaccttctctctgcccaggagccggccccgaggtgtgggcaggtcacgtggcaccgcatctgcactgctctcctctctggggccctcgggacccaaatcagccaccgatgtgggaagcaggtactgaggggtaatagccgctctctaaatttagacgggagaactccccagagagctggcagaaatatcccgagccttcctgtggcgaggctctcaggcaggagaatgaagagggggcagcgagaacccggggatggggggcagcagggctaagagaaggtgacagaggagaaggcccacacctgggctggggtgcacatgctctggaccacagccttgaactccaccctggtgggggcggcccacattcaaggacaggccagctcttctctgcaattccggtcgcacccatggctctccagcacccttctgcaaccaggagggagctgcctccttccttgctctggccgggtgggtggcttgccaggtgactgaggcctgagccagcagctcccctcctgcctgtcccccagcctataagaaagagccactcaagggcagaggcagttccctgcggaggggcgccctggccatggggccctggctgctagtctgtggaactgagcacatagcccggtcaccgcccccacattccatacttcagcatcctcatccagaagcaaacaagaagtgcagcaaacagcatggcttgtcctcacggtcacggcaccagtggtgggagggaggagaccctcatctgtccctggagctgctgtcaccattacccaaggggcctgcacacaaggtggaagcttcaggacagctgtgcttccaagggtggcccacgcggcgcccctgtcctggaggccacaagtctccatcagctgggactccttgcctggaaggtgactcgtggcacccacagctgtgattctgtctccagctgtgcccctgatcgctgcagggccttgggcaagtggcagcggtgggcaggagaggtgctgggtgctcccagatgccagagcagcaaggggctcagcagcctgagggtggggatgggtctgggtgcaggaagccaatggggcccaccaggctgggcctttcggtgctgggaggagatggggagtggtggagggaggcagccagacaagccaacaggtgctgtgaccgagcgcgcaggggcagaggcccccgaggagtgagatgagaaaaacccacagcctccaggagccgctctccacccccacagacatctgagccagggcaagcgctcgccacaagcccctgcctgggcctggccatggctgcctgtctcgtgtcttatcttgttacctgtggtgagacaccctgactggagaagcatgttcctggaagggggacggggtgggggatgctgaaatgcggccagaaaggcaggtgggcctttcctcctgggccaggcggggcaaaggttggggggatctgcagcaggggagccaggtggactgggaacatccttggcacccccaatctccccagacccatcgtttcacccttggtggctcccctctctcctggttcccttagccctggacgtccctgggccacgcgggaaagtcacctgctgccctctctcctcctcttcccctgcatggggtctggacagaggctccttgtctcccctcacttcccttcccctgtctagcccagggctgtgggtggctggctgtcccggtaaaaggattatatcatctgtaatgtatatccagacgcacatgcactgctgctcgggaggacaagacaaggagagggagccagtgcagctggccagaggggaattgtattgaacctgaacctgagccctccccaaatgggggtgctaatggctcaccaggtcccggcccgcagaaatcaatcgctgcacaggctggcgctctgtgctctacccccctcccttccctctcacctacctcctgtccctccctggtgctcacacccctgggcactcagctgcccggctggcctgcctttgacctcgtctgcaagtgacatttcagagccattttgtttcaaatgtctgggcagggctcctttgggagcggctgcagacaggtagggtgcttctgaagacatggtaactggtagcggggtacatctagaagatgccggctgaagcgcttcagatatgggagggtgcagagggaggagttggagggttggcgcaggggggtggggggattgtcatgtgaacagaaggcttcagctgcagaagccatctctgtgggacccaatggttacccagaaatgaagtctcggatgtgtgtgcaccctggctccggagcccgcagatgtgatccaggttccatgcagggacacaggcagggaggacccagcactcggaggcagcagcagcaggcgccgtggtgtgctgagacaagccaacagcagggcagcgtggggaccatgggcggggccctgaggagggcgcttggcttatggcaggaacgtgcctgcccctgtgccagctgtgaggctttgacggccatcacctttcccacggtctctccccaaaacctcatttgcctggagagtggcccggaatcgggccctgaacaaactgtcccttaacagatatggatgccttcagccaaagccctccatgtcagagggtgtgagttgggccggccgccagaggcactgctaggctaaagacctctctacccccagcaaagtgcagctcccgtgcccctccaccttgcccggggctggcggttcctgtgtctgatttcaaggtctctggggagcacctttgggattcgggagggcgtggggtctgacaggaaacaagatggccacttcccaatggccatccccaaggaagggacaggaaggacggcagtggccttggggttccgggtggaatggagggcgagggctggggcggccccgtcgcctcaccctgagactcccgtcagcagcagatggacccagctgcttcggagtcagagacccagctgtgccctcggttctgccaagcaaacttgcactcactcaagtcccccttgggagtgttctgcattttcttccccagccctggggatgaagagggaaccgctatttcctgaggccgagcaggcctgtgcctcacgagctccccgggcatctccgggcaggcctggcctttgcatgctcctcttccggcaacggatgggtcttgttgcctggagagcagagacaccaggagggctgggagtgggagctgtgcaggggcgagggtggcattcttcaatccaaatgtttctccgccagcctctcagccctgagtcactaaagcacaggatggtggcggaggggaggatgttaacaaaccttgctagaagctcctccgagtcagctcacccaccaagcctttgccgggggtcagctgggcacccaggccatgggcacagctgtcgtacgtccttcccaaacaggaggtgccctcagtggagggggagtgtgaaaggcagtcccctgtttgtagggcacagcttctatggaatattgatttcttaggaaaggttccgtaacttcagcacgtctagcagtacgggcaccagtggcagctgcatgtgctcgcctgcgtggcatagccttgggtaggtgcaagctcaagtcctgggcagcctgactccccaaggctgtaggggagagccccagtgcagtcccatgaggcccagcgtccagagcaggaagacagttgcagggccagaggcctgctcccaggaggggctgtgctgccgccaaggctgaaaaggtgcagaggagcagtcggggcccagagcagggtgggcaggcctggctggcgacagcaggaccctcccagctcacgcaccatggcttgaaactgcagcacagctaggagggtccttggagatcacatggtcccacctctctccccaaacgtacataccaggaaatggagacccagatgggacagggacctgggctccagaggcaaagctgctgccctcgcctcttccaggggtaatgactcaggggaattcagcgctgcggcagacacagccaagcggccagcggagctgctggcatcccagccctgcctggccgcaccttatcctgcgctccctgggcggagaagacggcccttgatgctcacagcctcctgccgggtctcaggcaatcccccactgcaggcacgaggccgggctcatacactgctggtctgggagccccagaaaggccaggtgcacatctccacgggctgtcctctgcctcccctccccacgcaatcttccgcactcacactcgctcaggctctaggcttctgaactcagccagcccaagccacatcctactctgccactacactattgtgccaccaccagggagccacggactcagtttccctggctgtagcatggggacaatcccctcagacttccggaactgctgtaaggataaaatgaggtccttgatggcaatgcgtgtgacctttggcacaaaggagaaagctaacgggacctagtgacaacagccgctccctactcgcttccagcccctcccccacccaaacgtcctggctccaccccttccaggcactgaggctcaaatgctattactattagccagaatctgacacatgagaatgagaggagacactgcagggggacctggggtgggggatggaattggcagcgctgtcagccagactttataccctcttcactgtgggagcaggaggtggctctggggcaccaagttgcgcccagtcctcaatgggccccttcgctggggtgccagtgcagattctgcgcgtaaccgtccacctagcccaggcccagcctagttcagggcccccaaccccactcccgcgccccaagcgccggagcccccactcattggcgccactggggaccggggagcgcagggcgcgtcgggcaggactggcctagagaacagaggcttgcaggtgggaggaaggcggcggggggtggggggggcgtgggaggtggagggagacgccgggcaggccgcggcccctccccgctccctccccgcgagccgccagctacagtgcccctcctgggcagggggcggagaagacggcgactggaggggaggaggcggcggcagaggcggaggaggcagcggcggcggaggcgggatttggagtttccctccgcagcggcggcggcggctgcccctcggctccaggagaggccgccacccggggttccggtggcgttaggctgcagcagtggcgcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtgagagggggattagggggttggctgcgctcagccctgcagtgcggaggtggcaacaggttcccatttgtcctgttgctggcgctgcgggcgctgtgggccccgagcactgagctctgactttggaaattgagcccctcatggcctcctcccaaatgctttctcccggtgcgaggacttggcagcagggctccgcagttaggtgcaggggagcccctcgccaagcgtcgggagacgtggacccttggatcctaggcttcccctcccttccccattgcggaggttgcctctccccgtcctcattccagcccagctcctctcacctccagggaaccctctccagagagcgccactgagcagctcaggagctccctctctagccgaactgagcccccacggcagggcgggccggggaagtggctgtccagctccctgctggtcacagccctgcgccacccccactctccacaacaagactggcacatggcagaacctccgtggtgccttcaacccctgcccactctgagctcccacccacagctgcagtgggcctggaggcagcccccaggctgggtgccggtgtccacctccaccactgtggagctaggctgtggacagaaaacagaagacaaagtccctgccccaggaacacactgagaaagggggaaagtgaccacactagggagcacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggacacctccccctgaccctggtctcctgcctcagtgctcaccacacctgagaccttgtccagtgctcttgctgcctgtggatctgtcccgcctgttgtgcccatggaggaaaggatggaggccaccagccttggttgagtggatggcattctgacgttgggcagggctgggcagggcagggtggagggcaggtcgttgcaggcccggaggcagggagactgttgtgcaagacgtgacagtgacctggcctaaagctgatgaatttgagccctcggctagggcaagggacaggggagagaggcgtggatgtgagagatatttaggtagaaactagttctttccactttgattagccgaaggggggttaagggaaggaggcagaggggggagccacgggtgactcttaggatcagtaatgtgataagagcagagtgccccagtttagggctgggagctcagggttcctgggtgcttttggccagtcctgtgcgagtgaagcgggctggtattggtaggtatccaggagctacccctgcctgcctagccctgcagcagacctctgggccaaagctgcactaagtttctggtcctgcctcctcctcccctccgtgatttcggtggcatcccaagtttgcccaagctgctagctctgagcccattacagagatggggccactgagatccaggcaggggagaagatgctccagtatcaccctgtgagttgggctggaggcagcttctgcggcagaggggctgggctctggtcctcacccctccccctgcctcccgaggccaggctggcgccggccaggggagccgcagctggtcccctgctgggcccctgacctgcccttggcctctgccccgaccccgtcccgcctcggtggaagccccagctcagccgactcgcaggtcccacccgactgcttcggctagcacccgttggctcaccggcccgccgggcccgcccccggagccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggtaggtgccgcggggccctccttccagggggttcgggattcatttgaccttaggccagccccacttctttttttctaaagcgagttgaggcccccctcccctgatgacctgccaggctgctttgagaggagggaagcctgagtgtgaccgtggggaagttcttcaccctcggcagcccagtctctgagcctggaaaatggggagaattagcctgacctgagctagttctcaggatgctcaagaacgaattacaaagtgcgggctccccagggtctcggcaagggtatccccacctccccaacctgctcaggaatgagcaagggaggcaggggtcagacagcactggtgcaatcacggctcactgaagcctcctgggctcaagcgatcctcctgccttagcctcccgaacagcatataaagtgttcaggtgtccagcccggggaaatagtatctgtaaatagagatgctggcttcttgagccatattctcccccaagttcccccacatcttggggtcccacttcatccctgagagtcaggagatgcccaggcagagagctgacatctgagttcctccttttctttagctgatggccgcagtcctccctaaggctggcagtgcatctcggctctgttgagccctcacacctgcctcagcttgaccctaggggtgtaagatcctttccggtggctcagcgtgagcccagcttcttgcagcccgagctgactgagggtggctagggccccacgtgggtaccaggacacaccaagctgctgggttttgtgttccctttgggaacatttgcaaaccctccaagttgtccagggtcatctccccagccccagacagaggcacttggctgcccagaaggccaggtcagcaggccccatgccctctccccaacaggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattggtgagtccaccccacccacccttccctcctgtcctccccaaggcctgctctggcctcccccttgtgagtactcctcccaagccccgctgccattcccagagccaaaagcctaggtgacagttctaggggacaggcagagctagggcggcccccagaggccactagagaaacctgcaggtcgtggccatctggcccagggggcagggcggggcctttgagggcccttcggaaggcctcggcctcacacacgcctgccctccgggtctcccgggccctttcctgccccatctagatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaggcccatgtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagagtgcagtggccgcccacatccatggcctaggagctactgggcaggttcccggccacacatctggtgggctgttttgttttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagatactgagtagagagagaagctacctcctgagcgccttggagggtttgggggaaggtggggaaggaggccctcttggtctctctggactgcccatggtggaaaggggcatgtgccaggctggccagggactcaagtgccaccccactccctgccccatgttatcatttcccatcttgtgcttacactgcccgctggcccacgctctgagtcgcccattcattcacctccatttgaacccctagtctgtgccacacactgtcctggggactaggttgcagcagtgagctccgcctgctcacagcagactttctagtgggggaagaaacgacaaatgcaacagtcacagcactgcggttgtgccgtagacgttcattgccatggacagagcagaaaagtgaggggccagcactcacaactgatccctgagacaccggccaagtcagccccgagccctgcctggagcctcctgagggctgccccggctgggtggcatcctgagagtgacagggaggggtgtgggcagactggcacatgtgagtgttgtggttgtctggctgtggaatttgggctgcaaaggcccaggctggggactagaagagccccatggagaacatggagaccaacgggccacctaaagggacagaggtgaactgcacctctcctcatattgggacactgcaagtgccttctccacaccataactggtggggtctataaggctgtgactctccaccatggacatgtagtagaggggaagggcagctggagggtggcggggagcgagtgcagccagagaaagctgtggaggctttggagcaatgtggcccagaacccacaatctaaaggcatatgcgtgaatggctgagctggtaggaaaggaagagcaaggtgatgaactgagaaatgaggtgaatcctctgggccagcggagtaagccactctggggttagcccaggagccaggaccctccactggaacgcagccccaccaacaccttgatttctgtccagtgaaatctattttgaatggctgatctactgaaatggaagatgtgaaatctgtgttgctgtaagccactaactctgtggtaatttattacagcagccacagaaatctactagaacaggtgacctaggaagatatatcccaaataaagaagagggtgtgtgctgatcttgaccttggatctggggggaagtggaataaaaggaaaatgttccccctcccctgagagcttatagccacaagctgaactgttcttttagagtggtctaggcatagagtagtggacactccagaatctctctcagaggtacttagaaacagtgattcagccgggcacggtggcttacacctgtaatcccagtactttgggaggctcacctgaggtcaggagttcaagaccagcccggccaacatggggaaaccctgtctctactaaaaatacaaaaaaaaaaaaaaaaaaaaaaaactgagctgggcatggtggcacgtgcctgtaatcccagctacttgggaggttgaggcacaagaagcacttgaacccaggaggcggaggttgcagtaagctgggattgcgccactgcactccagcctgcatgacagagtgacagagtgatgagagagtgagagtgaggccctgtctcaaaacaaacaaacaaaacaaaacaaaacaaaacaagaaacagtgatctggctgctggagaaggctcctggatttgtcttgaagctgcattcgactatcttacctacagggtttactgagattgtgacagcccaataaaaatagcagtttaaaacataaataaaatacatttttaaagtttcttattttagaaacaaggtctcaatatagaacttaaataggccaggtgcagtgcctcagcctcccaaagtgctgagattacaggcatgagccaccgcacctggcctatttaagttttaaatgaagtggttcagaggtcatattgctccagagtgaccagcagaagcaagcacaaatcctctgtggagggagggatgtcctttaaacacaggcctcaaagcaccgctatagaaaattccaaaatacgtaattttttaaaatcctaaaatgtacaaggaaacaagccaccatgagttatagaaacatttagcatgtgaattcaagtatcagtcctgcaaagatagcagcctttgaaattatataacagactataagtataattaatatgcttaaagaaataaaaggaaatattgaaactgtaataaaaaagcaagagaatataaaatgactagatacgcttgaaagaaaaccaaaaagagctcctagaaatgaaaaatatgacaattgaaattggacatttaaagtttaaacagcatattaaacatagctgaagaaagaaatagtgaactggaagatggatttaaggaaattacccagaatgcagcacagacagacaataagacagacaggtcacacatatatttagttggatttctagaagaaaaaaaggagaatagggaatataaagtattttaataaacaatgcctgagaaatttccaaaactgatgaaagacaccgtggaagagactgctgagtgtcccccagtatccattctctgcttctcctttttagaaataaaatgcccaaaggttaatagcgtgtatggcttcacagctaaaaactttatttcccatcctcccttgcggctaattgtggccatgtttttgcatattgtctcatatttccattagagcccttagcattttaatcatagttattttaaacttctggtctgatcattccaacacccctgtcatagctgagtctgcttctggtactggctctatctttttgaactatgttttttggcctttagtatgacttgtcttttttttactttttgttttttttgtcaaaagctggacacatactgggtaaaaggacctgctgcgaataggccgtagtgatacagcagaatgtggagggaggaaaagcattcagtcctgtgattaggtttctgtctttgggcgtgcctatgcccctggactgtgaatttcaccaatgcttctcagattgtgccccgcttaggtgggccaggatggctacaaaagactgagttgggtatttcgcttccctcaggtcagttaggctccgccaaaaccctaataggttgggcctggtaagggttactcttgagggcaggcctagttaagaaaggaacgccctgggcgtatttcaaaatgaccactttcccctccccctgccagaagcatgatgagatttttctcactgtgagaacctggttgagctcctaaaggtaaaacttacaaaagtatgggagccccaaaagactgccccatcccagagttttaactctcagacttgtccgcactgagcccccagcaattcagcaattgcagttcgggtgtccctacgccagcactggttcctgtgcctggcctcctgctctgctaagttgtgattctctgtgcccacctgtctgtctccccaattttgggggcagcattttgcccagtgacttcaattctctgataaatctaagaggagttgttgattttaaatgtgttccacttttactcgttcttaggacagaccgatgacttctggcctccttacacactggaccagcaacagaaactcccctgggtctgtttctattgaccgatttttcttctcatgatggctcacatttttatgcttcttctacctgagtcagaaagccgggatgtagagctctcttagtctgtctcctttctctcagggaccacagtccttcactgactgctgtcccccatctgaaaacaatggattttcatatattttgcccagtttctagctgtttatggtgagacagtaattctggaccctcctattccctcatggtcatattgatattgagtgactttacattttgttaagacaaataagcatattaaattttttagcataactagaatataaataggatatactacttccaaactagtagaggaaaaaagcaaataatgaaggaaaatatcaactaatcaaaaaaaggtcaagtaagggaaataaagaaacagaaacattggaataagtagaaagtataatatgttagaaatagatccaaaagacggccaggcacggtggctcacgcctgtaatcccagcactttgggaggccgaggcgggcggatcacgaggtgaggcaatcgagaccatcctggctaacatggtgaaaccctgtttctactaaaaatacaaaaattagccgggcgtggtggcgggcacctgtagtcccagctacttgggaggctgaggcaggagaatggcatgaacctgggaggcggagcttgcagtgagccaagatcgagccactgcactccagcctgggcaacagagtgagactctgtctcaaaaaaaaaaagaaagaaagaaagaaaaaaagaaatagatccaaaaagcattaagcaaaataaatagattaaattctccggttagactggattttaaaaaatccagctataagctgtttaccagagacgcatctaaagggtagaaccagaaaaggttgaaagggcaggactggctgggcacagtggtggctcatacactcaatcccagcacttggggaggtcaaggcgagaagatcacttgagcccaggagtttgagaccagtttgggcaacatagtgagaccccgtctctacaaaaacaattttttttaattttttttttaaaaaagaaggcccaggcacggcgactcacgcctgtaatcccagcactttgggaggccgaggcgggcagatcacctgaggttaggagttcgacaccagcctgaccaacatggtgaaacgtggtctctactaaaaacacaaaaattagctgggcatggtggtgcgggcgcctgtgataccagctactcaggaggctgaggcaggagaatcgcttgaacccaggaggcggaggttgcagtgagccgagatccagccactgcactccagcctgggtgacagagcgagactccgtctcaaaaagaaaaaaaaaaaaagaaaaaaagccctgaaactatcaaaaaattagtcaggcatggtggtgcgcacctacggtctcagctacgtgggagactgaggcaggaggatcacttgaaccaggaggttgaggctgcagtgagccgtgattttgccactgcactccagcctgggtgactgagtgagaccctgtctggaaaaaaaaaaaaaaagggcaggacctccacctatggccaaatgcagatatcagcaaataacctccccaaaaaagtaactttatataaagctggacaaaattgacaaaaacaagctttttgatctggaagtcaacggaaaatgtctcataatccaagtggctggattttgagtaagaacagcgggagtctgtggcattctggcccagggctgctcccatccctcctggcttgctgggcatggaagctatgccaaggaggggaaggccatgaagaccagcagcttctccccataggcttgaaaggcgctcgctcatttggatgattggtgggcaacacctgtgcccagcggcatgatcggtggaagtgacttcttggaggtgggctggcagggaagattttttccatttaaaaaatatatattctagttaaaaattttaagcctggtttcctaggagctaccctgtatctgcctagcttggtggtcagccaatgactggacagaagctgtgctcaaacatctcaagccagtaaggcttgtgtccttgggtctgggtgtgggtaggggagcttattcaatgttcaggctgctttaaggtcttctgggctttcctttccactgggccctctcacatctcttatatacacgtgcatagtcccagggcagtccaggagagcgtgagtagcatgggacccctccagtctctggtcagctagaaatatactgccgcaagcacatccatagcctcagttgagtagagctgatctgtttgcccttcccaacccgcccacctccaagaagtcacttccaccgatgacaccactgggcacaggtgttgcccaccaatccaaatgagcgagcgcccttcaagcctatggggagaagctgctggtcttcatggccttccccgccttggcatagcctccatgtccagcaagccaggagggatgggagcagccctgggccagaatgccacagactcccgctgttcttactcaaaatccagccacttggattatgagtcatcttccgttgacttccagatcaaaaagcttgtttttgtcagtttggtccagctttatagttacttttttggggaggttgtttgctgttatccacgtttggccatagctggaggttctgccctttctttttcttttcttctctttttttttttttttcagacagggtctcactcagtcacccaggctggagtacagtggcaaaatcacagctcactgcagcctcaacctcccggttcaagtgatcctcctgcctcagcctcccaagtagttgggaccacaggttcgcaccaccacacccaactaatttttttatttttttgtcgagacgggggtctcactatgttgcctaaactggtctcaaactcctgggctcaagtgatcttcccgccttggcctccccaagtgctgggatttcaggcgtgagccactactgtgcccagccagtcctgccctttcagccttttttggccctattctttagatatatctcttataaacagcttatagctggattttttaaaaatcctaactggataatttaatctatttattttgcttaatgttttttggatctatttttaacatattatgttatactttctgcttattccaacgttttggtttcttttttttttttttttttttttttttgagacggagtctcgctctgtggcccaggctggagtggcacgatctcggctcactgcaagctctgcctcctgggttcatgccattctcctgcttcagcctcccaattagctgggactacaggtgcccgccaccacgtgtgactaattttttgtatttttagtagagatggggtttcaccgtgttagccaggatggtctccatcgcctgacctcgtgatccacccgcctcggcctcccaaagtgctgggattacaggcgtgagccaccgcgcccagccccgtttccatttctttatttcccttacttgacctttttgtgattagctgaattttccttcattatttgctattttcttctactagtttggaagtagtacatcctatttatattctagttactctaaaaaatttaacatgtatatttgtcttaacaaaacataaagtctctcaatatcaatacggccatgagggaataagagggtccagaattactgtctcaccataaacagctagaaattgggcaaaatatatgaaaatccattgttttcagatgggggacagcaatcagtgaaggactgtggtccctgagagaaaggagacagactaggagagctctacatcccggctttctgactcagatagaagagacataaaaatgtggcccatatggattgcttgagcccaggacttcaagaccactctgggaagtatggcacaaccccatctctacaaaaaaatacaaaaaattagccaggcgtggtggtgcacacctatagtcccagctactcagaaggctgcagcaggaggattgcttgagctcaggaggtggaggttgcagtgagccgtgatcacaccagtgcactccagcctgggtgacagagaggaatttcagtttctggtccagcatgtaaggagcctgcaagtcatcagtgtctcctaagaagaagtaaaaccagaacagacttaaaactgaacacatattttgatatgtgtaattggaggctctgaggaagaggagaaagagaaaggggcagaataaatatttgaataaataatggctaaacaccagcatttggtgaaaagcattcatcagatccaagaagttcgaataaccccaagtgagataaacacaaagagagccactcatagacatttcatggtaaattatcgaaagccaaagacagacaattttgaaagtattatagcagaagaaataaatgacccatatagaagggaaccacaataaaattaacatctgacttctcatcagaaacaatggaggccacaagggagtggaacaacaaactgaaagcactgaaagaaaaaaatactatcaaccaaaaaaaatttgttttgagacagagtctcagtctgtcacccaggctggagtgcagtggtgtgatctcagctcatcgcagcctcaacctcctgggctcaaatgatctgcctgcctcagcctaccaaagtgctcagattacaggtgtgaaccactgcacccagcccccaaattttatatctagcaaaactatgctttaaaaattgaagctgggtgcatagctgggtgcggtggctcacgcctgtaatctcaacactttgggaggccaaggcaggcggatcacctgaggtcaggagttcgagaccaacctgaccaacatggtgaaaccccgtctctactaaaaatacaataattagccagacatggtggcatgcacctgtaatcccagctacttgggaggctgaggcatgagaatcgcttgaacctgggaggcagaggttgcagtgagccgagatcacatcactgcactccagcctgggtgacagagagaggctccatctcaaaaaaaaaaaaaaaaaaaaaaaaaaaattgaaggtttaaaaaaagacattcccagataaacaaaggctaacatagttcattgctagcctgcctccttacaagaaatactcaaggaagtccttcaggctgaaaggaaatgacaccagttagtaactggaattcaaagtaagaaatggagagcagaaaaaatggttaataagtgagctaatataaaagcctctcaacatatttttattcatttcttctcttttaaaaacataagattgcattaaaaaataggtattacactgtatttcagggcttataacctatatagatgtaataaacatggcattactagcacaaaagaagtgggaaagaatgtagccatactgaggcaaagtctccatatttcaccaaaattaagtgagtattcatctgaggtggattgtgattagttaagactcataatgtaatagctagagaaaaccctaagaaaataactcaaacttggagtgaatgaagcatgtttatgtctaaatttctgcttcaatgtaattaaaaatcaacagaggaaaattggccagcacggtggctcacgcctgtaatcccagcactttgcgaggccgaggcgggcagatcacttgaggtcaggagttcaagaccagcctggccgacatggggaaaccctgtctctactaaaaatacaaaagaaaattcaaatataacagatggacatttcaatgctctattttcaatagttgatggaactagacagaagatcagcaaggatatataaaatctgaacaacactatcaacaaatttgacctaactgatacctatagaacacaccattcaacaattgccaaatacacatttttttcaagtgcacatgaaacattctccaggatagaccataaaacaagtctcaatatatttaaaggaatttaaataatttaaataatataaaatatttctctgactgcaacagaattaaattataaatctaaaaagatagaaacctaggaagtccaaaatacttggaaattatacaacactcttctaaataactggcacgtcaaataaaaaacaaaggaaattagaaagaatgaaatgagaatgaaaatgaaaacaaaacatatcaaaatttatggaatgcagctaaagcagtacttagaaggaaacttacagctttaaaggcctataccagcaaaaaaagaaagatctcaaattaataacctacgtctctaccttgacaaattagaaaaagaagagcatgctaaacccaaagcaagcagaaggaaggaaataaagattagcacagaaactaatggaattgaaaacaggaaaacaatagagaaaaatcaatgaaaagaaaagtcagctctttgaaaaatcagcaaaattgtcttgggtagagtgaccaaaaagaaaagagaatcaaattaccaatatcaagaagagaaaaggggggcattactactgacctatagaaatttaaaggattataagagaatgctttgaccactttatgccaaaaacactggacaactcagatgaaatggagaaattcctagaaagacacatgaccaaaactgactttaaaataaattaaaaatctgaatagacctataccaagaaaataaattgaattagtacttgaaaatattcccacaaaaaaaatccaagccccgatggcttcactggtgaattctatcaaataactaaagaatgattaatgccaatccttcacagactctttcagaaaatagaggagtaagaacactttccatctcattctatcagcccagtattacccttgcaccaagtatatcacaaggaaaaaagctacatatcaatatccttcatgaactcctggatgcaaacatctgtaacacaatatttaaaaactaaatctagcagcacctaaggattgggcaccatcatcaagtgggatttataccaagaacccaagcttgatttgacatctgaaactcagtgtcatccaccacatgaacagaaaaggacaaaaaccgtatgatcctctcaataggtgcataaaaagattcgacagaatctaacatccattcatgatttaaaacagtccttttgcgggtggcggcgagcgcagaggacgccatgaaggccccgggcacacgactagagtaccaggtggtgggtcgctgcctgcccgcccccaaatgccacacaccgcccctctaccgcatgcgaatctttgctcctaatcatgtcgtcgctaagtcccacttctggtacttcgtatctcagttaaagaagctgaagaagtcttcaggggagattgtctactgtgggcaggtgtttgagaagcgccccctgcgggtgaagaacttcggcatctggctgcgctatgactcccggcgcggcacccacaacatataccgggaataccgggacctgaccaccgcgggcgctgtcaccaagtgctatcgagacatgggcgcccggcaccgcgcccgggcccactccatccagatcaggaaggtggaggacatcgcagccagcaagtgccgccggccgaccgtcaagcagttccacgactccaagatcaagttcccgctgccccacagggtcctgcgccgtcagcacaaaccacgcttcaccaccaagaggcccgataccttcttctaagggcagggccctcgcccgggtgtgccccaaataaactcaggaacgccccccaccccccccccaaaaaaaaaaacctttctacaaactaggaacagaatggaagttactcacgataaagggcatctatgaaaaatccacagctaacatcatacttgatgatgaaagactaaacgttttccctctaagattaggaacaaggaaaggattcttttaccacttgtatttaatgtagtattggaggttcttggtagtgcaataagctggagaaacaaaaagaaaaaaagagaaaaggaagggaacaaggaaattataagcatcccaattggaaaggaataagtaaaaattttctttacttgcagatgacacgtgctgtgtgtagaaaatcacaaagaatccacacaaataaaacctactagaactaataaaaagggccaggcatggtggcttatgcctataatcccagtgctttgggaggctgaggcaggaggattacttgagcccaggagttcaacacccacgtgtgcagcatagtgagactccatctctaaaaataaaataaaataaaataaaataaaataaataaaataaagtaaagtaaattagaaccgagcatggtggcctgctcctgtagtcccagctactctggaggctgagaggggaggatttgcttgagcccaggagttcaaggctgcagtgagctatgattgcaccactgcactccagcctctagcctgggtgacagagcaagaccccagtcccccccaaaagagagagagagagagctaataaaaagtttagcaaggccgcagaatacaagatcaatatacaaagaaaatcaatggttacttctatacacttttaacgaacaattcaaaaatgaaattatgaaaacaattctgtgtacaagagcataaaaagaataaaatttacaaataaatttaacaaaagaagtgcgaaatgtatacactgaaaactgtaaaacatcattaaaaaaattaaagagcaaaataagtggaatgatattctgtgttcatggattggaaaacaacatcgttttaacatagcaacactctctggctgggcgcgggggctcacgcctgtaatcccagcactttgggaggctgagatgggcagatctcctgaggtcagaagttcgagaccagcctggcctacatggtgaaaccccgtctctactaaaaatacaaaaaaaattagccaggcatggtggcagacacctgcaatcccagctacttgggagactgaggcaggagaatcatttgaacccgggaggcagaggttgcagtgagccaagatcatgccactgcactccagcctgggtgacaacagtgaaactccatctcaaaaaaaaaaaaaaaaaaaaaaaacccatgtgcatcaaaagacactatcaaagagtgaaaagataatccacagaatgggagaaaatatttacaaatcatatatctgataaggatctaatatccagaatacataaagaacccttacagctcaacaattaaaagatgaattatccaattaaaaaaagaacagaagtttcgaatgaacatttttccaaataagatatataaataataaatacatgaaaagatgctcaatatcattggtcattagagcaatacaaatcaaaaccacaatgagatagcatttcacacacactagaatggctattttaaaaatcacacacaataacaagtgttgacaaggatggagagaaatttgaacttcacgcattgctggtgggaatgtaaaatggtgccgttgctttggaaaacagcttggcatttccttcaaaagttaaacatggagttatcatatggcccagcaattctactcctaggtatatactcaagacaattgaaaatccacatccacacaaaaacttgcacacagttgttcatagcagcattattcacaacagctaaaagtggaaacaacccaaatgtccatcgatagttaataaaatgtggtctatccatacaataaaatattcttcagctgtaaaaaggaatggagtactgatccatgctacaatatggatgaaccctgaaaacatcatagtaagagtaagccagacacaaaagcccatgtatggtatgattccatttatttgaaatattgaaataagcaaatccacaaagatagaaagtcaattagtggttgccaagcactggtgggggggggtgcggtgtgtaaatggggagctactgcaaatgtgtacaaggtttccttttggggtgatcaaaatgttctggaattagatggtggtgatggctgcaaaacactgtaaatatactaaacactgctgaattgtacgttttacagggtgaattttatggtatgtgaattgtatctcaataaaaacaaatttttaatttgaacggaaaaggattgaaaaaactataccagttaaatgttaaccaaaaaaagttatagttgctatgttaatatcagaccaagtagactataagggaaaatcattgctagtattaacatatatcactatattttgatcaaatattcaacttacctaaaatacataccaattctaaactcaaatacactgaataacataacttataaatacataaagcaataattgaaagaactacaaggagaaactggcaaaaagcagttgagcctctactcaggacatcatgtgaggaaagacttggttccctggggtgagggaaactgtggaaatctccacggggtgtgagggaggagctctggagagatgggcatgagcttttgttttttaaagaccagcatgatagtaagcatgggctttttctatttctcaaaagggggcagataatagggttgaaaaatattgaaaaattatcttaaagcaaaaatcagatcctgtcacttgttctgtttaaaacgtccgtggctcccagtgccctcttgagaaagttcactttccaggctgatctctacccacctcctctcacaacctccctcaaccagacgggattctttgttatttctgaaacattccatacttcttatcttgcccacctggtgttggggctagtgatagggatccgtggatgaagctggggtggggtggagaacatggttgccacatgcccagacagtgcctggcaggaagaaacatgtggcttatagtgccaactcagccaccgcctggccagggggcccgacttggtcacttcgtctcttcaacagacctgttgctctcccgggttccctggcagcatcctcaactccctcacaacccccccaccacccccattgagtcgatgaccaagctccatctttccagtagtcccacatctcttgccttgttctccacatggttcaggcttgtctcccagccaccagccctgccctgccccacttccaggccatcgctcacaccgaactccaaagggatctttgtagggcccagctcccatgccccatttccaccactgtgcaaagacctccctggttcccacttaacaggacataaaattgaggcacagaggagcttaaaggcaacacaagccaggtggcatggtggctcacacctgtagtcctagctactcgggaggttggggatgacttgagcccaggagttctgggctgtagtgtgctatgtccatcaggtgtccgtactaagttcagcatcaatattctgggagcagaggaccactaggttgcctgcggaggggtgaaacagcccaggtcggaaacggagtaggtcaaaactcgtgtgctgatcagtagtaggatcacacttgtgaagtgaatagccactgcactccagcctgggcaacacagtgagacctcatctcgtaaaaaaaaaaaaaaaaatggcaacacaaaccatctgcaagaccccaactcaaatccagcgtgggttcccccagcccagggttctctttccttcagacacacagagtttgcattcacaaagagaagtggggaaagaatgccgccttgttttcttcaattccccacacaatcatgtcccaagcaagacctcgcttgcatggatgcaagcaagaggatgcagtggcagagtgtgggttcaaatcctcactgtgccacaagctgtatggctttggctcacttagcctctgtatgcctcagtttctccatatgtgaagtggggatgatgatcatgatagcagctatctcacaggtgaggttcaagttaatacatggaaagctcttcaataaagagtcgttactagcatgctttttttttttttttttttttgtaaaggtgggttctcgccatcttacccaggctagtctcgaactcctgggctcgagggatcagtgttctttttattaaaaggaataagccttccagaaataccagatacaatgctagatacatatttgcaaagagaagggtgaaaagtaagtctactttcatgcccgtcaggcacctcgaactcaccacatccagaatcaatctcattactcctcccccaaagtaatgcccgttgaactcttcttgatgaatgttctgctgccagaaacatgatctacctggatccccccgcttcattccccacctgcaacccatcaccaagacctgtccacatgactcccaaagagctcctaggaccacctccgtgtctccctgtccctagggtggacccacaggttgagcttcccttgaaactccgctacccacaggtttgcttcaagatagagcacgtgacccaccctgtgtggcccagaacagcagagacagcttccttttgtgatgcccaccagggttcccctgaccctcaattctggtctggttccagacaccccaattcctagcagccggccccggctcagcacctaacccacactgggcaaggatgctctctggctacaaaccccttcgatggctccccactgctcctagactacagctccagctccttcccctgccaggcttggtctggcccgttcctcttgctgccagcctcagcaccagccctgagcctgagaagccctcacagtgtccagcacagctcccttgccatcacttcacacacacacaccaccttttgcctttggctaaaccagtcctttctctctcccaggctgccatcccactgcctaggtgacccaaactgccttcctcatatgcggtctcggagggatgaaggaggggtgccgcctctgcttgacctgggggttccccctctcgcccctatcacagatgggcaggacctctcccccaaggttggacttccccaaggcaggatttgcagggtgtggggtaggggcagtcgcggagaggaatggatttgagaggctgcccagggtgctgaaggaactagggaggctaatggacgtctaaagatggggccgtggctccccctgctgacgggaggccatattgcaccctgtgtcaaggcagcccagagctggcttaagctccaagccgaagcgatctggccacgtgcctggactggaagagctggctgttctgagcgagtgccggtttcttctgtaaggctggctctggcactcctgctcattgctcccagacccacaaagatcatttttatcatccccgtaaaaccacccctccaatagagggcgtcctcctggagggcaggcgcctcttctgataggcccaggtcagtgcccagcacctggcccagagtagaggctcagtcaacatctgaccaaaacaacagcaagtaggtatcgtgggagtccagtgtgaacaacagagaagatgggaaggggggcccacagcaggggtgcccacaggcaacaaggccccacgtaggggtgagggcaggtgggacaggtcttggaggcgaggaagccgtggtactggctgactgaggtcccctgtggggcccaaagcctggagcgaaggatggcctgggagcggctgtggggatggaggaggaggctgcccacccacctccagcctgctctccctggtggaagccaggtcccctggctccaaccctgaaccccactccagccttcacccacaagacccaggccagccttggtttgagcctcaccgcctccctttggggcccaaagttcaacaaggagagtgatcttctctaccattctcgccagtcaagccatgggtcatcaggcttacactctgagggctggcagggagcaagggtctcagagtggagggaggggtggccagcttgcctggaactctcgctggggccaagaagtggctctaggggtcttcccctgatgggcccaagagaaaggcctagaggggccagcagagctttgggacccagcaaggcagggctctggagccctggcccctccaaaatggaggttggtggggctggggccactcagaccagaggacaggccacggctctccacttcagaagccaccgccaagctgccactgctcccagagccccagctgccagcccaggtctaccccagcctggagcctgagggttccaaagcccccgcacagcagaggggaagagggccctgtgtcgccctctcctggacaaggagctcctctcaccccctgaccctggggtcccctactcttctgctcgacaagatggcctctggccatcaagaaagggaagggagggagggatggaaggtgacagtcctgggctctggtcgccctccatgcacctgtgagcccttcccagtcccaggcacctggctgaggcaccccaggcccggccctgcatggcaggggcactggagcacatccctgggggtctggagccagcactcagcctcctgactgcgccccctgctggcagcccagcaggcgtgcgctgcctccactttgtcccaggaccccaaggctgggcagttacacctctggggtggcagagctgcccggccacgctgccacttgttggtgctttggggggaggggacaggaagtttttggacagttggaaacttgtctggggaagcagaggttcaggtggcagtgggcgaagccgtgtggcaggctctcattggtttccttcccacaagtgaccaggtcccctccacactcgccgcacccccaggtcaccactggcccattgctgtatctttctttattggtttggggaaaactggagggggctggaaggccatgaccatgacacaagcaggaccacccacactcagcgaagcacacaacagccgtgcaggaaagacagcccctgaggcccgcctgccagcaccccctcggcttttggcggggcggggggggcaggggcgggagaggcaacaggggaggggagccactgcccccaggcagggcagagcctggggacagacttgggggtgccccattccaaccccagcgccatgcgccacaccctcaaatctcaaaatccagcagaggccagccccagggggaggggttgggggaggggaccgaaagcatccaagggaaggaaatctgggggtcagtccacttggcctcggcatctgcctgagagggagaagcagagggaaagggggtagtcaggagccggcctgccagccctgtgcccccaccccccgcctcggtcaaatcccggacttcttagaggccctctccccctgcacccccttgcccaatgtcaagcacccactggccctccctgtccttccacctctcctggggccctggctcctccctctgctctctgccttcagtcctctggcctgtgggggccaccccacttagctcttggccacatggagcgccaccaccctctaagctctccaaggagccagctcctgggcgtgcagggtccacccaaacacacctgggcatcaccacttggggggctggccagcacggaggcctgagtggctgtggcgggccatgccctgctcagaggccccctcgccctctgggatctgccccagcttccggatgtggcgcaggaacgaggtggcattgaaggctcgctgccagaagagagggagatcaggccaggcctgggcccaggccccagcccctagactgtgaggactgcagtggtcactgggcagccacggcgatcaggctacagctggggtgcggcgggcgaccacactgggtctctctccacactgaccttccagtgtgtccgagcaaagttcttccggatctgctcactgacagagcctaagatgtccctgtcgaaggctgtgtccccagagatcctggggaaaggctgaaggtcagggggggtctctctgcaaatgcaggccccctggccctggggcagctcagcagggctcccactcaccaaaggtgccgcaaggcctgttggcaggtgaacctcttctgggggtctcgctccagaaggtgccggatgaagtctttggctggaacagggaggctgggtcagcctgtcaggtccccactcccttgcatcacctccaagcacgggccagcctcaagctcacctgattctgagatgtcatcccagaaaggagagtcaaactcatagctggccctcaggatctggctgaagagctcagggtcgctctcgtcgtagaagggggggtacccacacagcctggcacccacagatgaatcatccagctgtcccaccctccccaacccagcaggggcaggcaggcaggagacaagccttcccagcggtcactcacaggatgtaggagatgacgcccagggcccacacatctacggccttcccgtagggtttctgctccaagagctctggggctgggggccagagacagacagacgcacgcacaggcacacacgcagccatgccgctcagtgtcactggctcggcctactcaagcccaggaatggcccacacaaaggcaacgggcacaacagccttcccggctgtctagggtcccccaggccaccccactcccagcaagcctcagggtgtcgtccctcacccacatatccaggggtcccacaggcggtgcctagcatgttcccagcctggattttggagagtccaaagtcagagaccatgatcttcgagtcctcaaagggcgtggcatacaggaggttttcgggctgtgacacacggacaccgggaaaagggccagtcagtcctgacgcggtgccggtgctgggacaggatggggactaggcactctcaggttccccagagccttggtggagcaggagatcaagaaaggccccagccgtgctcccgggaaaacaaaggcagggccaggtgggcaggtgggagggtggggtgcagaggccccagccaggcaccttgaggtcccggtgcacgatccccaggctgtgcaggtaggagacggcgccaaggacctgacccaccagatggctggcatccttctctgtgtaggagccgcgctccatgatgcggtcaaacagctcgccacccgtcaccctgggggtgccaggggtttggctgacccaggcactcagcctggccttcagccccactcactgctcagtccctccccggctcccacagcctgcccaggccctcctcacagttccatggccaggtagaggtgggaagggctctcgtggacatcctccagagcgacgatgttggggtgactgatcctgcaatggcaaggaagcgcctgtgggccaacagagtcaaggggtgctctgtcctgaggccctggggaaagcctcctccctcttctcttcctcccacctctgctccccattccctaccacatgccacccctgcccggtccaggaaggcagagctccagcctgagccccggccttccttctaaagcccatttgaaaagcacagatcaatatcaactcactccctttgccacagggatgtgcaggcccagagagagcactgccccaggcctcccaaaggttggtggccaggcctggactagagccaaggactgcttgcacccccccatcgacctatgccccgtcccagggccccgcgaggtgcgcacctacggagcactgcgatctcgttctccaccagggcctccttgccccggagggccttcttggggatgcacttgagggccacgaggtgtgcggagccccgctcctgggccagcaccacctcggagaaggcacccctgccgcagacggggcggtgggaggtgggaaggaagtgggaagagaggagaggcaggagggagagagagtggagcggggagggccccctgtgaaggagatggggaggccctacctggccctgtgccaccccccaccaccactcacacatgccatctcacagactcactcacattcacacacccctacatattcacacacacacacatcatctcacacccactcgcgtagtcacacacacatgccatctcacacaggtacacacacacacacacacacacacacacgatcacacacgcgcgcgcacactcacgagccgagcctctcgcggatctcgtagacgctgctgatgtcctccgtgtgtttcttcagcagcagcatgtctgcaggggcaggggagaggtgatgggggtctctccccgccccgccgggggcaagggcagcttcctcctccaccccctgccaggcaggcctcagccattgccgctgcgcgctcgaccctcccctcccccgtccaggtccacacccccagacggacgcctcccagcgaggccaccgcatacacgcctccacatcccaggcctacagctgctatcccacgcaccctcccccgcaccccgaaggcgaccagcgcctggatgctgcctctctgcctccacacatccggccgctttccagaaggctccatgctcacccacgccgtccctcccccatccacacatctacagcgcccaagcccccacccccgcctagacccgccacccatggcacagcgcccacaggcacccgctgcccaagccaccaagccgcccgggatgcacctgcgacccccgcgcgcagccacctgccaagaccgcggccacccacgcggccgcagacgcagcccagccctcggcgccgcggagcagggggacctggcagcctgggccgcccgcgtcccgagctgcgtggaccgagcgcgtgcgggcagggggcgcgccaggcgtgacaggtgtgctgcggacgcgcaaggctgcggcggccgcgggccggatccggtgcgcccccgccccgcgcgtccccgcgccccggagcaggtgcagacctggagcgggtgccgcagcgtcgtgccgcgcagtggccgcagcgccaagccccccgcccgcgccccgccggccccgccccctccgcgcacgcccccgccagccgcccaagcacgcagtggcccagcgcggccgcggcgccgcagggcaccttgtaaggcaatcgccgggatccggctcgggtgccggccgccaccgcccagcccactgctcgctcgcgccgcctcccggagctgcggcccggctgggccggccccagggcctttgcaccaccggtggctgtctcccggagagctcttcggccacaggtcggcaaggctctctgccttccagtctctgccttcaccgcctctccgaggacaggctgacccggccacttgcccgaaagcagcctccatgcctagctccaggaccctgcaaccctgcaccacagctctgccaccctgggctcccggcactcactgggctccctctggctccaccattaatccctcaccctcgctttcttctctacccagcagccagagcattccttttattgagatcatgtcaccctcctgcagctctctatgtcaatccaagtcaaagcatgagtccttagggggcggcctaacgactgccctggcccctcctcctccacctcttccccggccacactggcctcctgacggccctagcctttgctcccctgcctggaatgttcttcgatcagatatctgcctggcttggctcctcgttccatcagatctcggctcaaatgtcccctcctcaaaccggcctcccccgccctgcccctgccaattctctccgcataaccctgccctgtctttagaacgtccaaccgcaaaaatcaccttcttcgcctggtcttcctcaccaaagcgtccgctcccagagagtgtatctccgcgaacccaaccaagacgagcccaggaaataagtgcgggtgaccgaattcaatcctgcatccaacagttactggacccccctcgctgctcgccatccagtcccatgaggttgtggccagcatcacaagggttccgtcaagtgaccgtgggccctggcatgacacgacgtcttcaagagagtccacggggcaggaagagtttttaaaaaatcatttttccagacctcaactcccatatatactctgtgtaaaaactgggaaatctgagaaggcccctagcagctcttgccccctggcctttcccagtcacccctcccaggacactgcagaaggctccagggaccccagcactcagaaactccagtcccacctgctcctctatgtgaaaatggtttcctgggaccgacatctaaaacagaaaaaaataggaatggaactgatggtgagccccttctcatgacagcaggaagtgcaatttgtttacagatacctacagatagttccccagaatgtctaatacgccaatggtgctttgcccaagcagagttctacaacatggtcctgggttataaaaagaaatagaaatacacatatttctgtgccccagaaaagtaataaaaaactgcccgcgtggaaagagatggcacaaagagacctatctgaggggcagcagatggaaactggaggccagaaggaaagcacccacctccaaagtgggcctgggaaagacgagccagcgggcaggtattggtccacgaggtgactcaggtggccctggcctcatgtaaaagctgatggcacagtttttgtttgaatcattgtatcatggggttttttttggtttgttattgttgttgttgtttgagacagggtctcactgtcgcccaggctggagtgcagtagtgccatctcagctcactgcagcctctgcctcctgggttcaagcaattctcccgcctcagcctcgagtagctgggactacaggtgcatgccaccacaccaagctaatttttgtatttttagtagaggcagggttttaccatgttggccaggctggtctcgaactcctgacctcaggtgatctgcctgcctcagcatcccaaagtgctgggattacaggcgtgagccaccgcaccaggcctatattgtgtgtttacaagagaaattacaccctccggcctggcaaggtggcttatgcctgtaatcccagcacttcaggaggctgaggctggaggatcacttgagcccaggagttccagcctagcctgggcaacatagcttttcttttcttttttttcttttctttttttttttttttttttgagatggagtgtagaaagtaaaaagttcctcttcaaagtttcccttcttattaaaaaataaatcataagtttagaaataatagtttcttttaaagactaacttccttcaagcctccttgctttgtgctaataactctttgttaagccctatcctatgtagctgttaaacatgcttacaggcacgtagtacattctatgtccttgtactttaaccaagatatctgtgctggacgtgctcacaggcatgtcccagctcgcagcctatctccctttcctattggggaatattattacttttctaagccgtttcgtaagcaacttcctcttttcctttatccttccattacttttatctattttcaaaagttttaaactactagccaatcgggttttaggttagattgtgaggtctggctgcagccaatggaaacaggacacagtagcaaggacaaacggcataaggaataaaaattgcttccctcctttgtttggtgtactcatgtggcaaaactgctggcgagtgtaccctttccgcagaaagttaaaaaatggccttgctaaggagattaaacttatgccgggtgtggtggctcatgcctgtaatcctagcagtttgggaggccaaggtgggcaaatcacctgaggtcaggagttcgacaccagcctggccaacatggtgaaaccccgtctctactaaaaatgtaaaaattagccgggcatggtggctcacgcctgtaatcccaactacttgggagtctgaggcaggagaatagcttgaacctgggaggtggaggttgcagtgagccaagatcgtgccattgcaccccagcctggggcacaagagtgagacttcatctcaaaaaaaaaaaaaaagaaagaaagaaagaaaaagaaaattaaatttatgttcaagtgctatttctttgtgccaccggggaacaaacatttctaacatggagtctcagtcttgtcacccaggctggcaggcaattgtgtgatctccgctcactacgacctccgcctcctgggctcaagcgattctcccacttcagcctcccaagtagctgggactacaggcacccgccaccacgctgggctaatttttgtatttttgggtagagacagtttcaccatgttggcaggctgatctcgaactcctgacctcagatgatccaccctcctcggcctcccaaagtgctgggattacaggcgtgagccaccgcgcccagccacctgtgtccttttgatgtccgttcatcactgcatgtgtgtgtgcatgcccgtgtaggtgtgggcgtgtctgtctctgtgagcccttccttactttctggctctgtgctcatcccttatatttcctgaaccggtcctagaagcagccgttttctctaaggagccatttttgagagaatggtgttggagacgaagatctgggcgctaggtgtgcccattgttcctggagtattgctgcttctaggccctctccactgacagcaagaacttatagtgtgtgtgtgtatatacatatatatacatagtgtgtatatatatatagtgtgtatatatagtgtgtatatatagtgtatatatatatatagtgtgtatatatatagtgtatatatatagtgtgtatatatatagtgtatatatatagtgtgtatatatatatagtgtgtatatatagtgtatatatagtgtgtgtatatatatagtgcatatatatagtgtatatatagtgtgtatatatagtgtgtatatatagtgtgtatatatatagtgtgtatatagtgtgtgtatatatagtgtgtatgtatatatatagtgtatatagtgtatatatagtctgtatatagtgtgtatatatacactaacccatgtacatatagatagatatgtagtatatatagtgtatatatatacactaacccatgtacatatagatagatagatatacaagcccatataatacccatttaatatatataccaacccatgttatgttactaacataacatctataaacagatacacacgcgcatcagtatctatattaaactcaacaggagtgcacactgatgtctccaactctaatccatcaccacctgggtcattctagctgcctgcccttgcttgtctataacctcccactctaaaagtgagaaacccaggccaggcacggtggctcatgcctgtaaccccagcactttgggaggctgaggcagatggatcatctgagatctggagttcaagacaagcgtggccaacatggtgaaaccccaaatctaccagaaatatgaaaaattagccaggcatggtggtgcatgcctgtggtcccacctactcgggaggctgagttaggaggatctcttgagcctaggaggtcaaggctacagtgagccatgattgtgccactgcactccagcctgggccacacagcaagatcctgtctctaaaaataaaattaaaaattaaaattaaagtgagaaacctggctcccaccgtcttccatccattgccgtagttcttgaattccggtataaaggtggagaggttgcagaatcattcacctctaccctggtggggggtgatcttatcaattagagtgcggcgcttatgtgttcttccttttgctcttagtctgacagatgcctattttaagttccctctgtctgctgtaaagttctatgggttttgacatattcagagtgtcacgtgtccaccattacagcatcatacagaacagtttccctgtgctacagaatccctgtgctgcgcctaccaagcacgatcccctctctcagacccctggcaaccatggatccgttttctgtctttttttttttttttttaatctattttgctttttccggaatgtcaggtaaatggagtcatagagtaggtagctttgtcaggctttttactatgcaatatgtatttaagattaacttatttctttgcatgggttcatagctttcccctctttatcactgactagtattccattgtccagatataccacattttatttgttcacctactgaggaacatcttaattgcttccagtttttgccaattacgaataaagctgctaatactatcgcactggtctttaaggaaaaaaaggctgctataaatatatgtggggtggtttttgtgtggacataagttttcaaatcatttgggtaaataccaaggagtgtgattgctgaattgtatggtaagagtatacttagcttcggaaggaactgccaaccgcttttcagggtggctgtacctcgtcacattctcaccagcaatgagtgggagttcttgctgctccaggtcctcgccagcattaggagttgtcagtgttttggattttggctatctagtaggtatgcagcggtatctccttgtggttttaatttgcaattccctaaagatgtatgctgttaaacatcttctgatatgcttatttgccatttgtatttcttctttggagaggcatctgttcagatcttttgcccatttttaaattgggttgttttcttattgagttgggatttttcttttcttttcttttctttttttttttttttttttttttgagacacagtcttattctgttgcccaggctggagtgcagtggtgcaatctcagctcactgcaacctctgcctcctgagttcaagcgattctcctgcctcagcctcccgagtagctgggattacaggcacccgtcaccatgcccagctaatttttgtatttttagtagaggcagggtttcaccatgttggccaggctggtctcgaactcctgacctcaggtgatccacctgcctcggcctcccaaagtgctgggattacaggcatgagccaccgcaccttgccaagaccccatcttcttcaaaaaatttacaaattagccgggtgtggtggtgtgtacccatagtctcagttacttgggaggctgaggcagcaggatcacttgagtccaggagttggaggctgcagtgagccatgatcatgccactgcactccaccctggcaaccagagagtgatagcacaactcaaaaagaaaagagaaaagaaattacaccctttgcaactgtgtaaacatctgctgaaatcctgtacgtgtcaactttgaaatgtatgtgtgttggttgggtggtggtgatgtgatacggtttggatgtctgtcccctccaaatctcatgttgaactataatccccaatgttcaaggtggcgtctaatggtacgtttttgggtcatggcggtggatccctcatgaatggcgtggtgccgtcctcacaataatgagtgagttcttgctctgagtccatacgagatctggttgtttgaaagagtctagcacctcctccaccctcactctcttgctcccattcttgccatggatatgccggctccctcttcaccttccaccatgaatggaagcttcctgagggtgtcactagaagcagatgctggcaccacacttcctgtatagtctccagaaccatgagccaaaataagccacttttctttataaattacccagcctcagattttttttttatagcaatgcaagaacgggctcacatatgacagataaagagctgtagtcccagctacttgggaggctgaggcaggagaatcacttgaacccgggaggtggaggttgcagtgagccaagattgtgccactgcactccagcctgggcaacagagtgagactctgtctcaaaaaaaaacctagccttcagggctgggcgcggtggctcatgcctgtaatcccagcactttgggaggccgaggagggtggatcatctgaggtcaagagttcgagatcagcctggccaacatggtgaaactgtctctaccaaaaaatacaaaaattagccgggcgtggtggtgggtgcctgtagtcccagctacttggggggctgaagtgggagaattgctttagcccaggaggcggaggttgcagtgagcggagatcacacaactgtccgcccgcctgggcaacagagtgagaacctgtctcaaaaaaaaaaaaaaaaaaaaaaggacaaaggacacaggagccaaccgaaagagagtccaatggtccaagatggaaaatttgagcaagaaaataaagagttgtgttagattaaaaccaaatataaggtacacatctatgagtccataccgttataaataaatgattacataaataaatgtgggagaacagacaacactcctgcacagaacaaaacattacttgtgtagatactgcccctccaggaggtggccccgctccctaactgggcctcacggagcggcttccttcccaagagcacggtatggaaagggggaacagtcacttcccagtggagagacccgacaaacaggaccccagccggtcgttccaggtctacatggcccccgatgaggcgcttcacccccgtggtcttcctcctgatcacccctgaggcccacctgatcatgggaaacagcaaaagtttcccaacagaggttgttttacaacacactgcccagtcctcctcgaagctgttagggccaccaagaacaaggagtctgagaaactgtcacagccaagaggagcctcaggagacaggatgactaaatgcaacatgtgatcctgacagaaaaaggacattagggaaaagccaagaaaacctgaataaactatgggctttagatactaacagtgttgattcattgtttgcaataactgatgttgattcattaattgcaataaatgagctgtcctaacataagaggctaataaggcgggagatgggggtgggctgtatgggaattcttggtaccctctttacagtttttctgtacatctaaaactagtctagaaggtgagggttgaaaaattacctattgggtacaacgttcactattcaggttgtaaccacctaatgggttcattttgctcactgcccagatagatagagccaatttatcaagacaggggaattacaataaagttttgttttgtttgtttgagacagagtcttgctctgtcacccaggctggagtgcagtggcgcgatctcagctcactgcaacctccgcctcctgggttcaaacaattctccagccccagcctcccgagtaactgggactacaggcacgcaccaccgtgtctggctaatttttgtatttttagtagggacagggtttcaccatgttggccaggctggtctctaactcctgacctcaggtgatctgcctgcctcggcctcacaaagtgctgggattacaggtgtgggccaccgcaccggcctgttttgttttgaggcagggtgtcgcactgtctctcaggctggagtgcagtggtacaatcacggctcacggcacccttgacctcttgagctcaagtgatcctcttgcctcagcctccccatagctgggagcacaggtgcgtgtcaccgccccagctaatttttaaattttttgtagagacaaggtttcgctatgttgcccaggctggtctcgaacccctgggatcaagtgatctgtgtcaggcctctgagcccaagctaagccatcatatcccctgtgacctgcacatatacatccagatggcctgaagcaactgaagatccacaaaagaagtgaaaatagccttaactgatgacattccaccattgtgatttgtttctgccccaccctaactgatgtactttgtaatctcccccacccttaagaaagttctttgtaatctccctcacccttgagaaggttctttgtaatttgtaattctccccacccttgagaatgtactttgtgagatccacctcctgcccacaaaacattgctcctaactccagcgcctatcccaaaacctataagaactaatgataatcccatcaccctttgctgactctcttttcggactcagcctgcctgcacccaggtaaaataaacagccttgttgctcacacagagcctgtttggtagtctcttcacatggacgtgtgagacaatctgcccacctggtcctcccaaagtgctgggattacaggtgtgagtcaccaggcccagccgagaaagagttgaatacacgtagaggagactggagttttattattactcaaatcagctgccctgaaaatttgaaggctgggatttatttatttattttttatttttttgagatggagtctcgctctgtcgcccaggctggagtgcagtggcatgagctaggctcactgcaagctccgcctcccaggttcaagcgattctcctgcctcagcctcctgagtagctgggattacaggcccgtgccaccacacctggttaattttttgtatttttagtagagacggggcttcaccatgttagcctggatggtcttgatctcctgacctcgtgatccacccatgttggcctcccaaagtgttgagattacaggcatgagccaccgtgcccagccctgaaggctaggttttttttttgagacagagtctcactctgttgcccaggctggagtgcagtggcacaatcttggctcactgcaacctccacctcccgggttcaagcgatttccggctaacttttgtatttttagtagagacaggggtttcaccatgttggccaggctgctcttgaactcctgacctcaagtgacccacccgcctgggcctcccaaagtgctaggattacaggtgtgagccaccgcacccagcccgaaagctaggattttttaaagatagtttggcggacagggggctagggaatgggtgctgctgactggttgggtgggggatgattcttgtgtgctgagctgagtctgcttttaggtagggccacaggaccttgagtcataggtctatgtggtccgggtggagccatctggtagtgagaaatgcaaaaacctgcaaagacgtctcaaaaagccaaccttaggttctacaatagtgacattatctacaggagtaattggagaagttacaaatctcttgagctctgaacaatggctggtcatcatgaatgcttccatgttagcagaattcaggcccctctcatcctcctcacctgatggcctttcattacttttacaaaggcggtttcatcttgggaaggtctgttatcatttaaactataaacgaaatttctcccaaagttagcttggcccatgcccaggaaagaccaaaaacagtttggagggtaaatgcagacagggttggttagatcagctctctcactggcagaattttgttactgttacagtttttgcaaggcagctttagggtgatgggtctgcacggaatatatgcatgtaacagaaccgcgcttgtaccctctcaatctataaaacaaataaaaccagcctaataaaagtttacataaaatgtaaaaaacaaagcaaagcctcctttctgcgggtctgtgtaaacgagcacagctggtgggaagggcgcgggtggggggttctgctgccccccatccctgccctgctgcaggccctcgcccccagccccattctttctgttctccgcttggctgcagccgcacgtcggccccctccccaggagctggaagtacaaagcccttccaggtggactctggctccccctttgttcccagcttattctaattccaaagctcattgtgcccggctcgccttcagaagaggaggcgcccccatcctgtctccagctgcccatcctcccaggataaccagtcaccccagggcccggtggcccctcacccagcccctccccggtccgcagctgccctaggcttgagtgggcgctggctccaattctcaggcctcccccaacaaacaggagcattccggctagcccccctcccctgccctccccccagctccccttctcctcccctctccctcctcctcagctcctactccaaccccccagccccagctggggcctgaaaggctgcccactccctgggacacggtaaggggagggtgcagctctccccccgcccctccccggtcgcctctgccccagagaacagtttgcttctcacccagaagccaccataggagctctgggctgggcacaggtcgcagggcacccccaccccctcctgcacatgctcggaaccccccttcagtgagtagaacacaagggcctggcaagacaggcggaggcttggaaagggctggcgggggacagctacccggccctcagctgggggcctggagagcccaccctgcccctccccagcagctgctgcccccgggccgagcctgacgcgccttgacaaagcccgagaacgctttgaagccttcggacgtgggagaggacccagccagggatggaaatcgctttgcctttgttcccccaactgctcagcagctcgtgggagcagcctcagaagaccctgtcactggccgcccgggtcagagcctgtgacagagaccagagctccggccggagctccccgccggaaactccagccttaccagcctgaacttcatgcactgctcaaagaggcccagctcgccctggctgggcaggggcggctcccagggtggccgacgtggggagggttcctgaacctccctcaggagcctcctgggacagagtcctggaggtcagcagagaaagggaagcccaggctgtgggccccgcgtggagggaaaactcagggggaacgccccgaggctgggagggcacagccccatcacactccatctcgtagtcttggagaaaaatttagttctacctccagggcacagaaaagcccaaagaagggatgagataaaggaggggctggtcagatttgtgcttcaggagggtccctctggctgctcagagaatgcagtttggggtctggcccaggccgtgaggaggagttcacagtcactatggggtccagaccagctgggggcgggaggcagggcctggcccaggggctggtagtgggtgcaccccaggctgggctggcaaagggcggggaagaaggtgggtgtgggaaggggtggctgcctggagaagagcccagttccaggaggtcgtgggagtcaggtatgggggcccactggacctcccctcagatgtgggggctcccactccgagggtccatggagcagtggcagccattctggacagccccccacccttcacttctgtctccagtaccctccagcctggccacctcgccctctgcctcggcctcctctgatctcacaaaggcagcagcagtcaggggtggcgactccctcatgatcctgtccctggcctcggaacccaccggaggagtaaccgcagcagtggtcacttccccaaagtgccatcagctctcctacatccttctcgagcctctgctttctctcccttccacccccacccctttgacaagcaacatctgaaagtctcccctgcccgcggctcccagagctgtctggccgtggcctgcactctccctcaaagcggccctcccccaggtcaccgtcctcccttcgatgacatcacgcgcccaccccgcactcctgctgggctgaggccctccgagcctacttcaccgggtcctcttctttctctcaaaggcaatggggtttgcctgtggtccagctgggttggccctcttccctctgtcctgggtccttgagtggccccgcttctttaggccatctatgagtcacttctctaatgcccctgtctccagaccagcttcagtcaaaggctgggccagagaagaccctagtgagaaacttctgatgagcagtgtgaccttgccacctcaggggtacccacccaccacccctggtctaagcacaggtgacaccgcctgtctcccccaaccacacacaccccttgaggctcctcctccaagcctgggtggggacactgtccctccctcacccagcaagctcaatctggcttgggccggaactgcttttcttcctaaagctggacggatggccgcgggcttagcttaacgggatgagccatctggggactgcagtgtccacgatcagatcagggagcttgaagctgaggggggcacactttacctcccaggccaggacaatgaccacttccttccccaccccacccccaggctactcttagccctagaaaattctaaacaagctgctcagctggcggcggagaggcagcccaacaagctggctcttgctagggaggcctggggggtcctggggagaggaacacggggtgggtggggggcgggcagccaggacctcaggcctgaggcctttggggaagggtctgtgcacctgccaggcaccagggggcagccttgccttgttcccgctccagtcccctcaagtccgaagcccctacccactctcacgccaggcaggggtgggggccgccggggtcatttacccgggccccttctctgccttgatgacaaagtcgaggcttgctcatcagccaggcaggctcccctctgcccactgtggagacacagaggcctgtcacctgaagagctggtcccggcctccagcttccagggtagccgggaagctgtagcccccagtgggcagcggtggagagagctcaaggaaggagggagcaccgggaggagacggctgcagcctgccaggagcggggagaaagggagagaaggggaggcggagggctgagggggcccgggggacgtcttcccagggctgggaggggccggccgggaagcctgggctgcactaggagccggcgaccctggggcgaggggcggcccggagccctgcgggaggagctggcggccgccccaggtagcaaccatcctgcctcccgctggagcggcgtctcctccccgggaggagggcagggaggaggtgggcggagtgtgacgaggagggcgggagggagggatgcgggagggggagggggaggggggccggccggccgtgggggtggggcgatagtgacatcaccccggagtcggtttttaagcggcggccggccggggacggggaagagagggatagtcggagcgaggtggcgagtcgctgagcccgccgcggccccgagagcggctgcagccgccgccgccgggaaggagagggcgaggcgcgcccgagccgccgccgccgccgccaccgccgccgccgccaccaccgccaccggagtcgcgggccagccgggcagcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccagcaggccgccggcccccgcccgacccccggagccgccgcggaggggtgaagtccgggcaacgggtggcccccgggcacgcgggggtcggggccgcccctcgtccgccgctgccgctcggtggccgggccgggcgcctccacccccctcgcagtcatgtgcctggcatggtggggggagggggccggcgatgcccgcgaggctgccccccagactcccgggctgggaggagcgattggccgccgaggtgggaaagcaggcctgcgccttggggtctccgcgaggtaaggagccctggctgcccccacgggtcgggcacacaagcggcacattgtgtgggccccccacgtgtgcacacacacgaacacacacacacacaatgggccactctgtccctccccctgccctcccctcccctcgcggccctcccgcccctcccctctggcccgggcctggaacactgggtgcccgagccaggcttgggaagcctgcggcctggcccgcctggcgccgccactggacacactgcatgcacgtcccatgcccgcccgcccgcccgcccgcccgggcccagcttagcaacagcgatgggcacgcgtgtgtcctgtgactacaaaacagcactggggttgctggaagccgaagtgacccggtgatgggtgggaaacagaggtccagagcaaaggcctttgcccaaggtcaggagaaggatgctgggacctggagtcaggcaagttgcagccaagctcagcctctgagtagtggagcgagcccagccagggcaagggtaggaggcccagagaggagaagggggtagtggcacccagctctccctgcccttctgccacccccaccccagcctgctggcctcaggagataggcctgtgtcacgccctgcctatctcctgcagagcctgactccctggccttgctaaggccggcctggcccctcttccgcacctgtatccctctgtccttgcacatcgccatcccaccagcaggggactgtgacccacccaccctctgccttagacctcacacttgcaggcaagcgtccaagggcaggacagtcgcgctccctgcctttggatgagccccccaggcctgatcacccagccttggcacacatgcacacatgcacgtgccctcactgtgctgcctgaaacagggaattgcagcactagggacagcccgcgtgtctgagcgtgtgtgtcctccatggccatcgccccaagtgaccgtgggggtggaagccctgggggcctagggcccctctgccacccagggaatagggctccaatggctcaggggctactgtagcccctcttcaacacactcaacccaccccctcaagactccacctggggcctgagtcagtggccacccctacactgactcacccagtcggaagttgtgatggggcctttggagtctgggctggcccgctgggcctgggcagcctggctgggggccaccctgagtccacgctgtgcctccacccccaggtgtgttccttattccctacgtcctgatcgccctggttggaggaatccccattttcttcttagagatctcgctgggccagttcatgaaggccggcagcatcaatgtctggaacatctgtcccctgttcaaaggtgagcagcccttggccagcctcagggactgcccccttctcccagctggctcccacttgagaaatcttttcctgtcgtgagcaccaggcctggggccacgtgatggcgtcccagtctcgaggggggagcctggaggagatgttcaggccgcacagcgaacttggggaagcggggactagagggggcataggcagctccacaaggcaaggacaggccaggcatagccgggctggggacgggacctgcccagcagcacccttggctctctaggtaggtcctactgttactatccccaaggacgctggggcacagacaggtggagcgacgtactgaggttgcccactgcaggggcgactgtctccaacactacctcaggcgactagaaaccccccccccccaccaccaccatcaacaccagctgctgaggactggaggctactgggtggccaggcagaggcttggacctcctggaaccgccatggtggcagtgggacccacagaaggggccaggtgtatgaggctggagactccacagcacttggtcagatggggacaggaggagaggggctcgctctgccttgggtctagggggcggctggaggagaggagacaggctggggagtcagcgcagtgttggggctcacacaagggggagcccaggggagtcaggagcaccacaaacaaggctccaggaggacagatggtgggagcacggccagcctgggtggggacataaaggggtggcagggggaggtggccagggaagaatctacatggcaaggacttcccggccccaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagtgagtccggcacctctgggccaagcccatcccatcccccaggtctccctcatgttgcccggctccaggggagtggccctgagggggcaccagggtgttgcctggcagtccatcctggaccctgcctgcccttgcctgtcctcggagagtcctggggccagcctcgctcctgggttcggcagccgatcactgtcctggtcactcccccctgatgggggagctggggctgcatgtgaggtgggatgggagtggcctcccaatggccaggggatcgtgggctccaggcccagcccaattggacaagagggacccgctgaaccctgggctgtgggagagaagggagccacaactcctgggggtggaccctgtggctccatcctctgctggcacaggcctcatgggacctccctccctcccctaggaacaaagtcttgaggctgtctgggggactggaggtgccaggggccctcaactgggaggtgaccctttgtctgctggcctgctgggtgctggtctacttctgtgtctggaagggggtcaaatccacgggaaaggtaccactagaggcatgcagcggggagggtggctcagccctgggagccggatgtctgtgccaggcacacctgtggcaacgggaggtgaccagacagagtctagccctaaggaagggggaggtactgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggccccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgaggtggaggtggagaggctgcagcagggcgctgcgggggagccctgcaggcccctcatgcctgcgctctccggcccttctctaggtgtggatagatgcggggacccagattttcttttcttacgccattggcctgggggccctcacagccctgggcagctacaaccgcttcaacaacaactgctacaagtaagcaccgccgccctgccacccgtgccctgtcctgccctgccccgccctgcccagcagcctaacccatccactctggcccctccacccctcagggacgccatcatcctggctctcatcaacagtgggaccagcttctttgctggcttcgtggtcttctccatcctgggcttcatggctgcagagcagggcgtgcacatctccaaggtggcagagtcaggtagggccctacccccagccccgcctccagagcagcgagtgctacccagatgcatgatgtacaggaacatgcaatagaaatgctgaaaagtgacgaggattcaaacggaacttgtcagattgtgggcctgtgggggcaggtcctgggatttgtcaatgttgacagagaaaggacctcccagcccctgccgcacgacccagggttgacagcgcctctgaggcaggcgtgggcatgggcgcgagtgttgcaggcagggctcagggtgcgcacagggcaggacatcggctacaaggtctagagcctgcacctttcccacagggccgggcctggccttcatcgcctacccgcgggctgtcacgctgatgccagtggccccactctgggctgccctgttcttcttcatgctgttgctgcttggtctcgacagccaggtttgcatggggctctgggacagggagccaggaggggggcggagggagggctgcaggcaaggaaaggggtggagggcggtgcggggctcggcctgagctgccctggccacagtttgtaggtgtggagggcttcatcaccggcctcctcgacctcctcccggcctcctactacttccgtttccaaagggagatctctgtggccctctgttgtgccctctgctttgtcatcgatctctccatggtgactgatgtgagtggggtggggggtctgcctgtgacctctggtggccgtctgccatcctccctgactgggctctgtcccccagggcgggatgtacgtcttccagctgtttgactactactcggccagcggcaccaccctgctctggcaggccttttgggagtgcgtggtggtggcctgggtgtacggtaggtcatggctgagggctgggctgggggatggtggcggggaaggcaggtctccagcttggccctcccgcctcacctcgccgcaggagctgaccgcttcatggacgacattgcctgtatgatcgggtaccgaccttgcccctggatgaaatggtgctggtccttcttcaccccgctggtctgcatggtaagggctgggggaggtggggcagggcggggggcgaggcagggcggggtaggggccccattaaccgcagcattctggtccgtagggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgaggtaaggctcccgcccggcccgccctcccctcccctgctgtgaacattcaacccagcctgcttcctagccagggagtggccccgactagggtggcaggcagtgggaaccggagagaggcagaggaagtcaccgtggggacgagcaggtgaccctgggggcttcagcatgtcctcctctcctgcagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcaggctcctgcttccgcctctgctgctctaaggaaggggtcggggtacaggaggcagggggaacctcctccagctggagctgctgccgtgagcaaggctctgctctggaggcctctgcggccggcacccttctggggactgggaagggggcagggaaggcagcagcccaggggaaggccttgtccccctggagccgaggcagttggggagagcaggacgagagtgagctggagagcagccacacccgcggggaagggtgggcgtaaagccatgggtgctgaaattttcaaaatgttaccccaagaatttgtcactgaacaggtgccttgtgtcacttgggccaggctggtagcagcagaggggataactctgcatcagggatcaattttgaaggtggagccaataggggttgtgcatgaccaggatgcagggctcaaagaggagttaaggacaacagatttggcctgagcaagaggaaagatggagctgccaggtcctgcaatggggaggcaaggagagaatggtctggagtcagccttgggtgtgtcatgcaggaagtgtcatccaagtggagatgtctagttggcaggtggacacaggagttccagaaagtactggagatggaactgtgcaagttcttaccacatagagatgacactgaaagccctgagcctgagtgagctcacagggacgccgcaagccccggaacacaatgagaggggcagagcgaagacgtggcagtgataggggaggacgcctgagagttcctggtggggtcctgcaacctgagccagtgaggacccctcacaggtcagggaggagcagtggctggctccatctgtccagtgctgctgctggtgaaggacagtgacctgcaaatgctcactgagtctggcaagggtcacgggggcctggcgagggtggcttgcatgagcgggtgcgtgtgaaaggctgggtggtgtgcgactgagaaaaggagtggcggcagcgcagtgtcatctgcagacgaagggagagacaacaacgtagttcacccagacaaggaaatatgagccagcctggaaagggaaggcattccaacacacgacacaacatggctgaccctggagggcatttctgtgaaatgagccatcataaagggatacttgctatagggttctgctcctgtgagagagacagggccttacatgagaggagggagatccacagagacagagggcaagggtgggtgccaggggctggggacagggtggggagtgttgagtggggacagagtgtcagtttgagaaaataaattctagaggtggatggaagtggtggctgcgcaacactgtgactgcacttaatgccactgaattgcacatttaacgatggtgaaaatggctcattacatatacactgatgacactatatatatgtatgatatatatgcgttttaccatgagaagaggtggagaggaattggagacactgagtacagacaggtccttcaacgggcgggaccccgtgcacaagatgagcatgtggcaccccaccctcaaagggctgggcaccatggcagggcacagcaggcaatgcagtgggcggctcaggcaagcacagagagcatcagagattggagcctgtgaagggggagcaggtgacccctcagagcaaagtgacagcttgggctgctccctttgcgtcctgcccaggactgctatcgtgctatgggagaacccccagaggccctgctcctcagcaggcagcaccccctatggaggggctttacccctaaacttctggagccaggggagggacctggcttggaatacggccaaccaagagcctgggtgagaaatacacggaccagacagggagcagagaaaggagtggcagtgcagtcccaccctagctcagccaggggctctggagcctgtcctgcagtccctggcccccatctcttcagcaaccgctgtttccagttttctttttctccctgagaagcctgtcctctcaccatgcctgcgccttcaagaaccccgcctgctggcagctcccacatctccggcctggccctccttagctgcaaaggtgcttcccaacatcagcaagacctctccccagggtgccccaggccctcacacagcccctgtccccaaccgactccaactgtcctgcagcccacagtcaccctcaggacccctgagctcaggccaactgctttatacactgtcagccaagtctctgcctggatgacaatcaccctctgctaattgttctccgcacctccaggccaaatgccctccaagccacctcatgcaccacgatgacactaaacacacagaaaaaagacattgaaaaaaggaaacttcacagaggcctgtcacttaaagagggtcctgaaatagagacaccatttcctcaggacttagctcctgcatcaggggttaggacacagagatcaacaagcagcaggctttgccctcaagcagctcgcagtctagtggaagatgggtaagaaaacagatcaggacgcccacgggtgcagatgccctggaacagaagctgatccaggaaggcgcgagcctgcaggccgccctccagtctaggctgggcaagcacctcaattttcatctctaagagcctgtgcccacaccccctgccccgttgttgttccatcactccactagaaagggcgctccagaagctggcctcgtgcagctttctgtctgctgctggcctaggcagaacagcggaagaagccatcagggctggtgagggaagcacccgtttggactttagcctttcaaagctcagagaagggtgagctcagggaggtccaaggtagctgagagcacttcctggaaaagtgggatcagccttcggccttggcacagcaaccagagggtatcgcccacgtgtcccctactccctcagacaccacctctcagaccgcctggaaagggacagaactcgtcatgaggcggctgtgctctgagcacaagggaagggcgacaggatgctagagaagggaaccactggcctgggcccggacagggcaggcagaagcgagcatgcacagcaggccgtcagctaccctgccagcatcaacatccttcaggggtccccccagttccaggagacacacctctaacctgctcccctgacccttccgcccagtcctcatgcagacaccaggcatggcagaggccctgcagggtggaagcactgtgctgcgggcgggggctgccttcctcatgtgctactggagagtagcacagtgcaggggcctgggcactggtgccaggcaggaagccccggtactggcctggcttgctgtgggcctggaagacacagctctgagggagccacgggagggacaccctggagccagcacagcgctctggtggcaggcacacacccagcacgttctcagggccaagggccccagcccattcccagcccctttctgcctagctctgccctgggccagctccaggtcactgccaaggacaagtctcctctcccagctggcattagtcagaggtcatcctgcaaaccttcgggggggggggcagggagtgactagtggcgttctgccacgttctgtctgtcccaaatgtgacgaacaggaacccagagaaggcaagcgagtcctctacccggaagccccgccggtttactgagcctcccaagctgcccacacccagggaggcagacaggacacacactcggcgggtggccctgaagcgaggcctggcccagcccggggagcaggaggacagagagggcaaggccttcgagaacaggtgtgagcctggccttcagtgggggaaacaggttgaagggctgtggccgcttgggggctccaggcaggagagaaagcagagccctccccacagctgcagtcacacaccgcaccacgtacacaccatgacaacttttattgccctcaagagaaactccagtccacctgctccacccaccctcctgcgggaccaaagaaaacacccagagggcaaaacaaaaaggggctcaaaccaacaggaagtcagccccaccgcaagccggactacaactaactcgtgctctccacgctcaggcgtggaagccaaggctgtgccaggcctggccaggccaagcaggatgacagcaaacgcattctgaacgtgtagcaatcaggtcccctgtaatgtgcttggagagtgtggacaagggccgagatgacgagctatgagctgtggaagggaatgggggaagcagaagggcacaaacagaagtactggagggagaggccgggctctcaggaagcagcaggcacgtgccaggtggaagccagctgcaggcaggggaggaaggaggcccttactcttccttcttgtccatgggaccatctactgcagcctggaaagggacagaaatcccacagcagtaggttggccgggtccactcctcccctgccacctccagccccatgccccagaggtccacctcggttcccctctctcctaacaacagctattcaagtgaacaaggggccccctccccagctgcacccaaaggcctgccagggtgggagcgtcagccctggcccacgctctagggaaagccctggacctaacgccagccagggaggactgccaggacctcactgggggctgagtcctggctgcagggaacagcaaggcatccagtccccttcaagacctgatcagacccttcccaactctgcacacctttgacaggtgccctcgaagcccatctgccaagcctgccccatacagagggcatgggtgccccctttgaggctggacccttcctccccacctgctgtggtgcccaaacttgggccaccaagcactgaggccagctgtccaaagttaggagtatttatgtggccctcactcccaacgtcaagaccgcctgggcttccagatgcggcctggtgcacccaagctagtctgaggactcagatcaggcctagggcagcaggtgatggccacaactagcgcctgctagggaaggtgcctttttgacaccttgtgccctcacttgcccagggatctttgccctacgtcactccccagcaccctaggaaagaaggccagcagtgggtcccagagtttcacctgcttctttgttcttgaccaggccccaaaccatggctgcgcctgagcacgaaggtaggaaggctcagagcctagtgagccagtgccactcctgagggccgccttggcaagtgcctacatctgctgccaggccacccccctcctgcccggtgaagggtcccactcagtagggcagaggtggccagggggagtggtggagagggcagccagcccctgggcccctggaaggttccctccgcacccgcaggggctgcctcatcctgctctgctctcctgccctgggcgcagcaatacgggagggctgacctgcagctttgcgtgctcctccagcaagcggtcgtactccttggtgaggccctcagactgcttccgcatggccagaacctggttttcagctttctctagttcttgaaatgatgtaaatgaccaagaaaacagaaacgaaaagacaggaattagggggaaaaaacccgactgctacagacaccagaaactggcccaaatctatctcaaacgaggttatacaggaggctacttctcaaaataaagcccctctgcttttgcaggcccccaaagtagagggaaagggctgacaaaaaagctcaagataaagcaaaagaaacacagaggccatcccccagtccctttaatggagaggaactctagtggctctcggcaagggtaacctccagggaggctgagagtgggagacagggagcaagatcccagcctgcaagcgagacccaatgacaaccacgccttgcacacagcagcagcaggcgaggcctgtggtattgggggaaaacgccccagacttaagtctatgcgtgggagaccaaagacaggcaggccgcttgggagccgcccactcccctcctgaacgccactcccacactcccctcattctcagcccccaggcatgctggggctaccgtgccacactctggacgggaaagccccagcatgcactgctctagtgcagggcaatcgaggcccaccaactgcagcctggttcctcctgagccccattcaaaccacttagcctcactggcctgccggctaagcatggctgcattggggttggaggcgcagggtgctattggtctgttttcagccagccctcgagcgtgcgtgcaaggcttgttactaatactttggcacaaaatgggcagcagcgggcagaggaggctcctctggacttccctgcggggaaggacacgaggtcgagcctcactttgcttagtgctggccagctcgtcctttagcttctgcaggtcagccttcaggctcctgttctcttcctccaacttcacctcagcattcccgacatccaacttgcctccgtcaacagcagctccctgggaaaagtgccaaaggccagggttactcaggagggagggagggagaggttccagccccatcctccccaccgagctgcggttcctcaagctgccctggccacacgccccttcggaaatgtcaacgcggaaccgagccaccacttgctcccagctcctaggcaaaggccagggcgtggctgcccgccgagggaaagagaagcgccagcggggccacctgctgcagctcgccgggcacgccttgcctgccctggcccctggcccctggcccctggccctgcctccttcccaagcagcagggctcagcagctccatggtgctcaccaacccctccacagatggcggtgcctcgtgctccctacatggtgccgctcactgcagttaggagcccccagtcggcctggccagctctatcccacctctgcatccacatccctccgagcttgccttgcagctcacctcctgacgggacgtctaagactggccaactaccctgcccccacctcctctccagcactgagggatgccacagaccccgagttccagagggggtgcggcaatcttgcagggaacaagggcctagctgagggccttcggatcacagcagagggcctggctcactgaggggccatttttctcagggaagggtctaactggaagcagtggatggaaacgagagcagcaacaccctcctcctcacccggaccctcacacacagacgcctccagcaggcatactctccccactgaggacttcccctctgcgcctccacccaactctggcttttcaggcacatttcccagcgtgacaggctagcagtggccactgaggccctgaagaatgtggctcccacagtgtaacaccaggacgccccatggtgggtcgggaagctgggctcaccttcttgagctggtcattctcctccatgtacttcttggccgcctcactagcactctccgcctgctttttaaaggcttcattggaggccagcagcgtggcctgctgcgaaatgagagtcaccaggcgtctaagcaggctgcaattatttacaaaaagaagggagaagtgagaaaaagagcatgaagggctggcaggagcacctcctggttgctcccactccacacctagctccagcctggacctgccctcttgccaaggcagccgagtgagaagccgccaacctggtgctggcagcgtgagggaaaaggtggggcccaggagccgtcctctgccgctgtgcccaacggccaccctcagctctcagaggggctggaagcaggagcctggggggctgggaagagcctcgctacagcatgaggtcccagaacgcggcactttccgggtcggggcctagacgtgccagacaagccacagcaccaccttcctccctgcgaggctgggcttgccttggtaaggtaacgagagaagctaatcaatccaagcacttccaacatgccaggccgcatcctcacatctacctgatgaggaagttactatcactgccccagcttatagaagaggaaactgaagttcagcagcgtaaatcaatgtacccaaggccaaaaaccagaaatggacatggctggaattccaaattatgtctgcctgactccagaacctgagctcggaaccactctgctctctaaactaacagggaacagctcccaggtcccaacgtaagatagaactctcttctctggccagcctccttcccaacccatcatgcaggctgcgctggaacacatccgttatgtaacagcaccccgaatgaggtcttcttgggctggagggtgtagaggaatcaggacacaggcgcaggctgcctctctgaagcagccaggagagacaggcaaacaggtggcagctggaggcagatgctagtccccaaacagagattggaatggccacttcatttcccttggttcacccttgccccgagatgttagctggcaggaagagaggagggaaggactcgttcaaacagtcaaaacaaggcaggggttcctttctcacacacctcagaaggcaagggtcacacagggcctgggggaaggaagagacaaatctgcttagtccagagtgcttcaacaacagcttactcagaagagtcgaagtggcctcctgccccagccaggccttcacacttcacagcctctgctcatggccaggggcagcccggaagggctggagaaagtaaagagcagacaaggtgagctacctccctggcccaagccatggctctccagggcctcggcagagcccctttccagatgtactcaggacagaaagtacccacccgggccaggagacacccctgaggttcctggtttggggagaggctcccaggggcccctggcagcaccaggagagccaggccgttgattcctggcagagaaggagagtttccagtgacatgtgctttctaaaattagcggcccaggacctcgtggcctagggctcaggtttccctgcctcagcccccagctgcccaccagcctgccccgcactgggctacagcctgaaggtggaggaagctactgagcgccctaggagccagagagaaacaatgcatctgactcacatcggcatggccagaagtcaatggagaggcctagaaagaaaggcaagtctgactaagacccaggcccccggcaaggagctgcccagccccagagcggatcccagtgatgtagaaagaggaagaggaccgctcctcccagctggaattgaggggtgggggtcatgccacctggtggtagagagaggaccaagcaagactgaaggctatactccccgccaccaggccaggcaagcggctgctggtgagtgcccatggctgtcaccccagtacccagggagatagctaacacaaatgcttccgcggcagtgcagcagaggcccagctcttttcggaccgtcccaggcccttcccggctattgagaaccagggcttccaagataggccagggcatacacaaagtccagcgcaagatccacgctgtgtgtgtccgaaagcctggccctgctcagccccagcccaggccttcagttcccagccttgagacagtctggggctcccctctgccaggccccggttccccttcctcttgccaaccctcacaggcgctccccacccccacagcaccccgggcatactcctcccactgcacccccagcccgatagttctttttcacaccttctaggtcctctctcttcctgctggatgacccgggatcattctccccccaggaacctcaccttcaactgcctccttcctggagtcaccctgcccaagcccctggtcttttccctcccatatattcctcaacctaggctggccaaggcctgcccttccaagccagcagcagggccaccagtggcctcctaaccgcccaggccggaggtcaccctgaactccttgctctgctgctaagttaccctcctgaggtcccctcgcaacaccctcctcccactgttattctgctccctctggggtctgcactcttcagctgacaccctataccttcctcccagccactcttatccccgaaagggttttctctgtggcccagactcatacctaacctcctgctaaacattggctcctggatgtccccagagacattctagactcagcttgtccaaaacgggccttcccttgtcctgcctgacctgaccacctcgtgtagcccctgctgtagtggtgggcaggcaaaccgccttggactcagccctcttggcccccagcccaagccacaacccagcactttccatgtcaactgcaaacatgcccaccatcatccccactgctggcgcctcctccctatctgctgccatacggctttcccatccacctcccagagcaaggcaaatccgaccatgtcagccctctgcttaagccacctgctgccagcacgcatgccctcagtgagctctcctccttcactaaccacgtggccccctgctctagtaacacctaacccctcaccattcctggaacacgcctggctctgtgtggcagttctccaggccggaatgtcctctcgacccagctcaatcctcacctccccccagaaacccttttggatctcccaccccatcagagggacgccttctgggggctcctgcagcagccccccaggcacccgcatgtaactacctcattctctgttctctgcgtggctgccatccgtttatatggctgccctaccaggctatgaaggtctttaggctgggcactgtgccttcatctctgcactcccatacctggcacactgaaaaggggtcttccgcccactccagcaagtatagctaaaaaaaaaaagggggggagggcgcggggctgggcttccagatgactggatcccactcccaggagaggaaatgctccctgacaggtgaggggacagatttgaggctgcacgtaaggctggacagaatctccctgggcctagactgcacctgtgttcacctgggagcctggcaccaagaggggcagaggcagacacagagctgctcagtctagcaacagaggagacagaagacaggagtgggaaggcgccgtctcagacccgttctgatgggcaagccaggctcatggctgcagggggaaaaaacattcactgccgcgacctgaaggcacaacccagagctccagcctctgcatcctcacaccctcaacccccacccagggcccaagcaatgcagaccaggtcctctctgatcactggcatttttcagcctgggagccagccttctagaacattttcccgctccctcacactgggtcactcaggcacgttaacgtgcgcttgtctgttcccttgtagcttcccaggcccccaggacagggcacgaacatggcctttagcttctgcctctgctggatctcccaagtagtcttacccgaatcactgttcttagctattcatttccagaaaacaggaaagaacctaagagccaaaggcaactcctacagatacagggtggtcaccaatagaatggcctggggtccaaaaaaaggccagtgaacgaaacttaacagaatccagatgtggccttggaagacacatggcagccccaatgcctcaatctgactgggctttcttgatagaatgttgttggacactgagcagggctatcgtgcttttataaaaggttgagtaaaccagagaaggcaggagaaacagaacctctccacagactagagaaacagggccaaccatatcaaatggagagagccatggctcataagcacttttcagcagccctgtcttcccccatgagcaaggggaagaggacacgggcttaataggaaatggagaaggagcaagtcccgaccaaaagattccatgctgtggccacccccggcccgccctgctgacgggtttcaggcgagtcaagtcattcaacccccagcccctgcatacacatggtgttcacataagctcactcctcagcccccagccggcagaaagccggtgtcccagcgccacctgctgactttccaggcctaccgcagggtggccagtggactctgggtgaacacgccccagctgtggaagaaaaaaaatgaggcagcgcccaggcaaggaagcaagtcaggtgacgcctcaggaaggcttcagtgaagaagaatgactaacaccagggcttccactgccctcagcgactcttacccaccagtctggaatcaggaaaacaggttacaactgggagagtcacctagagcagacccgagaaggctgccccaaagggctgccccaagtccattttggtacagctgcgtggccttccctgtagcctcccagcacacagacgctggagaagacgggaagaggagggctagagctgggggaaatggaggccgtttcaaatgagaacatgacttgtggcagctccagcccacgacccagatggagctcacccatcctgaggacagtgcactaagcgcagggcaaaggggcaggtgtgggtctggcctgtcctcccttcttcttgagaacaagtgacacagaccagctgggtttctggggttttgctgtgtatcttttttaaaaccagctatctgaggggtttggggtaagctggagggtagagagcaaccgactgaggtaagacaacttaggcaaaggtagtctgtgattagatgactcaacctaaaaaagaagaaaaagcagctcagcagagaagcacgggcagctccatctgggctaatggcagcgatgggattctaccctggaggggtaaagaggaaacaaaagatgcctgtggatcaagttcaggtcagcaaaaattcagggggcttccacacaaacaggggccttcctgcgactggctgctaaccagcactttgggcctaaccttgaccgtcatttaagctgagtaaggcagagaaggcagtgcaggtcctctgaacacacaaaccccagcccagagggagctgccgtccccaacacactccaagactcaagagggcctctcgctagctgtgcccccgaagtgcaaggttggcaggaagggaacaggagcgactgccggagtcttccacaagtggaaaccagtggctcatccagtgtggtcccctggaggtggccccgatggacccgccttcacaaactgtcatagctcctaagacctgaaaagctgggcttcttggctaaaaagcccaacaagttcaacccaggcacgcacctaaagctgtcgccgtcagcccgggacagcccattcagtcaccaaatgtttcagcgcccttcatatgtgccaggcccttggcactgagctgaacagtctgaaggggaagagcccaggttttccacgatgggcaaccctgccaagtgccacacctcagagctgcgtgtgcaggctgccctgggacccgaggacagcgctatgggtcagccgggaacatggtgtgggcccctcggaacaggctccacagggaagcctcggagattcacgaagaggaggtgccggctgggccggcagctggagggggtgttccgcacagaggtccccaaaatgctcagagaatcgagttgggggagagcatgtgttacgtgaggctctcccatgagacccacatgactgcttcatgacagggggaggccgaagcagagactgtgggggagccgcgtcctggaggatccatgtgatagcgagccactggaagtggggtgcacaggccaaaggggggaaggcaggtggcagggagcccgcttggtctatacgggatggtggtggccccaccacagcagtggtcccaagggttgtgagagagaggcttaggaggtgacatctacaggctgtttcatgggtggagtccagctctgcaggctgaagacttctggaggttggctacttgacaccgtgaaagcgcctcaccctgctgggccacacactgagaaatggccacgatggttgggcagtcacatgggacaagaagaaagggcagagcagccccaggcttctgggtcaagtgacaggactgagacagtagtggcagaggcaggacaaaagctcagaaggctttggctgggaagctgggactctcccactgctatcccaggcagcagcagcagactatggggggccaagggtacagacttgcttctaggtgtgatgtttcctttcaggccaggccccctttcccaattacaaaggctactcgggagctctcaggctaacctcctatgtgttctgagcccagtcccgctgaaaactagtgccaagcaccaggccttctccagaatgtgctcccctccttggccactaacctgctcacatcctccttcttgatcttgcttccctcttccttctgctccccgatcttctatcgctctgctggaggctggaatccatcctgccagcacattccctttgccctggcctcaatgcctctgaagccagcaacccaagctcgactgcccggaagcaccctatcctgctcatctgccaggcctcccctgctcaaccctgctctccctgtcccctcctttccttgctgcccccaggcctggccagaagtcccactctgcaaccagccctcacacctagcacgatagtgttactccatgggcagccagagctccctttccagcagggggctgcgtcctcgattccgcaagtccacagcagaaccaagatcatctcagactcccagagactggaaaagcctgctgattcaactccacctgggcctctcagctctgtcccctccaccccacttctactaccactgtaccactgcccccgttcaggttcccagcaagtctcactgacaacctccaacttggtctccccacttcaggctctcctgctccactccaacccatacacccttgcaaaatgttaatccacacaggtgactgcatgccagcagtactggaatacccactaggcaggctctctaccacgcagaaaagttgcatacgaagtctggaacccttaactcctaaccatctaacctgctcgggccatgagtacctgctcgcgccatgagtacctgctcgcgttcaagaactgagcctctcagtgggacataaagaacatggaaagaaagagaggtgggtgtggtggctcatgcctgtattcccagcactttgggaggccgaggtgggcagatcacatgaggccaggagtcagagacgaccagcctggccaacagggcaaaaccgtctctactaaaaatacaaaaattagccaggcgtggtggcatgtgcctgtagtcccagctacttgggaggctgaggcatgagaactgcttgaacccaggaggaggaggctgcagtaagccaagactgtgccactgcactccggcctcagcgacacagagagactctgtctcaaaaaaaaaaaaaaaagaaagaaagaaagaaaaagaaaaagaaaaaaatcaacagcaacaaaaaagaaagagacagataataggagtggcatgggtgctccaagaggatcaggaggcccaaagaaagctgactagctgaggccactgtttatgacatcagaaacagagctgcaggctcgacatccaccaatgaggaattgggtagacactcaagaacactcaagaacgctggagaggccaggcacagtggctcatgcctgtaatcctagcactttgggaggatgaggtgggaggatttcttgagcccagcagtttgagatcagcttgggcaacagagcaagactctgtctctacaaaaaattaaaaaattagcagcacgtggtggcacatgcctatagtcccagctactcgggaggctgaggcaaaagggcggggctgcagtgagccatgatcacaccaatgcactccagcctgggtgatggagcgagaccttgtctcaaaaaaaataaataaataaataaataaataaataaatatgctggaaacaggtcagttgtcccagaaaaacattcatgataaactgagtagaacactcaagtcaccaaggggcatttaaagcatgtggtgcttaaaagccccgtggttaactttttttaaacacgggaatgtttttaaaaagcatgtggaggctgggcgtggtggctcagctgccgcactctcccgtgttcccatccagtagcctgatccaaaaaagccatgaggttggtcttgcgtgacttcttagaaaaggaaacggtgatcccagagatcagtgtggattcaccagttgcccataagcgatctagttaatcatttctggaattttgccagaaatatatactccttgctagtctaagagttaaatctaagatggtggctgtgaccctagaggaccttggctttctgtgtgatgctcttgtccagccttatggccacacagcccatttgcagcttgcaggaaacactgaaaaaacaaagcaggccaggcgcggtggctcacgcctgtgatcccagcactttgggaggctgaggcaggcagatcacctgagctcaggagtttgagaccagcctggccaacatggtgaaaccccgtctctactaaaaatacaaaaaattagcagggcatggtggcgggcgcctgtagtcccagctacttgggaggctgagacaggagaatggcgtgaacccgggagacagagcttgcagtgagccgagatcgagccactgcactcctgcctgggcgacagagtgagactctgtctcaaaaaaaaagagtgagccccctaaggcttctatgtgtatgtgtggatagagccaatccacatggcagccactcatgtgggttaggaccacacctaactacactgttctgccagcaccttccccacacttcggcatctggtcgttaagaacagactcagactggcaagcatcatgctaaaaatccatctacactccatctatagaaggctgacagaacttctccaggaattcacagcagtcaccaatgatcccgctcttcttttccaaaagcatacaagctattctttctagagcatggctggagatcaaagtcaaccctccccaggtcaattcctcatctaccttctcctccctttggaaattgggatgtttgccaggctgcagtctgccagtatctctcccactctgcaaatcctcaagcatcggtggcaatgccttctgcagatgatctcaacagcttctggacataatctcatcaagtacatcctttagggatgccactcttgcccacctgtaatttccattttctcatcctagtgtttcctttgcccttgaccacctaccctccatctccttccttacacagacatataaaagggactgccttctcctcacttctccatgtctttcatgattcagagctcccggcaggttttcaccttcccgatactattcttttttttttttttttttttttttgagatgtcacccaggctggagtgcagtggtgtgatctcggctcactgcaacctctgcctcccgggttcaagcaattctcctgcctcagcctcccgagtagctggcactacaggcacctaccaccaagcccagctaatttttttgtattgttagtagagactgggtgtcaccatgttggccaggctggtctcgaactcctgacctcaggtgatccacctgcctcggcctcccaaagtgctgggattacaggcctaagtcaccgcacccagcccacccctcccccataccattcttaaagctctagatgcttttctggtagatggcctagtttcctctctttccctctcaatgtggtcttttttcctcattttgctgactgtcacactcagaattctgggtttgagactcagtctttcagatctgcttccctttcagcctcagaccacaagataatacttgtttggaacttcctgaaaaatttagggtatgtgtctgactcctcccagccttcctgactttcctaagtttgaagacagcaagcttgtagatcaaatctgtgatcaaacccattatcttgaaaaaaatgtgtttgccttttctagctccacccctctttccaacttggtcgcagagagtaccagatcatctaaacaacagattttaagacaagtagtcatcgtagcgcctagtaaagcaggacacaccaggtgactagagagcaagaatctcctaggcatggagattcttgagtctcggggcacaaaaccaagtggggaataactgtccatgagcctgagaatcacttggtgctatggtctgagtgcccttcaaacttcatgtgttggaatttaatcctcactgccgtagcattaagaggtggggtcttttgagaagtgattaagtgatgagagctccaccctcaaagcaagcgcctttccaatgccttcatacatggtctgagctcccatccacctcccagccaggccctgctgatcagaacggctatgtgaagcaggaggcagcaaacagggccccaggctcaaataggcacttcgtagtggtctagttttgcccgactagttacccttagccttgattaaggtacttagttttaccaaaaaaatcatcagaaatactctggctgccatggaatgtaacatgtcctcattacgagtttcacgtggggaaggccctgaggtgaggagaggcccagcctcttcgtgccacttttacctgctgtccctaggtcaacaccccggacacaaagagtcccccattcagtcgctcccttgtgagctggactctgaaggtcctctcccagaggagggcaaggccttaccgttacatctcactctccatgcaaacagaccgtgagatagtcatctgtttgcctgagagtatgtggtgtgtgagggtcttctgatatttcaggcagccctctcctactctccacgctgcctctggaggtcaggagaaaactatgtggcttccctaacacagacagggctttgggatccaggccacagactgaggaggaatcaaagtcacaggggggagactgagcccactgagctcggtgtccatggctagcccatggctcctttcacagcacctgccccctcaaccccccactcacaaggacagcagcaaggaaaagccagcaatgtagagattcctctgggcacggaaaagcttcatgtggaagtgctccatggccccgggattgttctggaggttcaccttttccgtcacatcatcatacttccgaatttcgcgcacggcatctgtggtggagcagagaggagacacgggcatttagcggacactagggcaagataaggccataccaggcagacaggcggcatgagacaggtcagactcacttccctcaaatccgcctccccagttcttcccacttctatgcacatacacccctcatgggatgctgttatcagaagctcccaccctcaggccaggtgcagtggctcacgcctataatctcagcactttgggaggcagaggcgggcagatcacctgaggtcaggagttcgagacaagcctggccaacatggcaaaaccccatctctactaaaaatacaaaaaaaaaaaatttagcccggcgtggtggtgggcgcctgtaatcccagctactcgggaggctgaggcaaaagaatcatttgaacccgggaggcggaggttgcagtgagccgaaattgagccactgcactccagaccgggggacaagagcgaaactccatctcaaaaaaaaaaaaaaggaagctcccaccctcagacccactccttcctccagcttttcaatccctggccccattctacacaggccccaggcttgctctgcagttcacgatgctaaccaagcctaaagagtttctggaaatgggggtggcttccttttcccatggtaccctcaccgcgtcttgttctgttcatctcaagttggcccatagccccccaacccccacaatgataagttgaacctggagatggaaatgcctgctccggggacctaaggtgcttaagagtcaagacccaggccagatgtggtggctcacgcctgtaatcccaacactttgggaggccaaggcaggaagactgcttgaggccaacgagttcaagaccagcctgggcaacacagggagactctctctcaacaaaaaaaaaaaaaaaaaaaaaaaaaattttaaatagctgggcatggtgctgcacacctgtagtcccagctactcgggaggctgagacaggaagatcgcttgagcccaagaggtcaaggctgctgtgagttacgatcacaccactgcattccagcctgggcgacagagcgagactctgtctcgaaaaagccaaaacaaaacaagcaaacaaacaaaaaaataggagtcaagacctgcaggataccagctaggagtcaagggtttcatttcaaagctttacaatgggttttattatctataatgttttattctgattacgaaaggaattcacactcatcgaaagttcaaacacacccaaaatgtagaaacggaaaggatcccataacataatcacatctagcagtatatacaataaaaatgtggtcacatctaaagtcatttttagtcacattacactgttacctgcttcgtaatagacatccatctctgaaattctctttaaacacattttttgggtccatctctcccaaagtagactacaaacttcataagagcagaaatcttttatactatattcccagggcctgggatagctctgggtgcagagtgggcactgaaataattgctgagtcagtgagcagcctctgctcctgaaagagccgctgttagacatatagagctccagttaaaaatatatttatatttgtctctaatgtagaaattgagccacgccaaacctactgcttttccccatgcatcctgagacatcgttttaagtcaatacactaagatgtacccaaagaatgctcttaatagactcccatatgagaggagcaaggtatcactgtatgggtatcgaggttctttttgtatggtgggttacagggtctcactctgtcacccaggcttgagtgcagtggcacgatcccagctcactgcaacctccacctctcagcctccccagtaactgggaccacaagtgtgtgctaccacactcagttaattttttctttttctatttttggtagagacggggtttcgccatgttgcccaggctagtttcaaactcctgagcgcaagcaactgcctcagcctcacaaagtgtggggattacaggcgtgagtcagggcactggcctcatggggttcttaatttccggttttaggctgcttagtttttatgttgatcttgcattataaaaatctgcccatccctcagcaccacgaagcgagtactctcaaacgctgttagcaggggtaaaaacagcacacctgtataaaatgcaaaatgttcataccctcgggttcaacaattcacctctgaaattatcccacagaagtatttgcataaatttgcaatgattcgaagatgcttataaagaatggattacggcacaaccacatgagagaatactacatgatctttaagaagaatgagattgctataaaaagatgttggccggacacagtggctcatgcctgtaatttcagcactttgggaggccgaggtgggcggatcacttgaggccaggagttcaagaccagcctggccaacacggtgaaacctcgtctctactaaaaatacaaaaaattagccgggcatggtggcgggcgcctgtaacctgcagctactcggaagctgaggcaggggaaatcgcttgaacctgggaggcggaggttgcagtgagccaagatggcgccactgcactgcagtctgggcaacaaagtgagattccatctcaaaaaaaaaaaaaaaaaaaaaagatgtctaacgtgcagcaggtagaaaaagcacaatccaaagtattggctaggctctgctatggacagcagtcttatctcagagctgtgctaccagctcaggcgtggaatgctcctcctgccatgtcccagcaggaatgtggaaagaaacataaatactttgtgtgtatgatcccaccgttgtagacattttattaaagatgtcagcatacaaaacccctctggaaatgcacaacaaaatactcatgatggttacctgtgggaaatgggattatggggagtttaactttctaaattcaacttttgaatttttaagaataattacccattatttttgtaatcagaaaaacaagataaacatgtttccttacactgtcacctgcatccaggaaccccaccatcctaaggaccaccttggccaatgaccaatagtggggatgggggactgagcaatactaacccaagtcccacagtagaaaccagccctccctgtctcgggcctcagcccaggtgggaagatcctgcaccctcagcaactccatcctccaggaggatctgctcaaccctccccacccccaagcaaggccacagctctagctagttatgccccttacccttcactagtacctgtgactaacacttctgtttgaagaaggctctgcagatctttctagattatgcttcttaacatgggagtaggaagcagccagtcatcatggccatatgtccccctagaacttccaagcagttccccgatcccaaaaaagaatgaaggctttgtcaactactggattccgcaaaggatctctccagcccactcagctgctctaggaaagaaacatactccttctggtttggggaaggggcaagaccctgagggaatcatcctcagcatggtccctcccctccccagttattacccccaccccagacccaaaagccaaaacacacatgctcagttcaaaaactcagtggcctggggatgacacatatattacctacctactcctggcttggaggctgctcagggcgagaaccctggttagaaagagctactacctcttggggccttgccaagtatttcaagaacactgaggtgctcaggcagctggcacctaccctatgtggttggaagctgtcaggtaacacttggcctgttcagaggcagtccagcctgaacatatcctatcaggctctgagacatcaggaaggagaaatgcctaatgctgaagctggtgggtgaggctttgcacattcccctgaaccacagccccccacccgctcagtgtttctgctgggactcggtgggaggagtgttccacgcctaggcaggcaccacagctctgagacaagagtggtgtccacagcagagccaagccaatactttggagcccaaacagggggacatatcgatcacttaccacagcaaaacaacaaacatctaccagtcagacaagagctttattgattcttgtctccagatggtcaccctaccacctcattgcaaaatgtctgcctttcatcttaccaccacctggcctggccttatcccagagcctgcttgcccttggaccagtttatctttcaagcacctgctagtgtacacctcaatgtcagagtttacagaactacagagctggaacgacctgggaaaacctcaagtctagcccagatgcagagaggtctaggatctctccccaagatatgctgccacacatctctgtgttctcctcctactactacagggaatggcaggacttcactgtgtgcttggttgctcagtcccccattagaggccctgctccaggcaattctgctgtttaagtgactggtgagcagcactactcagaccaaggtcacaggccagttagcttctcttggcttcagttctagagtgacctgaggagcagcctcagaaaccttaggcgtccctccttccaaggtcttgaaaaaaagcaatgtaaggtggccgtcataagctgcatacaaactgcttggtataagcccacgcccactgctagaggggcctcttttttttttttttgagatggagtctccctcttgttgcccaggctggagtgcaatggtgcgatttaggctcactgcaacctctgcctcgtgggttcaagcaattctcctgcctcagtctcccaagtagctgggattacaggtgcccgccaccacgcccagctaattttgtatttttcgtagagatggggtttcaccacgttggccaggctgatctcgaactcctcatctcaggtgatccaccgacctcagcctcccaaagtgctgggattacaggcatgagccaccatgtacggcctagaggggcctcaaagtgaagaaccgactagcggtcagcagcatgggcaaagggagcctcttccctccctcaagagaaagacacagcatttcattggtctgtctcctagcagccaaaactggatgctacacatcaaaagtggcaaagggttttgcagcagagaccagggtctaggtcaggtagctgccctcagccatagctcactcaccgatgaccaacagcacaaggatgacaatgagaaccacaaagaaggtgttgccataggacactaacaactccaccagccgggacttgaaaatcttctgccatctgtgaagaagacaaaaaggacaggagttgaagagaaagcacacacacgagctctagggccctgagcaaaatggaaatccagctttgtactcttctccaatggccgaatagcccatgcaaagtcagcctcagtggcttgcaattctctaatttgacatccattcaagactattggaaaaaaggccaggtgcaatggctcacacctgtaatctcagcactttgggagaccaaggtgggtggatcacttgaggtcaggagtgcaagaccaaactggccaacatggcgaaaccctgtctctactaaaagtacgaaaattagccaggcgtggtggtgggcacctgtaatcccagctactcaggagggtgaggcaggagaatcacttgaacctgggaggcggaagttgcagtgagccgagatcgcgccactgcactccagcctgggtgacagagcgagaccttgtctcaaaaaaaaaaaaaaaaaaagatgctggtccacgtatagatcaaaatgtctggaaaactaatcttttttttttttttttgagacagagtcttgctctgttgcccaggctggagtgcagaggtgtaagccaccgcgcccagcctggaaaactaatcttaaacgtgggcagttggctgggcgcactggctcacgtctgtaaacccagcactttgggaggctgagatgggcagatcacctgaggtcagaagttcaagaccggcctggccaacatggtgaactcccatctctactaaaaatatatatataaaaaaaaattagctgggcatgttggcaggcacctgtagtcccagctactcgtgaggctgaggcaggagaattgcttgaacccgggaggtggaggctgctgtcagccgagcaccacaccactgcactccagcctgggtgacagagcaagactctgtctcaaaataaaaacaaaaacaaacaaaaaaaccacaacaacaaaaagaaaacatactggtagtctctgaaaagggaaacttacttttcattgtactcccctttgtaatattcaaatgtttgccccatacacgttatttctttaaactgtctttccacatgataaaccttggtttgtctatatcccccgaccctgttatgatgagatggaccccagacctcacatcatttccatccacaaatgctttgggatgcagctctaagaagagacttcagaagtgtttacatattgttcaaatcaacaagaagccctcatcatcagggctagagttgaatatgccaatcactgaaggcaatgatatttgtttgaatccggacccaacaaggtaccgatttggcattcggtagataaacgtcttaaatccagcttattctggaagctcccccttccctctccctctttcatttgcttttccagtttcctttgtgtagaaatcagattgtctgtcctctaaagcttcccagattaaagctccccggggccctctatctctgcacgtcttgtcaactgtacgaaggtgtggttttctacaagaatcctcctcagacagcactgcatactttctatggtatcacatcaaagataatttttcacgaaaaaacggcttttaaaaatacctgtggagatttggccttatttgtaatatcgtaatttaaatagggatgtgttcaggtattatacataattaaaattaatctccaattcacttttaacaggtcctctgttcattaaaagggaatatggcttcatcctccacaggctgagtaatgttcatgcagccactgcgcaataccagtgagactagttaggaggacaagagtcaccaaatcagcaacaacgtgacccagtggtgcaagtcttccgaatcccacgctaccatcccagcaccccgtggaccaagagtgggtgggagggcatcatttccagaactgtaacatagatcttcctgcctctcgggggcattctgaagaccagaaggcaggggacacaggaaaaggaactgagcaagtcatgacgaagcagaaccctgggaagggttggcaataacaaacacaacccctgccacccccaccccagacaggttctacctgttccatcgggtcccaattccagggtccaccagctgcacacaccagtcccagggctagggcacaggcaccctcctgcctaactcgcctgcttgctccataggccataccttttaggagaaatgaagggaatgcagagaagcaacacaacaaagacctccgcatagaggaaggtggcaactgcagtccactgcagactcatcctgttgctagaaggtttcccacaggaagatgtgagcttgtttcctggcagggcacaaaaggtacgggacttgtaagcgctgggcagccaagaacatccagttcagttaccctgcgaggctggggccgccactctccaccctgaccccctgcactttgcttcaaagtctctgatgcgctggcggaagcagggctccactcggcagggcctcttggccagcagcgttcacaggccccacaaacttccgttcgctggtcaattacctgccccctccagcacgtgtgtcaacacgtccagagcggcctctcccgacgatccctgccccaggaagcccgagatttccgacgcccgtttaactgaaaggcgttcttcgggaagagcagtgccagggcaccaagaggaggacgcctcggcacccatcgggcgctcccttccccgccaggcagaactcagccgcagaggcgggcgctctgcgggcccaaatccccgctaccaggcaggcccaaggccgcacctagtccaagcgctgccgacgcccccgcctcccaccgtccccacggcgcccgcggagagaaaccggcacctccctcgaggatccagcggccttccgcccggggccgcttcgcctccggtgggctggaggcccgcaagagcgactcctagagggcaggattcgggaccaagcgcaaaggcaggtctcgaccaagcacctcaaggccccatacggagaaagttctagacgcagtatcctcagaagccaggggtccttacagtagccctcgcgggccccagcgcccacccagagcgaggggcctccgacttggccccggcctggcacaccgtcccggaggcccatcccggccgctcctccaggtggggcttcaccgccccccgccccgcccccgagaccagcttctagaggcgccgcccggtttcccctcgcccctgcctctcacacgcaggtaggctgcgggccccgagattccccggcccccgggcctccccgcgccgctcgcctctctccctcgtcgatgggccggggagcctccgcggtcccggagcccagcccggcgcgcggagcccgctcaccgagtttcccacagtcaacgtgcaggccccgccgcagcaacagaactctcccacagcagccccggccccgcccctcataccgcggccggaaaccggaagcgcccgccgggcaccgcccaccagccctcgcgaggccccggaggctccgcccacctccgcttcccaccccgccccggagcggagggccggcgctccgagcgggagaggaagaggcgcctcgggctccgggcgagcagggcggggtggagcgagcacgcgggcggggcggggcggggctttgtcgggccggcgagggccgcttctctagtccgcgcggccgtcccacgtctctgtggtgcgggaggggccccgccgaggggcgagaacgggaggtgggggtgtgggcgggccccgccgaggggcgagaacagggtggggctcccgcgcccggactccgcccctcgcccctcctccgcctcctccccttcccccgactcgcccctggggaagagtgggtggggattctgggccggtggaggagtcactgtcgcttcagccaggctgcggagcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggggcaggttggggtgccgggcacggagggaagcgtgtggcagggaggcccgggggcaggcagccgtgagcggtggggacagtctggggcgggccggggctgatgccaaaggtgtgggcaggccatgggagagccgggctggggtgggcagggcctttgggcagccgtggactcaggcgcggcagtggagaggcaggaaggctgggtggggactgtcctgtgctggttgcctgcacgctcgaggccacttctgcttcctctcctcctcaaggaggttgtcctggccttagagctgcgatcctagcggtttgagcctcgagagctcctgcccgccccactcctgcagccagccaggaggagacgcctgccattcatgagcggggaccgagggacgcagcctgctgcctagcccctcctgggcccttgggccctttgaaggccggcgtccagcagagctggctggccaggcaggccggcattatgggcatgactcagcccaagcggaggttaatgagcagcgcccagcacagcagtgggacttggggtcaaggccacccccgcctgagcccacaggcctgcctggctaccaactggctcagctgccttcccgggcccccagaccagagatgccgggcccaggccgccactgcggcgggacacacttcctgctcctggcgtggctgtccttccaaccctgtctgtctcctggctccctggtgggccggggccggcgggccagacaggcgctgggaaaggttactccaggtcaatgctccctttatctcgcctcagcccctccccttcctcgtgcctggggttgcagctgccttgggccctgctctctgcgactcagtttcggttccccagtgcttcttgggaggaggggcacaatggcatccatcccccgaaggcctgtgtgtgctccctgggtcaggtggcctcttgccctgggaccttgtctcactggctgtgcaccagcagagaagcaggcttgtccccgaattccacggagaggggcatcccgggtgtgggccagactgcagattcagagaaaaggcccctggacttcagccaccaccctggcttccctctcctcttctcccgcatgctgggctgcagggccttggcaagcagctgcagccttgggcgaggcgcttggcacattccccgcagctacattgtcagccttggctggcacccctgccagctcccagcacgagtctggattgccagggtgcttgcttcaggaatgggagatcgggcttgcagggagctcagctgtgcaggccgacctgggtggcgggggcagaagagagatcactggttctttgaaggccttcgtccgggctagcttcaggaagtagagagattactggttctttgaagggctagcttcaggaagtagcacgttggccaagagggtttgttggccagggcaggagggcccggtgtgcattcacggcctgtctgcataggcctcggctggaaagctgtgtggggtgagaggaccctcgggtagcatgtggcccatggcagtcccactggctgatgtccccgtggacactggcctaggctcagatcagggcagaagcagctgactggctggagggcacatagcagagtattctgtcctttctgggattgccgcgaggaggcttattgaaacgcacatgcacacgatctcttgtttgagaacaaagtaaagctctcttgataagtctaagcatcatttacaagaatgtggttcttctggcagctctgccagtgtggtccaaattcccacactggttgccaccatcaggctgtatgggcttgggcaggtcactttgcctccctgggcttcagtgttctgtgtacagtgggcacgtgaatacacatgcagtgggatgtggggagaatcaaatgcagagacgtgaaagcacttggcaaacagtggcaggctaggcagctgtcatcagacggctgtggggaggcaaggctggggtgcgtgcccctggactgagcccagaaattcacaaccccttggctaccttgctgggagcacttcccaacacctcccatctcccccgcctgtctgactgctgctgccacctcttccctgcggctgtccctttccccacctgctggtgtcctgacatagtggtggccagtgcaggaagggggacagaaggacaggggaggcctacccactgctgagggagcaaggtccaggctcagcagtggggacatccactggggcgagtcctgtagggcccagctcaggagcgcatcctcctggtttcagtgggaaaatgccatgcaaatttctcaccaaaaggaagtgtgggaaagttgaggggaaagagggcgtaaataggcccagactgttgaaccgagtttttcagaaccaagagacagggtttcactgtgctgcccaggctggggtgcagtggcgccatcactgcagcttcaaactccagggctcccgcgatcctcccacctcagcctcccgagtagctgggactacaggtgtgtgccaccacacctggctaatttttttttttaattatttttggtagagacagcatctcgccgtgttggccaggctggtctccaactcctgggctcaggcaatcctcccacctcagcctctcaaagtgctgggattgcaggtgtgagctactgcactcagcccaagagcactgccttttgctgtcctgcgctgctctttgcttagtttagggggggaaattagagctgatggatgatctctccgagccaggaggagggggctggcagggagcccaaagaaatgggctcagcagaggacagaaacaaggtgactagagagggagtggagaggggacgggagccgcactgtgacatcagccagtcccttatacccccttacaccttgagtttgagacctggccccacccaatcgtaacctctggctctcggccttctgatggccaccatggcacagcgtgtgtgagtggcactgggagaccctgaccatcgcccccacgggagctgcccctgtgcatggccaggaagcctctctgtgtctgtcaccccccgcaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcaggtgagacccagggctccaagaggatccaggccaggggcctgtcccccataccgctgggtgctgagctcacgagggcccaactcagccagcccgccgcccacttctgctgccggggccaccgaggccctgctgccagccttgatgctttcagaggttgagctcgccttgcccctccttgttgccttttgccctgcgcgcacctcacgccctttgttaccactcagacaagcccaggactgcaagtcaggaacactacatgtcacttctccaggcacagataccctcacccacctgtccctgtcctcaacccaactgcgacttagaggtgggagaatgtgcggagtacctggagtgagccccttcatcactccagccttggtttcctcgccctgaaacagctcttgcaccctaaggtgttttagaggagtgggaagcctgttctacctgttattttagtgataagattaaatgtttaggtttctgcattcctgttgtttttgtttgtttgttttattttctttttggcttttgaaacaggagtctgactgtcgcccaggctggagtgcagtggcgcgaccttggctcactgcagcctcaacttcccaggctcaagtggtcctcccacttcagtctccccagtcgctgggactacaggcacaagccgccgtacctggctaattttaatatttttggtagagacagggtttcgccatgttgcccagactggtctcgaactcctggtcaggtgatcctcccgcctcagcctcccaaagtgctgggattacaggtgtgagctgccgcgcccggcctgcattcctgttttgttcctctgccggattgcaacttctgcatttgatttttagtccattagtggtcaccctttaaaaggtcaacacgcagccgggcgcgggggctcccgcctggcatcccagcactttgggagggtgaggcgggcagatcacgaggtcaggaggtcgagaccatcctggctaacagggtgaaaccccatctctactaaaaatacaaaaatttagccgggcgcggtggcgggcgcctatagtcccagctactcgggacgctgaggcagaagaatggcgtgaacccgggaggcggagctggcagtgagcccagatagcgccactgcactccagcctgggcgaaagaacgagacttcgtctcaaataaaaataaaaataaaaaataaaagatcaacacgcatacttgttaggttaatcaatagctccgccttctcctggaccttagaacgcagaagcagccccgtggggcatggcatcatagcccagccaagagttggatttgtacctagtttttcctctttgctatcgccttatccacacgtgttgaaactcactcgcatgtttgctgagttctgtgctcaccatttcgttcctacatctcaatttctcttctatgttctgttatcttcctccagatagacatgtttttagttttttgtttgtttgttttttaactcacaactatgctcaggacaaacagtcatcagtgcttctagttgtggttggtttttaaaaaaggttctttcagcaagggttttgtcatgggaaattcttgattattttattgtaattctttgtgttgtttagttttttgtttgtttgtttgttttttgtagaggcaggttctcgctgtgttgcccaggctagtgtggaactcctgggctcaagcggtcctcccgcattagcctctcaaagtgctgggattacagacgtgagccaccacacccaggctgttgtcattcttgattatttttgttgaaaatgtttctatttcacccttattcccaagctaaagttgagttgcgcaatggagtctaggtggactgttcttttctctcagccctttcacaatgtctcattgtctccctgcttcttctgtagctgctgacaaatctgtagctgctaacaaattgtcctccctgagtaccctgtgtttctttttttctgggtactttgatcactttctttctttttggcattctgcagtttcactatgacatgtttaggtgtcagtttttgttgattctgcttgagacttgttatatgtcctttgaatatttgagtttttcaatcattctggaagattctcagctattagcttttcagatattgcctgactctcattcttttttcctgttcttctagaactggcagccagtgctggacttctgactctcttcgttgtgtctttcggtttctgtttactgtttcccatctcacactgtctgtgctgaattctggggatgccctgaggccttcctgtttgctcattttccagttcaccagttttctctttggccatgtctaattggaattttgttcacatttcagtggctgttttgtaagttctatttcattctatttcaaataggaatttgaaaatggacatttcctttttcaagtagaaatgtcaggctgtttctgtgtcttatttgctcatctttttgactgctccttttatactgtgtatcaggttagtcatacttaccccaccgtctctatctgatggtttggttagcttcagttcttgggagtatcattcgcctgtcttctgtctgctggtcttcactcatggtggatcatttccttgtgggttttgcaacagaacttctatggggattggtgtggcctcaatggagggtgtaagtccaaatgtccttctgttttggccaagcactccagggtaagcagttggaggccattagttagtgcggaggggatggttcctgaattgagaggtggtttcatttgaattcatttgaactccaggcacattgttacaaattttcagaggaggctttttgttcattgggcatagagcccaggctaagcaaggaaagcttcctggtctttgccctgcctgcctctggggctatcaaaggatcacctggctgtctgcttctctttgctcccagaagtttcccttgctttccgtcaagcttggctctgctcgaaatagtgtcgtagtttacccagtttggtgggaagagggttttcgatttataaacagaagtctgattctctccctgttcctgtttccacctcggggcttccatgccctcaactgtctgtgtcatcctctgggtgactcaccaagaggaaggatctaattcggggactgcacatcaagggcagccttgatgctggcgtaggtgcccagcccagtcagcgcacctagccccgggcaccgagacagcccgcgagacagcacctgcagccgcttcgctccatggctgccattggtcacatcgggctgctccctgccctgaaggcttaggacttttctgagcctctgctgtgccaggctttgtgggctcctggccctgctctggtggtcctcagagccagcagcctttgaaggctgtgaagcattccctttcccctggcttgataggctctgtcctgtggccgtctgtttttttttggagggggagcttttgagatggagtctcactctgtctcccaggctggagtgcagtggcacgatcttggctcactgcaacctccatctcccgggttcaagtgattctcctgcctcagcctcccaagtagctgggactacaggtacacgccaccatgcctggctaatttttgtgtttttagtagagatggggtttcgccatgttggtcaggctggtcttgaactcctgacctcaagtgatccacctgcctcggcctcccaaagtgctgggattataggtgtgagccactgtgcctggtcctgtggccttcttatttccccaaatgccaggcctgctctgtcttggggcctgtgccaggagcactctttcctctgctgccccatggcgcagcccccctaggcaaggcccggcctgcccaccgccacctttcctgtctccttccctgccccactgctctcccaagcactcgacaccccgtcagtggcgcttttctctctccctgccatggactgcaagctccatggggtcagggatttttgtctgttttgtccctgctgtgtcccctgcatcgggtggctagtgagggctccaggtgcttcaaggaggtggagcgcactgggtgggaaggcaggctcttaccggttggaagatttagataagctttgctgggctggtgtgcaaggcaggtgggctcaggagatgggcaggcctgtggctcccactccagccctgaggccttgctctgtccagctctggggccctggccttattcacccaaggctccaagagaacctgcagaaggcagctggttctacgccaggatgccctgggcacaaagacttgcagacccttccctttgtccacagcgactgtccagctctcagaacacctggggaggagggctgtgtccttgagagcaccgtgggaaggaaggtccaaggccttcgacctttaggattcacatccccgccccgccagcccaatctagttccctggtttcccgggccaggcccctttccaccctgcatggccctgagcggatactgcgttccgtgtcttcccccagcccccagccaatgatccctgaggcttccccctcaggatcacacccacccctggatacagtcctcgggtccttcacaggacattcccaccacttcagccacaccccagcaccctcagaggcggccttcgcccttgctccccacctctgctcctgtggggaatctaaggatcaagaaactgagagtcaaggccattgatgagggtcaggggtgctgccacggggcctagagtgtgacagaaaagcaaattaagacaggagcagctcctgggagaagcagacaccaaacaatacggctgctggcccagaggtcaaaaaccatggcctagagggggcggtcaggaagtgggacattaggccgggcgtggtggcccatgcctgcaatcccagcatctttggaggccaaggcaagtggatcacctgagttcaggagtttgagaccagcctggccaacatggtgagacttcgtctctactaaaaatacaaaaaaaattcgctgggcttggtggcgggtgcctgtaatcccagctactcgggaggctgaggcacaagaatcccttgaacctggggaggcagaggttgcagtgagccaagatcacaccactgcactccagcctgggcaacagagcaagactccatctcaaaaaaaagaaaagaaaaaaaaaagaaagttggcgtttcaaagccaaacagctctgggcgttggatgacaaagttcagatgtgccccaggaggggcgacatcagtggtgcaggacagagggccggtggaaggagctggctgtacgtagaaacaaaaccagatgcctactggtgcatttaaaaatcaacgttattgagacgtaattaacatactatacaattcttccttttccatgtacagtttaaattcattcacagagttgtgcagccatcatcactaactccagaatgttttatttttattttatcccccaaagaaaccccagacccatgaacagtcactcctcattccctctctccagcccctggcacccactcatctgcttcctgtctctgtggatttgcctatctggacatgtcctagaaatggaatcatgtgctctgtggcattttgtgactagcttccttcactgagcatcatggtttcaagattcgtccatgtcataagatgaatcagtccttcattccttttcatggctgaataatattccattgtgtgcatagaccacaatttctttatccattcatcccttgatggacattttgggtttcttcatgttttggctattgtgaataacactgctgtgaacatccatggacaagtctctatgtgtgcagatattttcgtttctcctgggtgtgtagctaggagtagaattgccaggtcacatggtaactggacgtttcactttttgaggagctgcgagactgttctccacagtggctgccccattttaccttcccgccagcagtgttggagggttccaccttttcatcgtggctagcactggttatcatctcctttgtattctagccacctagtgggtgtgaggcagtatctcttggtggttttgatttgcatttccctgatgactaatgacgctgagcctcttttgatgtgttgagtggccatttgtatgtcttctttggagaaatgtctgttcacgtccttcgcccatgtgtgatcgggttatctctgtcgctgagttgtaaaagctctttgtatattctggatactgcaccctcatcagatgtgtggttcaccagtccagagttttctcccagtctgtaggttgtctttttcactgtctcgatattgtcctttggtgcacaaaagtgttgagttgaatgaggttcagttgatctgtttttctcttgttgctcatgcttttggtgtcctagtgaaggaactattgccatatccaaggtcgtgaagttttatcccattttcttctgagagtttcatactttgggccacactacacatcagcctgtgatgtgctctgggttggtttgtctgtatggtgtgaggggtccctctcctgcacatagagagaaagagagagagagctggttgccccggcaccatttgcagaagagcctcgcctttctctccagcggctcatttttgactttccgctgtctctgccctgcccctccccgccccgccacccacccctctggggctttgcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtacccctggcccagccccacccttgccatccttgccatgcttctctccctgcaactggcaggggctgagccagggtcaccctccctcaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggtaaggctgtcccctccctatgagtgaccccgcccctgctgctgctgcaggtgctgacctgctgccccagctcctcctattcccgctccctcactcagggacctccatgtgcttctggcccatcccagtccacccaggacgggagggctgccgggcagggtctttgaggacttcggcctggtcgagctgggcccctggagggtttcctgcagagaggtgctggtccgcccgccttccttcccagacagtagctgccggccaccgtactgactcgccctttgagggcctcagcctggattattcattcaaaacaagggggatgtggtcccctcacccatgcaggacagcaagagaaagttccagtcagtgtgccagctgctggctgccacgggaggcaggtgctgcagaagggagtggcggcccagggcactgtattagacactgggggaagagttcagcttgttggaagacctggctgtgttccctagggaccctggaccacaggctgctggtcaggaaccagctggcatgctgccagggatgggaatgagggcgtgcagccaggggcacgcagactccccagaatgcagaggggtcgccaccactccctctccaccccagccccgctgtgctgtctctgcaggccaggtggtggatgtggaacaggggatcatctgcgagaacatccccatcgtcacgccctcaggagaggtggtggtggccagcctcaacatcagggtaggtccagcggggagggcgccagccacgcacatatgcaagcctcagcccttggcttcccgcctgtctgtgctggcaacagccattgtccctagatgtacgtggcaggtgggccaaggtcaaggtgagagaccaacgtgtctctgactgttcatcctggggcaacagaggcagggctcataaaagagactagtgataccaggattgaccaaggttcaccccggcgttcctggccctatcatctgatgccaactccccacactcctaagaaagccaagacccgggtgggggggctctggttcaaaccttgccgctcgacctccctcggaaggccacagcaaggaatccacagatcacctgtgtccccagccaggggtttggacagggctggggagtaatggagtgagggggagactggggtggagggacaggtagagaagtgacaaggaatcactcattcattcactcatttaaccaatgtgccctgaactctgagccgggcaccagaaacccgaggtaaatcaggagacctgcactcagggagtcttcactgtggaggggcactaaagtgttacaaagggtctccaggtagacagctgttcaagggacagtgggggtcacaagaagagtggtcagagtccctgggggtggtgggggtgggatgaagccttgcccaggagttgctgtgagcgagtgggcaggcagctgagggtagaggagtgaggggccgtgggcctgaggggcaggtcacgcaggaggaagcagagaggaggggcatgccagggaggagggggccggcacaggtggttacccctcaccgctcgcagcggcccctcctaggatgtcgggggagctgatcaccagtgagtccaaggaaggtggtttccaggctggccccgggcagcacaagcaggcaggggcagcgggcaagctcatggggcccctgcgcgcagggccacatatgctcagggagccgggtatgcgagatggggcaaggcccaggccccacccttcaggaggggacagtcaggtggcttcattagcatcctgtggctgcggtcacaaagcgttacaaactttgagtggctttcccagcagagatggcctctctcccggctcggggaatagcagtccgagaggaaggcgcaggcagggcgggcttctgccaaggaccgagaaggtgcctccgctcggggcctctgtcccagcttctgctctgctgcccatctgcgggcttccctggcttctgccacggcaggtcggcctcagcctctgtctccacacggcgctctccctctgggtgtgtccgtgtctccgtctcccctttctgtcaggacacaggtcacactgcattagggcccacccctctgcagaatgacctcatgcagacctaactcatcacgtccgcaatgaccctgtttccaaataagctcacactccgaggtagtggggattagggttcccacataggaatttcagaggacagagttccacccatgacactgcctgaggtaagctaaagaccacggcctcaagtcttcccaggagccccgtgtagcattgttgttgttaccgtgaacttcactgactccaggcccctggcctcctccctgcacacagcccgcctccagcctggccggcattttcccaaagtaggcatttcctagctccagcgaggaccatggagtcagtgaattgaggagcctgaggtccatgatgcagagcccaggggccactgtggcatctctgggccactctggcacctggggaggcagtggggtctgtactgtcagtctagagacataaagaaagtgctttttgggccgggcgtggtcgctcatgcctgtcatcccagcactttgggaggccgaggtgggcagatcgcttaagcccaggagttcaagaccagcctgggcaacatggcaaaccccgtctctacagaaatttttaaaaatacacaaataagccaagtgtggtggcggtgcctgtagttctagccacttgaaaaaaaaggctaaagtgagagggtctcttgagcccaggaggttgagcctgcagtgagccatgatcccaccactgcactccagcctgggcaacagagcaaggccccgtctcaaaaagaaaagaaagaaactgccttttgtccccagtgactcaggaggccaaggtgagagagtcgcttgaggccaagagtttgagaccagcctgagtaacatagcaagaccctgtctctaaaacaacatttaaaaattagccaggcatggtggcgtgcatctgtaggcccagctactcaggaggctgaggtgggaggatcacttgagcccaggagttggagactgcggtgagctgtgatcataccgctgcactccagcctgggcaacagagtgaggtctcgtctcttgaaaacaaagtgcctttcagggcagttccttaaagggggctgacagttgaccctgcacttggattcctggtgaagtgggagtcggatgggactgaggacggcgctggctgtgttggaacacacctactcattcagctgtggcagaataggcccttcctcttgtgctggcaccatgttctccaggcgtgtcagggcctgaggactgggccggggcttgtccattcctgtgtcctgggccaggcatttagcgagagccaaatttagctagggctgtggacgctggaccccatcccccaggccctgctgtcccttatcaagagatcaagaatggcctgcgtgctggcctcgggcattgggagcctctcaaggctggtcaggaggccatagggtacgggaaggggcctgcgctctctggcgtcagcggctgttgcccctgcaggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggtaaggaagcccgtgcgcctctcctccacctcttcctgcctgtgcgctcacacatggcttcctgcagaggcccaggaagtggtgaagagtcagcacctcaggagaggacactgaggcactgtccccagagccagagacgggctgtggttcctgctccctccaaacccgcccgatccactgccctgttttggatctgtgtggggtgtgtgcacgggcggcgatgtgagcgtgtggatgcgtgtgagcgtggcatgtggacactgcctgggaggcgcagagtatcttgggggaggcagagccggcccttccctccgtggacacccagctttcccacaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggtaggaggcctggggctggcagccaccctttgtcccaccctggcctctcccttggcctccagggagtgaagattacctcaacatccagagtctaaagtgccaggtgccacggggcggggcagaggctgctaccagggaggaccaacaccacacagatggccccaggtgctctagggaagggggcacctagcagggatgtgcacctcactgggggacccaggataccctctcccagagaaaagaggtctgagctgagccctgcagaatgctgagtggttaccccgtccggaagccaggggcagcagggcggagtgcgttccgaaggcttggtggtgcgagaggctggctcacagagggccctcgggaccaggcgggagcctaggctttccctgagcaggatcagacgctcttggaaggaccatggggtggtgggcaggggcagcctgggaggggcaggcacatgtgtgcagtgatggctactgtcaagaggtttgtgcagacgcttggagggggctggggccagcagagtcaggtggattcagagatgagttcactgaaaaggaggccagactgagctgttgtcttgtcctgggcttatcaaggaatactgcttgtccacagtgtctgtcgggccggaagagcggaggaggagagggggctgcagctacagggacacagtagatggagtgttcagttctgtctttgaattctgagcctctgggttctgcttccagcctgcactgctgggtgcgagatggccctgggcaaggacctcgccttgctggggctccccttcacggttcaagggcacgggcaccaagccctccctcggtggcaacatgagaagaagtggctcctgcaggaaatggccggggtgttgtcacctgcctgtggaggaagcggggacacaggtggcaatggcagtggagcagcccctggcccggccctgcctcttgctcctgctgccctcagcctgggagcacgtggcccctcccgcctctgtggcagcctgaatgcccagggcctgtggccggccagcatgagccattaggatggagttgagctgcgaggaacagaacgggcctccccgcaatagtggctaagatcatctgtgagtttatcctactgagctgttaggtcccaagagagccaggccacggttgccagggctggccctgctctgtgaaggccccagggctcgaggattttctaccaggtcactctgctgtgtttggcctccgttcccaaagtcacctcatgatccaggagggctgctgcagccctcacatcatgtcccaggctgtaggatggaggaagtagaagggaaggggcaaaaggtatgtgccttcttttaaggaaggttccagaagccgccatattgaatacttacagttatatctcattggccacaacttagtctcatgctcacacctcatcacaaggccacctgggaagcgtaatctctactctgggtggccatatgccctgttgccacttctagccctgggccgctggggaaggcagcatgggcgagaagacaggaagggccgcttctgccgcagcgccccgacctaatggagcagccggctcacctgctcgttcaagcagcccactcgagccttgccaaagtgctgacacggggcagtgacaggaggcccaacccctgtgggtgacaagcccccggtctggggagagcactcaggccgctctggagctctgtgccaaggaactgtatgggtgccctggggctgccataaaccgcagggatggattgtctcctagatccagcagtccgagatccaggtgccagcagggtgggctccttccgggtgccatgacagaaggatgtgttccaggcctctgtcctcggctcgcagatggtccacttctccctgtatatcttcacctcatgttcccctgtgcatgtcttctgcccacacaccccctttttatgaggacacagtcatattgaattagggtccactctgatgacctcatcttagtgtgatcacctctgcgaaggccctgtctccaaataaggtcacactgaagtgttggggcttggactccaccgtatctcttctgggggaaggcacgattccagtccccactcctccatgattaatgcctgtcagacagacaaggacgcagaggcacaggggccctgtcgtcacagctagctcattcccgcagctcccccagctccccggctggcccccgggtctgggtgctggtggaactgagccaagaccattgcccccgcctaggttgggaggctatgtgtgactggaaggacgtcctgtcgggtggcgagaagcagagaatcggcatggcccgcatgttctaccacaggtgagcactccgggccggcaggctccctggggtcccctggaaggggaagtagcagctgtggggaggcctgggctcagtggagcctgagccgggctggggtgttgggccctggagggtgcacagactctcctctcggcccggacccccaggcccaagtacgccctcctggatgaatgcaccagcgccgtgagcatcgacgtggaaggcaagatcttccaggcggccaaggacgcgggcattgccctgctctccatcacccaccggccctccctgtggtaggtgccctgtctccctgcctggggtcggtgggagtggctgcctgaggggaggaggtggcctggcgggcccggcagcagcaggcggctgtcatcagcagcccccgtgccgtgcccctgaccctgtccctctcctggccaggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaatgcagtccttcctccctgcctcagagcctggtggtgtctgctgtgggtctcgaggagagatggaggagagggagtgggttgcctgtgggggaaagagtgagtttgggaaaggagtgggcctgacccccaagcccctccgagggggaaagtcaccagaagacatggtccagcatgccctccgccgagcctcacgccaatgctcttaggattcctgtgacggtggcggggcggaacctgcaacaacattgcacagaaatactggctgagcccaaataggactaggggaggggatcatgctggtccctgtgggaggagcacgaaggcaagagaagggatgtctaagctgccacacagggtgctgctggcccttctagggagaggcggccacttgtgcaggggcctggggggaactgggagcacagcgcagggtgttcgtgctgcatgcaggggaagggagggcaggggaagggagggctgcggccggcgggccttggaggccacactacagagacaggacttagcccagaggccaccgaggagctttcagcaacagggaagcagtgtcgagtactgcaggccacgtggctgcatgtgagggtggctggtgggaatagggtgcggcagcccatctggcctcagaggcacgagaactgagaacagctgtgcggccatacctttatgcatggatggccacagcctcccaaaggtggggcagcctgagtgttcatcaacagacaaatggacaaacagcctgtccataaggcacagtgccattctgccataacacgacagatagacctcaaagagttcgtgctgggtgaaagaagccagacacaaatgtccagaataggctcatcgggacagaaagcagacaagtgggtgtcaggggctggggcaggggaaggaaaatgtggcggggggagtcctttttaaaaaattttgtatttattttttattttttaatgagacagacagggtctcaccctgtcacccaggctggagtgcagtggcgcagtcataactcactgcagccttgatctcccgggctcaagcaatcccgccccagcctcctgagtagctggaaccacaggcgtgtgccaccataccctgctaattttgtgattttttttttttggagacaggatctcactatgttgcccaggctggtctcaaactgctgaactcaagcgatcgtcctgcctcagcctcccacagtgctggattacaggcatgagccaccacacccagcctcgggtttctttttatttcgaagaaaatgttctcgaactatagagcatactaaatgccactgaattatgcactttaaagggattgattgtatattttgtgaatatcgcctcaaaaacagatgattgatggataaattgatacatagatatatagatatatagacatgattgatatagatgattgattgatagatgatggatgattcataggtgataagtgatagataaaatacatgatagatacatggatagacagatgaatagagagagatgatagatggttttaaaagtttttttagagacaagatctcactatcttgcccagtctggactcgatctgctagcatcaagcagccctcctacctcagcctcctgagttactgggactacaggcacatgctactgtgcctggtgatagataaatgattgaaagatagacatgatagaggcataaatgatagatagatggatagacatgataaaaggaagatacatgggatagatcaatgattgattatataagtaaatgatataaattgatagattattgattatagattaataggcggatagttgattgatagatgattgatcgattgattgattgattgatggagagagacagagaagcaagcacagccattgcagccacccagacaagacatgctgaggcctgaagttccagaaggttcgagcagttggaagaactcaacaggcatgggggcagcttcttcagggagtggagggggcagcaaggtaccactgggttctggcttggaaggttaggtgagcgacagcacccttggtggacagaggcagctccaaaggaggggcaggcctggggagcaggtgcagcccgaggggatggtgtgtaggcagttggttcagagcttggggctcctcagtgggacgtgggtcagcagggaggccagtggtcattgaagtttggatggagacagcctggctgaggggaggggcatgcttggcatctcatttaggggacaagaggtagactgtttacctgcattttgagattaggatttattcctgatcccaggaggtggccgattcggagggctgagagttgttcctccatttcttttgacgattgtgtaagtcgcccatgcttgatcataaaccccgtttgtttatttctgacacatagctggaatggctctaattactacagatagaaggagacacatctggcaaagaccatccaaaaggaagctagtggagagaagctcatattgcacaaataggctccagggcaaaatcattattaggattaaaagtggttgcagcatactgataagtattcattccaaagcattcactggcgggggaggggtgggggaaaaagaataaatacataaataagttaattattttaaaagaagtattagcggccaggcgcggtggctcacgcctgtaatcccagcattttgggaggccaaggcgggcagatcacctgaggtcaggagttcgagaccagcctgaacaacatggtgaaaccccatctctactgcagtacaaaattagccaggcatggtggctcatgcctgtagtcccagctacttgggaggctgagacagaactgcttgaacccgggacgcgaaggttgcagtgtgccaagatcacgccattgcactccagcctgggcgacaggaaaacaaaaaacaaaaaaaagaagcattagccattctgatcttgtgtgcacctgcataatgatagagccccaaatgactacaaaacaaaaaagtgtcaagaaaaggaaaaatgaataaatgagcacattctccacgcaggaaattataccacttctcactggaactgctggtttaagcagactcaatgagtaagaatatagaaaaattgggccaggcatagtgtctcatgcttgtaatcccaacactttgggaggcgaaggcaggcggattacttgaggtcgggagtttgagaccagcttggccaacgtgctgaaactaaaataaaaaatacaaaaatgagccagatgtggtggctcatgcctgtaatcccagctactcgggtggctaaggcaggagaatcacttgaacttgaggtttcagtgagctgagattgtgcccctgcactccagcctgggcaacagagtgagactctgtcaaaaaataaaaataaaataaaaaaatatggaaaagttgaacaaacttgatttagtggacacccaaaaactacagaccacacattgttttcaagttcaccttggacatttactaacaccatgtcctaggctgcaaagcaagactcaacaaatagcaaaagaacttgcatcacaccagccatgttcttgatgcaacagaataaaggcataaattggcaaccaaactaaaattaagggctcccctatgtttggaaatttaaagatacactactggccaggcacggtggctcacacctataatcccagaacttcgggaggccaaggcaggaggatccctggagcccaggagttcaagaccagcctgagcaacatagtgagaccccccatctctataaaactaaattaaattattttttaaattaaaaaaataaaaaataatgcactggtccgagaagaattagaatgaaaatctaaaagcatttagaaccgaacaatgaaaactatgtacaaaagcttaagccatgtagcccaagcagtactatgaggaaattaaaaaagaaaaaaaaagtgtggccaggcgcggtggctcacgcctgtaatcccagcacctcgggaggccaaggtgagcggatcacctgaggtcaggagttagagaccatcctggccaacatgacgaaaccccatctctactaaaaatacaaaaattagctgggcgtggtggcgggcacctgtaatcccagccacctgggaggctgaggcaggagaattgcttgaaactggaaggcgggggtcgcattgagccaagattgtaccgctgcactccagcctgggcgagaagagcaaaactccatctcaaaaaaaaaaagtgtaaaaaataaaaataatattatgaagtacagagggatctccctgcaggcaccactgagagctgaaacatcggggcacctgggggcgaaagacatgagtgggaacaacttcagctaaaaggaatgcaaagggattgcagatgtaaaagggagagttcacagcagagagtgagaggagcgcctgccaggaacatcacagaagctggaaaacaagtgggggagtgataactgattcaagggatcagcgtgaacttggaaaaaagtggtgggaggcaccaagggcacgtgcccacagaggaaaggccacatgaggccaccacccagatgagaggccttggaagaaaccaaccctgctggcaccgtgatcctgggcttccagcctgcagggctgtcagaccattacggtgttggaccgacactgtaaagaaagaagcagtgatagcacacatggttgtctcgctccagttctaaaagcgggaaggatgctgggcgcggtggtctccagaaggcccctccatgtttctctgtggcacccgcagcacctggatgtcagcactgggagaaaccgcctccacattcatctgtaaaatccgagcatcagtgagctcaactctcccgctttctcagctctctgtttccattaggtttggttgatctgggccagggccagcatcagaggcaaacccaaagctgttctctgtgggctgacctcttctgccttctcttacgtgtctgccatgtccactagcctgtgagcttcaggagacaaaggagcatgtttcttcttcctgatacccccgaaacttgcacagtacatgctatcaaatgcagattcaatgagggctctttgcattacaattttgaaaaagaatcatgcactatgatttagcgtctcttcccatcaaaacccaggcccatagagcaattgcctttgcctgtgatgcacacctcctacctgttctccccccaacccggcatctctgtcttgcagaccaaacacaaaactcattgccatccctcttcaacctggcttcctttctgacttcccttcaggttccccaggcagaaccatggggatcatctgaccctctgtctccctcatccttccctaacccaccagcccgtgtcctactgactcagtccccaaagtccctctcgctccccactggatcctcagtgtctggtagtacagtgcctgacgtgggaggtacacagcgaccactaggtgaatacaagaatgatgtgattgagggtgttttcggtctcatatgctgcccatgctcggtgatgcagtaaatcatcatctgtttggaacggtctaagtctccagccagaaaggagggagaaggcaccatgtgaccctgcatctcccttgccagtgctctgatttgacgttctagaagagtagtctttatgccggggcacatgctcccctgaggattatgaagcctgtccaggaggggctcagcatggatggtcccaaggagccaatgtcccgcctcagcttgcacaggggctctaacctaacctgcctttcccagaaacctgaccccagttgacaagagcaggatgttgcaccatgatacgtcgtggggtcaaaggctaccaggcaccaggaaaagaagccatttgaaataccgcctcctttcaccaacctgacatctccacctctgcatttcaggaaaagaaatacatccaaaagaattttcccttcacatttaataattacaaaaattgtgttattttcctcaattacatgctaggaaaacttgtaggaattttgccatctcgaataaatgttttaacacttaggggaaaaaaagtagtgggaggcagccagtggcaaagttgggtttgcacaagaatcggaggcaccagataactcagaaacaatgtgtgtgtatgtgttggggagtgcagaacaagatgatttattggaagtctctataagaagctgctgtccttgcactggctatgcagattaaaaaaaaagaagaagaaaacaaagaagatgctagatgcccatatctctgccccactttgtacagaagaccagagatagaacagaaggtctgtggagatgcaaatttaagccacagtaaaatacccttttttttttttgagacggagtctcactctatcacccaggctagagtgcaatggcacaatctcagctcactgcaacctctgccccccaggttcaagcaattctcctgcttcagcttcccaagtagctggaattacaggtgcacgccaccacacctggctaatttttgtatttttagtagagacagggttttatcacgttggtcaggctggtctcaaactcctgacctcaggtgacccacccacgttggcctcccaaagtgctgagattacaggcatgagcccccgcacccggcccacagtgaagtatctttttgcatccactgattggcagaaatgtaaagtctgacaataccaagtgttagcagtactacagagcagcaggaactcacacttccccggggcaggcaaactgggacaaccactttggaaaacagtgagcattattcagtatagttgaagatgtgcacatttagaagctaacaatttcactcctagacaccagattgcatgtacaaaatcgctcacagcatcattgtttataatgcttaaaataatgtttaaatgttttttaataggcaaaagccagaagcaacccaagtgtccattagcagaagaacagataaaagatctatgttagagtcatacaatgaaacagtatacagcaatagaaatgtcccagagtcagaccatagaagtctaaaaaaataaataaatgaataaactacggttatgtgcatcaacttggatgtctgtcacaaatgtcatgtggagtgaaaacagcaggttatagaaaaatatatccagtatgattccacttatagggaagttaaaaaaaaataatgctgcaggatttgaacaacactctagaccaggggtccccaaccccaggccactgaccagtactagtctgtggcctgttaggaaccgggctgcagagcaggaggtgactggtgggcaagtgagcattcccgcctgagctccatctcctggcagatcagcagcggcatcagattctcataggagcacgaaccctatcatgaactgcgaatgtgtgggatcgaggttgtgcctgatgatctgaggtggaacagtttcatcctgaaaccataccccccaaccctccatccatggaaaaattatcttccacgaaactggtccttggtgccaaaaagattggggaccactgctctagagcaaatggacctagcagacatacacagaacattccatccaccagcagcagaattcgctttcttctcagctgcacatggggtagtctccaggatagaccatatgtcaggccacaaaacaagtcttaacaaattcaagaagatcaaatcacattaagcatctttcccaaccgcaaacaagagatcactaagagaaagcaaactggaaaactcacagatttgtggaaatacacaacaccctcctgaacaaccaatgggtcaaagaagaaatcaaaagggaaacaaaaaaaaaaatctcttgagacaaatgaacatggaaacacaacatacaaaatgcagtgtgcagcaaagcaattccgagagggaagtttagagccttaaatgcctccattaagaaataagaaagaggctgggcatggtggctcacgtctataatcccagcacattgggaggccaaggttggtgggtcacttgaggccagaagttcaagaccagcctgagcaacatggcgaaaacccgtctctactaaaaatacaaaaattagtgggcgtggtggcacatgcctgtagtcccagctacttgggaggctgaggcacgagagtcactggaaaaaaaaaaaaaagaaaaaagaagtaagaaagatctcaaataaacaacctaactttacacaccaaggaactagaaaaggaagaacaaaataagcccaaagtcagcagaaagaaggaaagaacaaagatcaaagcagaaatacatgaaatagagactagaaaaataacagaaaagatgaatgaaactaagagttgggatttttttaagataaaatcaacaaacctctagctagaccaactaagaagagataagactcaaataaatcaatcagaaatgagacattacaactgataccacagaaatgcaaaggattgtaagaaactactatgaataggccgggcacggtggctcaagcctgtaatcccagcactttgggaggccgaggcgggtggatcatgaagtcaggagatcaagaccagcctggctaacacggtgaaaccccgtccccgctaaaaatacaaaaaattagccgggcgtggtggcgggcgcctgtagtcccagctactcgggaggctgaggcaggagaatggcatgaacccgggaggcagagcttgcagtgagctgagatcgtgccactgcactccagcctgggcaacagagtgagactccgtctcaaaaaaaaaaaaaaaagaaaaaaaaaaaagaaactactatgaataattatactccaacaaattgggtatcctagaaaaaatggatacattcctaggcacatccaacctaccaagactgacttaagaagaaatagaaaatctgaacagaccaataatgagtaaggagattggacaagtaatagagtctctcatcaaagaaaagctcaggcctgatggcttcattggtaaattctaccaaacagttaaataactaatacctatccttctcaaactcttccaaaaaactaaagaggagggaacgcttccaaactcatttaataaggtcagaaaattccctgatatcaaagctggacaagaacactaaaagaaaaaaagctacaggccaatatccctgatgaacacaggtgcaaaaatcttcaacaaaatactagcaaaccgaattcaatagcacattaaaaggctcattcaccatgagcaagtagaatttatccctgggatacaagggtgattgaatatatgcaaaccaataaatgtgatgcaccacgttaacagaatggagaataaaatcatttctcaattgatgcagaaaaagcatttgacaaaatttaacattctttcatgatgtaaaaaaaaaaaaattagctcttggccaggtgcagtggctcatgcctgtaatcccagcactttgggatgccgaggcaggaggatctcttgagcccaggagttcagaccagcctgggcaacatagcaagacacctctacaaaaaaaaatttttttaaattaaccaatcatggtggtgtgtgcctgtagtcccagctactctggaggcttgagccctggagttcgaggctactgtgagccaggatcataccactgcactccagtctgggtgacagagcaagaccctgtctcaaacaaacaaacaaatacaaattagccaggtacattggtgcgtgcctgtagttccagcactttgggaggccaaggcaggaggatcacttgggcccaggagtttaagaccagcctgggcaacataggccctgtctctaccaaaaaaacaaaattaaaaagaaactctcaacaaattaggtatagaaggaatatacctcaacatcataaaggccatatatgacaagcccacagctaacatcatactgaatggtgaaaagctgaaagctcttcctttaagatcaggagcaagacaaggatgcccactctcaccacttctactcagcatagtcctggaaggcctagccacagcaatgagaaaagaaaaaaaaaaacatttaaaaacccaaattaggccaggctcggtggctcacacatataatcccagcactttcggaggccgaggtaggcagatcacctgaggtcaggagttcgagaccagcctggctaacatggtgaaaccccatctctactaaaaagacagtaattagccaggtgtggtggtgcatgcctgtaatcccagctacttgggaggctgaggcaggagaatcacttgaacttgagaggctgaggttgcagtgagccgagatcacactactgcactccagcctggacaacagagtgacacttcgtaaaaaaaaaaaaaaaaaaaagagagagagagagattaaattgtctctgtttgcagatcacacaatcctgtatgcagaaaaccctaaagactccaccgaaaaattgttagaattcagtcaaggtacaggatacaaaatcagcatacaaaacaatagcttttattttttattttatttttttttttttgagacagaatcttgctctatcaccccacctggagtacagtggctcaatcacagttcactgcagccttgacctcctgggcttctcccacctcagcttcctgagtagctgagactacaaatgtgcaccatcatgcctgactaattagtattaatattattgctattattgagacagggtcttgtttagttgcctgggctggtcttgaatttctgggctcaagtgatcctcctgccttggcctctcaaagtgctggaattacaggtgtgagccatcatgcctcacctagtagcatttctatatgctatatgctaacaatgcactttcttttttttttttttttttttgagacagagtctctgttgcccaggctggagtgcagtggcactatctcggctcactgcaagctccgcctcccgggttcacgccattctcctgtctcagcctctccgagtagctgggactacaggcgcccgccaccatgcccagctaattttttgtatttttagtagagacagggtttcaccgtggtctcgattcctgaccttgtgatccgcccacctcggcctcccaaagtgctgggattacaagcgtgagccactgcgcccagccaatgcactttctaaaaaagaaatcatcaaagaagatttattttgttatccaaaaaggaaatcaagccaacaatctcatttataatagctataaaaaataaaatacttaggaataagtttaaccaaggaggtgaaagacctatacaccgaaaactgtaaaccacagatgaaagaaactgaagaaaacacaaataaatggaaagataccctgtgttcatggattgggatagttaatattgttaaaatgtctatactacccaaagtgatctacacattcaatgtaatccctatcaatattcccatgagatttttcacagaaatagagaaagcaattctaaaatgtatgttaaaccacaaaagaccccaaatagccaaagcaatcttgaacaaaaagaacaaaactggaagactcatgctatctgatctcaaaatatgttacaaagctatagtaaccaaaacagcatggttctggcataaaaacagacacatacaccaacgtaacagaatagtgaacccagaaataaatctatgcatttacagttgattgatcttcgacaaaggtgccaataatacatgatagacaaaagacagtcttgtcaataaatggtgttgggaaaattggatattcacttgcagtagaatgaaattagacccttatctcacacaatgcacaaagatcaactcaaaacggactgaagattcaaatgtgagacctgaaattagaaaactactagaagaaacttacgtgaaaagctgcttggcactggtctgggcaataagtttttcaatatgacaccaaaagcacaggcaacaaaacaaaaacagacaaatgagtttgcatcaaactaaaaagcttctgcacagcagaggaagcaatcaacagagtgaaggagacagcctatggaatggaagaacatagttgtaaaccatccatctgatacaaggttaatacacagaacacacaaggaactcatacaactcaatagcaagcaaatgtattttctaacccagttaaaataacccagttacacctactatgtactcctaaaaattaaaaattgaaaattgaaaaaataaataacccaatttaaatgggcaaggacctgaacaggcatttctcaaaagaagacatacaaacggccaataggtctattaaaaaaaaatgctcaacatcagccgggtgcagtgctcacgcctgtaatcctagcactttgggaagccgaggtgagtggatcacctgaggtcaagagttcaggacctgcctggccaacatggtgaaaccctgtctctactaaaaatacaaaacttagccaggtgtggtggcatacgcctgtaatcccagctactccagaggctgaggcaggagaatcacttgaatccggggggcagaggttgcagtaagccaagatcgcgccacttcactccagcctgggcgaaagaacaaaactccatcttaaaaaaagaaaaaaatgctcgacatcaccaatcatcagggaaatgcaactcaaaaccacaatgagacaccacctcactcaaattagaatgatcgttttcaaaaagacaaaagaaaacaaactttggcgagggtgtggagaaaagggaacattttggaacagtatggaaaatggtatgcatggtggttcctcaaaatatttaaagtgagaatgaccatacaatccagcaatcccatttctgggtatgtatctaaaggaaatgaaatcggtatgtcgaggcaatatccacactcgcatgtccattgaagcactactcacaatcgccaagatatggaatcaaacgaaatgcccaccaacagatgaatggataaagaaaatgtggtacagatacacaatggatcactactcagcctttaaaaagaaggcaatcctgccatttgcaacatggaggaacctggaggacattacattaagtgaagtaagccgggcacagaaaggcaaatactgcatgacgctgctcacgtggaaagtaaaaatgtcagcctcatggaaacagagcagaacagtggccgccaggactggggtaggggaaatgggaaaatgctggtcaaagggtaccaagtttcagttatgcaggatggagacgttccagagatctgatgtacagcatggtgattctagttaacacatttaaaaaaataaaaccaaaaaatttgttgcaaaagtaaataatttattgtttaaggctaattcatatttgggacaagtataaagaaaaccaaggaaaggctaggactaactgcgaagggaaaaagaagggtccatgatggctgtcagtggggatgattcatctaagcagcatatgctcttccgtgtgtattagattgaacaagatgaaactgcaatttttgtaggttaacaataaatgaacattaagcaacgtcatctggttttgacccaagacatttattaataataaatcaatgataaaataaaaccaaaacactttatgctaataaacttgaaaacttaaacaaaatgggcatgttccagccaggcgcggtggctcacgcttgtaatcccagcactttgggagaccgacgcaggtggatcacctgaggtcaggagttcaagaccagcctggccaacacagtgaaactccgtctctgctaaaaatacaaaaatcagctgggcgtggtagcgggcacctgtaatcccagctactcgagaggctgaggcaggaggattgcttgaacccaggaggcaaaggttgcagtgagccaagatcatgccactgcactccagcccgggcgacagagctagattctgtctaaaaaaaaaaaaaaaaaagcatgttcctagaaaaatattgtttatcaaaaattgactcaaaatagaatgattcatcctaaattcagatagaatctcaaggggctccaaataaccaaaacaattctgaaaaaggagaacaaagttcgaggactcacacttcctgatttacaaaataaaacatattacagtgtggtcctggcataaagacagagacagaatataatccagagcccagaaagaaactctcaagtatatggtcagatgatttttgacaagggtatcaaggctacaaattgggaaaagggcagtcttttcaacaaatggtataggggaaacttgatatccacatgcaaaagaataaagttggaggctgggcatggtggctcacacctgtaatcccagtgctttgggaagccaaggtaggaggattgattgagtctgggaatgggagaccagcctgggcaaagtaacaagatcccatctctaccaaaaacattaaaaatttgaggctgaagcacaaaaattgcttgaacccgggaggcagaggttgcagtgagctgagatcacgccactgtactccagcctgggtgacaaagtgagatctgtctcaaaaaaaaaaattaaattaaaaattagctgggcatggtggtgaatgcctatagtcccagctacccaggaggctgaggcaggagaattgcttgagaccaggagtttgaggttacaatgattatgccactgcaccccagcctgggcaacagagcaagacctgtctcaaaaaaaaaaaaaaaaaagatggcaaattttgtgttatgtattttttcccacaataaaaaaattactcaagaagaaacagaaaacctaaatggtcccataattattacagaagttggattcattgtttaaaatctatagggggacaggcaggaagctacaaaaacaaggaaggccaggccagatgcggtggctcatgcctgtaatcccagcactttgtgaggccgaggcaggcagatcacctgaggtcaggagttcaagaccagactggccaacatggcgaaacaccgtctctactaaaaatacaaaacttagctggacgtggtggtgcatgcctgcagtcccagctactcgggaggctgaggcaggagaatcgcttgcacccaggaggcagaggttgcagtaagccaagactgtaccactgcactccagcctgggcaacagagtgagactctgtctcaaaacaacaacaaaacaaaacaaaacaaaacaaaaaaaacaaagaagagaaaagaaaagaaacaaaacaaaaaacagaaaataaaaaacaaggaaggcctagatggttttacagatgatctccagcaaacatggaagtaactgatcatctccatcttagactaactgttccagtgaacagctgaaaaaggaaatactgcctcaactcactttacgatgtcttgataccaaaaccagacgaggataataatacgaggctaaaaaaaaaaaaaaaaaccacccaatccagaattgtatatgaaaaaaatacatcacgcaaagttgagtttagtccagaaaatacaagagtggtttaacatttaaaaatgaattaatgtaatttgccacattaacagattagaggaggaaaaccctgtgatcatattaatgcattcagaaaaagcattttataaaaattcaacatatagcacactaggaatgggagggagctttctaaatctgataaacatatctaccgaatgctccctgcaaacatcatacttaataatggaacactgagaatgcctcctatgctttttttttttttttttttttttttttgagacagagtttcgcttttgttgcccaggctggagtgcaatggctcgatcttggctcaccgcaacctcggcctcctgggttcaagcgagtctcctgcctcagcctcccaagtagctgggattacaagcatgggccaccatgctcggctaatttttttgtatttttagtagagacagagtttctccatgttggtcaggctggtctcgaactcctgacctcaggtgatccacccacctcggcctcccaaagtgctgggattacaggcgtgagccaccatgcccagcgcctcctatgctttcattcaaaggaagtaaaagcaagagaaagcaagtccaggggaagtaaagcaaggaaacgaaatcagccgggcacagtggctcacgcctgtaatcctagcactttgggaggccaaggcaggtggatcaggagttccagatcagcctggccaacatggtgaaaccctgtgtctggtaaagatacaaaaattagtcaggcgtggtggtgggtgcctgtagtcccagcttcttgggaggctgaggcaggagaactgcttgaaccagggaggcggaggttgcagtgagccaagattgtgccactatactccagcctgggtgacagagccagactctgcctcaaaaaaagaaatcaaagctaaaaagactggaatagaagaaacaaaatggtcattacttgcagatgataggattgtgtacgcagaaaatcaaaaagaatccacaaagagaacccaaacataattattagacttaatatgagagtttacaaggttacttgatacatagaaatccattgtttttctatgtaccagcaacacacagtctgaatgggaattcaaaagaaggtagccaggcgcagtggctcacaggctcacgggccagcactttgggaagccaaggcgggagggccgcttgagtccaggagtttgagaccagcctgggcaacatagcgagaccctgtctctacaaaaaaattacaaaattagccaggcactgtggcgcctgcctgtagtcccaggtgtttgggaggctaaggtgggaggatcacttgagcccaggaggcttcagtgagccatgattgcgccaatgcaccccagcctgcacgacagagcgagaccccgtctcaaaaaaagaaatcagattgataaatgctatgatattaaaattaagactttctgtttatcacatgatacatcagcaaactgagaagacaagtaacaggtaggccgaagacatacaccccagggattggtgtggaaaatacagaacacctgcaaagtgtaagccaagacatgcacgggcatttgacagaagaaatgaaaagtgctgcaatatggccggtggtcaaggaatgccgattcaaaacccagcagggcaccatttcacacccactgtatgcgcagaaactctcaagtctgctctctggtgtacgtgaagacgtggtgcagcagtggcagtgggggtgtccgctgggatgccagcatggagagctacgtcttcagcccagcaaacgtgaagcccacgtcccactgacccaacgagtccccttccagcattgagaagcctggcacacagcaaggagacgacaccagatcagttgacgctgccttcccatcccttggtgaggggacccggccattgcaggataaatccagcacgactcccctgacataagatgttccggttccccaaaccagcctagatcctttctggttacaccagcttcagaccaggggctgccatagccacgcctcttatctgctcagaaagcgtagaaggtgcatatgcaggccatatacacacatatttatgaaaatggtgctgcctgtggatggatttattttcttttttctttctttcttttcttttttttttaaagacagagtcttgcactgtcacccaggctagagtgcaatggcaccatcacggctcactgcaggcaccaactcccaggctcaggcgatcctcccacttcagcctcccaagtagctgggactacaggctcgcaccaccatgcctggctaatttttaaatttttttatagagatgggggtctcactatgttgcccatgctggtctagaactcctgggcccaagtgatcctgctgccttaggctcccaaagtgctgggattacaggcgggagccacgacgcccagcctgatttattttcttctgtggaaaggaaggagaaacccattccccatgccagattgcaggcgtctgtctcatccggggccagcaaggacatgtgtgtgtgtgttggggtaggcatggggggaaggacagggagagggagagaggccagctggctcccccaagcctcccctcctggagcttctaaatccctccctggctccttcaaggctgcctggccttcctgttggggagagacccctcgccggctgctcactcgctttttggtggtccttcccacgggcctgcctggtctgcctccacatcctcagcggctgcaggtgagaagctgtggatctggggcccagtggtccagagcgtggcccgtgccagaatgcccaggttcaaatcccatctctgtggaatgcactctgaagaaacgacgtcaggtcatggccctgggcaagttacccacctctgtgccccatttctctccatgcaggttggaaagaatgacacagctgctcagggaagcacccataccccgagtctgctgggcctttgagctccagggccaacacctggccctataccctggccgcccccagggctccagccacctgagccaagcttctcacccccaggcctccccagccccatcaccatttcctcctccctcatgggcccctcagtcttaccgtcctcccacttccgccagcccctctgtggatggccctgccacagggggaacagtgccccagcagaaaagccccagggtcgcctggattctcctgccttcgcctcctgccctgggtccaacgcacagtcttcagaatgctgcctccccagagcgcctctagaacgcgcccgcctctctccatgcccatgaccaccactggaccaggcctccccacattctctgccccagtgccaccagcttgcagttgcccatggcgagacaagttcaagttctcaagcctggccacaaagaccccacctgatttgctgacctccgccacaccctgggagacggcccttgaccaaccttgtgttccagtcggtgggaaacactggtttttcctcaacgccacgtgggcatgtcacgtccaggcctggcctggggtaggcctcagctccatctcctgcccaacgcctgccaaggttcatggttcaaggtcatgtagcctgacggttaagtgaaggggccctgtgattgactcagccttgccacatactagctgtgtgactttattcaagtttcctaacctcctgtgcctcagtttcccaacctgtgtttgtttctggatggtgccagtgccaagcccaagcctggcatccagtaggtgcttcgtgccaggttatggaatgcccacccaataggagggcgctgccgtctctcacctgccaggtgcccacggtcagtactccatcatgcccgctgcggccagcagagggcagcaacatcctgccctgtgccattgggcaaaggggcgggcggagagaggctgggctgcctggccgggcttgttgggatgagtcggactgggcacgattgcattgtggggagggaggctggggctctgtgagacgtgctcctggcaccgccagctgctacttggccctcgccggtggcccaccaggtaggcaagagctggggcaggcttgggcttgggcttggggtgcaggggctaccagcctcagggcaaggcatcagggtctcagggccaactggctggggtcaggcaagagcgctcgggtgtcggcccagcctgacgacggcactaggtgtctgggagcacggtgtcccccaagtggtagccctggggttaggaggtggggaaccatgtttcttccccgaaatgggaaagccaacgccagcctcgggcagggtacagggtagagaggctgcccgcctggctccccacccccacagccacccaactggcccagccaggtgacagcagcccactgccaccttgccctggagcctactgctgccgtgctgtgggggaggcagagaccccatccccagtgcacctgctcctgtgccactggccagggtggcctgtgagggtgacagggggtctagctgctaggtgcccctcccttccccatcccctgcatggatggcatctaggccagcaggacggtgcttcagagggtggggtggacagccccggcctgtggaccctctgcctcagcccatctcaagcagcctcctcccgtggtcctgctcgctgccaccatgctgtacctggcaccacttcaccagtccccaggggcagggctgggctgggggtgtggaggaagatcttttggacaaaggcaggcattgagggccaggactggcacttcacccaggccccaaggctaccagccggcatttgcaggggctccaaggtccaccccgtgcccttcacagggacccggggagccagggaggggcatgcttagtgacacaggggttgcagggccagagggggagggctggctggaggaaaccccggccctttgtccccggatcccgggggtggctccctgagggtgggaagtggcaaggagccccctgtccagaacagcccagtgggggtgacagcactagcgagtggggccctggcctggcctctggacagagggaacattgttgtggtggaggcagggctgccttggcctggccactattgacaaagctgccagctgtgagggagcccggtcgctaggccctgggcgccacccccaccgccgcccctccttccccaggccagctcgaatggggctgagcctcgactgtctccctcccactcaggacaatgcccccccgcagccatctcatgcccatcgccactgccctggggcagctgaactgagcgtatgtgccacgccgcccaggagacccctctgctgcaccacttcatggtaagtgcccaggcccggtgtccccagaaatgttcctgggaggggcagggtagggcaggatggctgtggccaggcccaggacatacaggctgcagcctccctcatggcagacactgccccagatagcccggggtccgcaggaagtgtccgtgctcttcctgcctgtgttcctgagataagcggctcctgggccttcctccaggcgctgctctgccctgagtcgcagcggccccactcctggtcggcatgtgaccacacacccagggcagcatctctctgtggagggcaggaggggccagagaaggggctgctcccacctctcaccctcgggggctcaccccggggtcccaccaggcacacccaggaaccatctccagtctggcacccctccctgccccttccctgacccctcccccagccagctctcctggtctgctcttctcctgggacactcctacactgaggccccctgtgccaggccctgagagacccaaactgctggggcccatggggcaggagcaggcctccccgcacccctgaagcctgtgttgtctcttgacacccctggcttctcccagcacccccgctgccttgccccagtgcttcctcgccctggagctgggcgccagcatggagctcacccctgcctcttcgctgacttgctccttgctcagcccgcggctgcctggctctttcccccagctgcggagggttcctccttgcagccggccctggctgcccaaggcaggttttctctccctgtctggtcccttggggcacacggtggcctcactcctctcacctgacttagatctctcttgtctgggtggtgggcgcaggggcgcgctgtgacacagcttccgccagccttccagctcccgcggcctccctccctcccctgccctctctccatccctgccccctctgtgactcacagtccctctgttagcgctcttgcggctttccaggacctgccccccttcaacaatctacatgcatataaagtaggagatgaaagaattctgtccttgtgtgcttgtgcgtgcgtgcatgcacccctccctgcctcttgctccagctcttggacactgtctttgtccctccttatgtccccctctctctgtgccccctctgtctccttgtctccgctcactctctctcattctccatctctctgcctccctccctccctggccctgagcaccctggcctctgtccaccccaccttccaccttcctctggtcctctatctgccttgcgctcccactgccctgacctgtgccctctcacaggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgtgagtggcatgcccttccatcccccctctctgtggatggctggcatctttcagcactggacaggggtgcctgcccatgggaagtgccagccaacctctcagccaggggtcagctgagtctccaggtctcctgcctgctctccacccatttctttccacctttctccctctggatgctatgagcttgccaggtgccctggcccttcggccctgattgctgggccttggggtcatcccagggtgcctggctctcctcccgctggcagcctgggtaccccccctgactgcctctctgctctcttccgggggctgattctccacttcctgccacgtaggattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtgagggcccggccttgctgtccggctgggtgtgcccctggccacggaggctcaggaaagcccccagcaacttccacctcttagcccgcatcccacggttgggtcaggggactttgccacacagtgactgctggctgagcactgccccctgcagcccggccttcaccagctggtggtggctcacggtgaaggtggctggggtggctgggtgaggtgggcagggtgtggtgcctcctggtgaccttcctgtctccccatagctgccctcccacctggcagaactgtccctggtacacggggcctcacccagggtgccgctgctgccccggtgtcatggttccctggagagtgtcctaggcctgagggtgctgagtgggggaagtgatgtgtcctccctcgatggcccggcaggaaggggaactggctctaaaaaggagcccccactaggaggagggcgtgtccctggaacaggcaacctttggccatctggcccagcctcgtccttgtccccccactcaggtctttctccacggctcccagggccaggtttaccactcccagcaagtggggcctccaggctcagccatcagcccagacctgctgctggacagcagtggcagtcacctctatgtcctgactgcccaccaggtgagggccatcctggggctgaaggggccagcacacgcggcccaagtctcgtgcccattgcctctctgctctgctgcccctccaggtggaccggatacctgtggcagcctgcccccagttccctgactgtgccagctgcctccaggcccaggacccgctgtgtggctggtgtgtcctccagggcaggtgagcacggggcctgtgcctaggctagggccaacgggtggtgtgtgccacgaggctgcccctggaagtagccctaggcgtgccgggaggccaaccctgcctgttggagagactcagggccaccacggaggtcacccatcctgccccatctcactgagccgtcaatctggttggcaccccccttttccgacaccacccggcctgtggactcctcatcccagcagccccagccagggtccagaaccccacacagctgtcctccagccggtgctccacacggcagcccctggaatcctttaaggcagccctgagtcactgtgcgtccctcagcccagccgcacctgcctctcagggctggagcccacgccttggccatgaggccctgcctgcttggcccctttctctctggacacagtccccttcacgcctcctgctcattgcaccccactgcactccagctgggccggcctccccaggcccctgttgccggtcatccttggagtctaggacccccacggtgacctgatggacccctgcctggcaggtgtacccggaagggccagtgcgggcgggcaggccagctgaaccagtggctgtggagttatgaggaggacagccactgcctgcacatccagagcctgctgccgggccaccacccccgccaggagcagggccaggtaagccgcccaccaccactgggccctctgggcagcatgaccactgcctggagcatgaaccccgcctgcctcccgtcctccttcctctcccatggcctctgctgccccctctctctggctacatctcccggtttctccccgctgcatcccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacaggtgagtggcccatggggtagggggctgggatggaggctggaggggtaatgagccacctgacctgtcctgcccccactgtcccctcccagaccacgtcactgtgcccctggccctgatgttcgaggacgtgactgtggctgccaccaacttctccttttatgactgcagtgccgtccaggccttggaggcggctgccccgtgagtccctgggcctgcctcctggggtaggggtggcgaccccagagggcactcagttgagcagccaccctgcccctctaggtgtcgcgcttgcgtgggcagcatctggcggtgtcactggtgcccgcagagtagccactgcgtgtacggagagcactgcccagagggcgagaggaccatctacagcgcccaggaggtgggtgggcccgaacttcgggcagagacagggctgtcccttctccacccttcccagacccgcccagcagtaggccctttgagttctgaagggctgagggctcttgttttcccaggtggacatccaggtgcgtggcccaggggcttgcccacaggtcgaaggcctggcaggtccccacctggtgcctgtgggctgggagagccatttggccctacgcgtgcggaaccttcaacatttccgagtgagccatcaggagggaaggggacagggcagtgaggtctgccaacagcgtgtccacactcctgacagcgtccttccccagggcctgcctgcctccttccactgctggctggagctgcctggagaacttcggggactgccggccaccctggaggagacagcaggggattcaggcctcatccactgccaggcccaccaggtgagtggctgccttccaaaccctcttgcccccaagcttccgtagaccctcaggggtctgccatctttgtggagagcctgcttggggcccataacctctgtctgtgggccccagtcttgggggagaggcagggaacaatcacattcattctggggggtggcccagaggagacaagagtcagaggtgccctgagtgggcacccagcctgaccccacactctgcccacagttttatccctccatgtcccagcgggagctcccagtgcccatctacgtcacccagggtgaagcccagaggctggacaacacccatgctctttatggtgagcctgagggcagccaggcaggcggggcagggtgggtggcagacaggaggcgctcagcacactgcctgaccctccctagtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtgagtctcctgccgggcccccacagcccagtggcccacttctcctgccccgcactgtcctgtcctccgtgatcagaccagccctgccccaggcccccaaaccccagcagctcggcctggctgggctggttggctggccgggcacccagcactgcagagtggagcgtgggtgcgggggaccccatctgccatcatttgcctgctgcaggtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggtgaggcacttggagggtgaagatgggtggggaggccctcagagatggccacccagagataaggaaggcctgtggccaagaaacctggggcactcgggtcaggggaggggtgggctgtcccctccgtccctgagccctgagcagctcccaggcctcggctttccaggattgtgtgtgtgacatctcctgcccccaatggcaccactgggcccgtccgggtggccattaagagccagccaccaggcatctcaagccagcacttcacctaccaggtcagtggcctcccaggtgtgccctacgcaggggagggtaggagggagggccaggaaggacaggcgcctagtaaggatgtcaagctgggtctgcggggagcaggaagcaccgctgcatgtctaggagggaagccatggcatgtgagtggaggtgggcagccaggccagtctgaggcacgaagctctcaggatctgttgccctgggcacttggtggcaccgtttcctgggtgggaagcctgggacaggagcagtgagggcaggggtgggttctgcccaaagaggcaactggatttgagagtttagagctccaggtctgggggctgtaagctgtggtggggaggaggctgtcccaagggggacagagtggcagtgaggatgaaagagccccacttctactccccatgcggcaggggtgggtgggaggaagctggccagtgtgcagtggcctcgggaaggagggcgtggtccactttggccccaggaggtgaagtccagagatgacctgcgcttcagaaccggagggccttgggcatggcccaggggggtgaaagggccaggctgggctgccgtgcctacccagcctgcgctgttcgccaggaccctgtcctgctgagcctgagtcctcgctggggcccccaggcagggggcacccagctcaccatccgaggtcagcacctccagacaggtggcaacaccagtgccttcgtgggtggccaaccctgtcccatgtgagtcccggcctggctgccgtcgggtggtgggcactcccatacgcctcagtgggggtggtacatttagagaagtggttgctgtggccacccccagtggtccctgcccttgtcaaggcaggcaaagcagggcttctcctacgggggttgggccagggctggggtagaggggtggtagagccgagatgagagaccccactacccatcctgcagcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggtgagggtcagcccgcaggccagcctgtgcaccacgcaggagggaaggtgggatgcgggctgggctatgttgcccaccgcccgcccacacccgactgccatcctggtacaggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcaggtgagcccctcaccagcaggcgacaaggctgtccccgaccatgcccatgcccagtggggaggaggagggtaggccgccatgcccctagcagcgcacagcagagcccagctcactccacctgtggtcggccctgaatgccccacagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggaggtgagggccaccttcaaccctgccccgccacggtgctcaggccgcctctgtgggggccagcagcttaggctcccatgtgtgtcccagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgagtccgtgccctgggtgggcaggtggaccgggtgccgccagcatgcactcaggaaccctgcccgccccccaggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggtgagacccgcccacccccagcacacttccctcctcgccattggcaagggcgccctggcaggcggctggcctggccccggccctggctgatgctggccccggccctggctgatgaagctggccccgggctgcaggcacaagagcaagcaggccctgcgggactaccagaaggtgctagtgcagctggagagcctggagaccggcgtgggagaccagtgccgcaaggagttcacaggtgggtgcggaggcggggggacagggtacccacgaggcctgaactcacacctcggcgcctcctggccccgcagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacggtgagggccgtgtggcgggagtgcccagtgggcaaggaggtggggctggggaactactggcctgagacaaaggtgggggaggagtggggcttcccaggatgagcctccgacccctgctcagctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggttggccttgacctggacccggtggcgggggtgagggcttgccacagacctgcccccatcgcaccctgggcgggctctgtccaggggcgggtggggccaggaagccccagcaggtggggggaaggaaagtgagatgtcctcagcagggacacaggcacaaaggcctgaccctgtggccggctccccgcaggacagagaccatggtggagaaactgctcaccaactggctgtccatctgcctgtacgccttcctgagggtgaggggcactgtcccgcctgctcccagccctgagtggcagactcctcccctcttgccatgagggggctactgcctgcgccctacgtgacgaaggcccggcaaggggggctttggaaagggaaggactttgaaccctctccggggctggagacgaggcagaggcgagaagggctatcatcaatcctccctcgcttggctgatgccggctcatcttggcagtgcaggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttggtgagagagccagccctgcccacccaccccagggacccttccctacccctccggcacctggagcccctcaactgtgtcttactatgagtgtggggcgtggagagcaggctgtagactatctgcttccctgactccctccagagtggcgctcaggcctggctggtcacctgaccctatcggacgaagacttgacctccgtgacccaaaaccactggaagagactcaacaccttgcaacactacaaggtgtgagcagggacggggcgaggcagggcggggctggggcggggcagggcgaggcagggcagggcggggctggggcggggcgaggcagggcggggctggggcggggcgaggcagggcggggctggggcgaggcggggcagggcggggctggggtggggaggggcgaggcagagcagggcagggctggggcggggcgaggcacggcagggcgaggatggggcggggcgaggcagggcggggctggggcggggatggggggcggggcggggcgaggcaaggcagggaagggcagggatggggtggggcagggtgaggcgaggcagggcagggcgggtctggggcggggaagggcgaggcagggcaggatgtgggcggtgtaggcgcctggctaggggtcagcacagcctccgctccccatctctgccaggtcccagatggagcaacagtggggctcgtccctcagctgcaccgtggcagcaccatctcccagagcctggcccagaggtgccccttgggagagagtgagtccctcggccctgacctggggccactggagtccaggctgggcaggcagaactcctggccatgcatctgcctcaacttcatcccccaccccaccgagatcttctgcccatctccttcctttcttccagtccccacactgccccaccttgtcgggggagtggactgggcatcccaggccaggggcagggggtatagccctgaagccaggctcctgtgccctcagacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaaggttggtgcggcctgggtggctgggcctgagaggaggctcagccagggaccccgaccgagccagggtgtgggaggggcaggggcagcctcagccgtggatggcccccacaccctgccctccacacagcccttatcccctgcctcgcagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacaggtgcctttcctgctgccccacccctgctgtgcatatggtccactgagtcccagagagaccaggacattcccagggtggatgcgcccacctggggtttctggaacttacaggaagatctagggcccaggtcacctaggccaccaggccagcttccagcggcccctggctccgagtgtgttgccagtaggctggagtacatggggcggagatcacgatggcaggccagggcctcacgcccacgcctgccctgcgcccccagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggtgagagcagtgccagcagcagcagctggcaggggcttgaggaggaaaggcttatgggggaagcctagagggctgtgcacagagctctgggtgggcagtggcagcatcatgggggcaccttcacctccgagctcatgcctagcgcctcccctccctccggagcaggattccccagtgaacaaactgctctacgcccgggagatcccacgctacaagcagatggtggagaggtgggtgtcagaggcatcggggctgcggggaagggggctgccccacccctaacgaagtctgctcctccaggtactatgcggacattcgccagagctctccggcgagctaccaggagatgaactctgctttggctgagctctccggggtgaggcatggcccggggggtgcgcctgtccacacgtgggtggaaagactagcagagcagaggggggagacttggggcttgaggaccaggctgggacctcactgcccccctccacgtggtgcccccagaactacacttctgctccccactgtctggaggctctgcaagaactctacaaccacatccacaggtactatgatcaggtgaggcccagggcactccggaggggaggcacagtggagcgggaggcccgtggaccctcccgggggagcaggggtgccagcccatgctggcggggcccaggctggggaagggactcggctttcattctgattccccagggagacgccaggcagcccctgctggatccccaggctcctgcggtgatggaagcagggtgggtggccctgggccagcaggcagaggggcaggctcagacaggcaccctcctctgcccgggcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttattttgagacggagtctcgctctctctcccaggctggagtgcagtggcgcaatctcggctcactgcaacctctttttcccggagttcaagcaattctcctgcctcagcctcccgagtagctgggactacaggcgtgtgccaccacacccgactaattttggtatttttagtaaagacagggtttccccatgtcggacaggctggtctcaaaactcctgacttcaggtgatctgcccgcctcagcctcccaaagtgctgggatcacaggcatgagccaccgcgcctggccagaaatgtcttttgacaaagggcccaatccccagcccctgctgttccctgcaggagctgactcagtgctctcctgactgagagtccctcagccccatgcctataacctgctacccacagacaaagagaggccatcaggtacccgggcttcactttccctcccactctctgacctcgctggcccctccagcaatgcctggcccacccctaccagttcacggaccctggtacagggacactgcaccaatatcttgggacaaacaccctctctgccgagccccctccctttcattgggactcctctgtcaggccccagctggcctcccggctccaccctcgcctctccattcccttgtccttgaagtggccagagtgatcttttgctgagcagaagctcagtgaccaccccccaaccccatatcacccaagctccacattaagcctacagacaccaggcctctagtcctcgccctcgaaccatgcggcagccgtggccagcacgtgaagggctggaacgcgtcttggccgcaggccttgccccactgtgccctgtgctgccctggatgcttctggggacccaatttctcctggtctctcatgatgcagcccctgggtcacaggcccctcagtcaccaccgcactcatggggaagtggctatgggcttgcttgtccccagcagtgagcagcttcctgctgcctccctcatgtctggctatggagcagcccacgacaggcaccttgcaaatggtggagaggaagagcaggcgctgggagccagagcgccaggcagcgtcgcaggagcaggttctgggctggcaagctcccaggcctcccctcagcaggcctgttgcctctggtaggggaaatgaggggtccccagtgacgccacattcagagggcactggactcccagttgtcctaggggctgatgaaacatagaagaagcaggaagtggctgggagcagccagggacagggttcccatgggaatgagaagggcacctccaggaggatgcccacaggggcacaggtggtgggggcttggcctaaggaccaggttgccaagtggagcacatccccacagtccgcaccggagaacgggagcccgacctggggtacgggctgcttcacccccgcgtggacctccccctcagctggggtgcggaggctcagcctgggggcccagttgcccctggtccccaagcagcagccccctctgcctccagggtgggcctggagcaggaggggggcctctgcccgggggccgggctctctggggccgccgtcgcgccgccccctccccgcaccgcataccttgcccacagccgagcagctgggaggctatttataaaggcgggtgagatcagcggccggccaaggctataaattcgcaggccgcggccgggccccacaggagcagccgcccggggcaccggagctgcgggctgcgtggccgggatgagcgccagcacgggcggtggtggggacagcggcggcagcggcggcagtagcagcaggtagggctcggctggggcacccggagcccctggcgtctctcatgcccactgccactcaccccacccgcagctcacaggcctcctgcgggcccgagtcctcgggctccgaactagccctggccacaccggtgcctcagatgctgcagggccttctgggctccgacgacgaggaacaggaagaccccaaagactactgcaagggtgagacttggccttggggacatgcggcctcacggccactgcagggacccagggcagtcctgggcccacatgggccagatggtcaatggggccgaggtgttcgggggcccaggggagtgagaaccccctccaccccaatctacatctcccctgggcaggcggctaccaccctgtgaagatcggcgacgtgttcaatgggcggtaccacgtggtgcgcaaactgggctggggccacttctccaccgtctggctctgctgggacatccagtgagtgcctccttcgcctccggggcccagcactggctgggatcctgtccctgggcttgcttggggccaccctgatccccgccgtgggtcctgccagggccacagcctacaagggtctcggtattgcaggcgcaagcgctttgtggccctcaaagtggtgaagagtgcggggcattacacggagacagctgtggatgagatcaagctcctgaaatgtgtgaggcacctccctaccccactcccagctcccctggagctgcctggggcctggcaatgcgggtgcaaggcctgccggggctctgtggggcagggcggggctccctgaggggcagcctccagctggctgtgcccaagggggaggatctggaggaacaggcgagggacaggaggggttggcggcctttcttccagcagggcccagctggagcaggagaagggtacactgaagggagctgtgggcttcagggcagggtggaaccatctgtggccccttggcttttgctccaggtccgggacagcgaccccagtgaccccaaaagagagaccattgtccagctcattgatgacttcaggatctcaggagtcaatggagtccgtatcctttgcaggaagagcaaagcagtgtggcagccaagggccggcaaatgggggggccctcgctgctagagcctgtctgcagacccgcacaatgggcttgcatccctcccagtaacgggagcctctggcacgaccccgcccccaggtaactgtgtttacgtggaggcagtaacaagctagcgttgattgtccatggacgttgctattatccccaaacggcaggtgctgtctctgtggcactgccttccctttgggggactgccaagaggccctatggcataactagcatgggagtgggctggcccgagaggcctctgtgcctgctcctccagcgccacctctaggatgaccacaaaatgcaccatcccaactggcatacctgttgagactgacagggacactatcgatgatgacaccagcataatggtgaccaggactgcccaggggaggccctgcctccccacctccacacggcccaagccttgctgctcccctagctgagggtgggtggggcctgtgccgcagctggtgtccactggccgcccttcactcccagcccagatgtgtgcatggtgctggaggtgctgggccaccagctcctcaaatggatcatcaagtccaactaccagggcctgcccgtgccctgcgtgaagagcatcgtgaggcaggtgagtgccacccactgggctgcccagcctggcctgggcgggagttggaggaggtcaggtgcgactctctgcaggtgctgcacggcctggactacctccacaccaagtgcaagatcatccacacggacatcaagcccgagaacatcttgctgtgtgtgggggacgcttacatcaggcgcctggctgccgaggccacggagtggcaacaggcaggggcgccgcccccctcccgctccataggtaccaagggcccacatggggctgggtcggggcctctgggcctgaacccctgcctgagtctctgttcctccctgtccccccccaccgctccccacctgcactcccagtcagcactgccccccaggaggtcttggtaagttggggggcccctctctcccatgcctcctctcccatctgagccaactggaggccatctctggagccacagtggctccaccccccaccttcacgcactcccacggtggtaatcccgaaaggctgggtggctgggctgacggtaattcccggggggggtcaagtgccccaaactgctcttggtgaaaggatgctgtcttccccgaatggccacttccgcctgccttagcttgggctgagaggggacagagagcaccctgaggcgggccggccaggtcttcccactcctaatggagctgtggggagtggggccacaggcggggaggcagggagagtagtgagtagctggtgccaaggggcgctggcgccacattctggtgtccatgggagccctggggcccggagaggcctcttccctggcggctgtgcagggaaacctccacttcatgctgactggggcgggcgacaggaaccctggggtgaccctggctctgacagcagaccggtaagctgtccaaaaacaagaggaagaagatgaggcgcaaacggaaacagcagaagcggctgctggaggagcggctgcgggacctgcagaggctggaggccatggaggctgccacccaggctgagggtgaggggccacagagggtgatgggccgtggagcgcagcaaaggctgcaagacatctgctcagcagctgcctccaccccgtctccccagactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcagtaagttgggtggcaagtggtgggcaggcagggctggcagtagtcggaccacttcagtctccctgctctgccttccccagcaccattcggtgcctcgaacctcctggtgaaccccctggagccccaaaatgcagataagatcaagatcaagatcgcagacctgggcaacgcctgctgggtggtatgagcaagtgtgggagagcagagtggggggccctgctccaagggtggaggcacagggccgctcttggggagccctaccccagtctgcagtgcacgtgaaccgtcggctgggtgggcactggtcctgcccagtcaacagcactggggccatggccaagggcaggggccactaggaagggatcagcctcagcctcacatcactgggcctgtccctcttggaggacctggggaccccgaggctcacagcaaaccccactgagctcctcgggtaggcggatcggggtggggcaggagtccgtgggggcaggacagccttggccccagcccgtccccagggctccccttgcttccagcacaagcacttcacggaagacatccagactcggcagtaccgggccgtcgaggtgctgatcggcgccgaatacggccccccggcagacatctggagcacagcctgcatggtacgcccgcccgggctgccctgtgcccagggccagcagcccaccagccagcagcctcacctcctcccccttccaggccttcgagctggccactggtgactacctgttcgagccgcattctggagaagactacagtcgtgatgagggtaaggggtgagggctctgggctcagcctcccggcctcccggcctgcctgcccccaacctcctctttctgcccacagaccacatcgctcacatagtggagcttctgggggacatccccccagccttcgccctctcaggccgctattcccgggagttcttcaaccggagaggtgagggcccgggcagcctcaggccatgtggctgcagggagggtgggacggggaccttggattctgcaacagagggaacactgggtcccaggagccagggcctaagcagaaggcaggtccagagacagggacagagcctgacgcccgctggcctgcccgcaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaacatcggtgcctggagtgagggaggcccacgccaagtctagggagaaggtgctttattctgggatctgcgtaccaggctggctggggtgctggagtgggaaggggaatccaaggagcaaaccaagaaggtcctagggccagcctaggcctccacggcccggccgttgatgacgcggatgtggcggatgacgtcctggatggcttcagatgttgtgccctggcccccgatgtccggagtgtgcatctgtaggacacaggcaggctcggcacacaccaggccctgccaccccccgctgtctcctgtgacgtgcaggactgggattgccacaggagggaagtggcaccagctaagggccagaagatggggccagatccagtaccatcctcccctgggggctgtggtcagtgcatgaggcgggctacaggaggctgcagggggagactgggcggggcagcagggtagggtgcgaggggaacctcacattctcattgtccatggatgccaggacagccttacggatggaggtggcataggagtgcagcctagaggatgggacagccagccttcagtccctggggcccggagggctggccaggggcttgcggggcactgggagccactcacttgaggtggtccagcatcatgcagctggccagcagggtggccgtggggttggcgatgttcttattggcgatactcttgccggtgttcctcgtagcctggggaggcaagacgaaggagagtgggtggagggcagaaggatgccgggcagtgactctgctcctgtgacacgtccagaagaagccactccacagggacaaaagcccaccagcgggtgccaggggttgggggaaggtgtggggacagatagcttatggggacaggctttcctcgtggggtggtgaaaatgttctggaatgacctggtggtgacggcagtacaaccctggatatccaaaaaactactaaatcatgcattttgaacgggctaaccggatgggatgagtgtgcctcactaagtctgtgaacaggagaaaggcggcaagccgcggcactgccaccggcactcactgtttcaaacaccgcgtacacatggccatagttggccccagccacaaggcctgggcccccgaccagtcccgcgcagacattgttgacgatgttgccatagagattgggcatcaccatgacatcaaactgctggggccgggacaccagctgcgggacaaggagggggctggctgaggagcagattcggaagcatgggtgagagaagcccagggcactcagggcagggggacagcactgggcaggctaatacctgcatggtggtgttatccacaatcatgttctcgaaggtgatctgagggtagcgggctgccacctccctgcagcactggaggaaaagcccatcgcccagtttcctggtggggggttaggaataggacaccagcttggccatcgcaacagtcagccagagggacggggcgtgcagagggccccaggaggctggggtctgaattctaacctgtccctcaccagcaaaatggacagaatcccaccccacctcccctaagtgtgggttctggcaaggcctcgagggcaacagggcactcgcctagggtggcacctcggtgggtagctgggcttttggaccacaaatccctcagagcaggcccaagcaggccactgcagctgcttctggactgctcgcagagaggtcaggggacatacatgatgttggccttgtgcacggccgtcactttcttgcgcccgctctcctgcgccagcttgaaggcatactcggcaatgcgcagggacttggccttggtgatgatcttcaggctctccaccactcccgccacactctgaggagggcatggggagaagagacccatgtgctactgaagagcagcactggccaaacaagctggcgcgaccgggccaccgtgggaagcaaccctgtctgcctatttctggcttctccctcgggcacagcccctgccctctaagggtacacctgtccctggttccttaagctctccccttaatcttgacgctgggggggctcatctcgggccccccatgcacacctcatgctccaggctgctgtactcgccctctgtgttctcccggacaatgaggatgtctatgtccttgtgccgggtcaccacgcctggaaggctcttacagtggatgacgttggcatagaggtccaggctggtgctgggaggggacggagaaagaggctgctaggcctgacaggtggctgactggagccagactccactggctcaccccaccttagccccaccaagcccccagcccgcacacccggatctcaccgaaggatgttgtttcgagatttgtgcgacggtggcaggttatggttggtttcgatgttgcctacaaaacacaacacaggcttagtggcactgcccatccccgccccacctcagcagggcagctgaaggctgccggggtcagaagacttggggagcaaaaatgtttcctgaacactagaatgctagaatgcaacttccagcctaagccccacgaggctacacgctcagggatctcgaagggcacctggtgcagcaggtgctccatgaataacccctgaacgacggaatgaacaagtcaataaatgaataaaggctggcaaccagccaggcagccatgccattctccatccaggctctggagcaacagaaagtgaccactctttactaacaggttggccggccaggctggagctagcaaggtggccttggcggtgttactgccaagcccccgcatcaaggcaccacactcagaggcaggcgggggctgcctggagaaggccacggattggccggaccctaccctacgacccaggacacctggaggaagggaagcagaggccagtggccgctggagacagcagtcagagggcgccaagcagaggccgcctgctggtgagcggtaccccacccagactgctccactcacagcgcgggggtcccctgtggctggcacaaaggcccctctacttgactgccagggcctggggctccccctgggttcatctttgctcacacgctcctcacacagtgcaagtaatgggctgagtgtgcaaaatgagcaatggaagtagtttaaggacctcaagtgaagccccaagaatccctgcctgggctgtgccatccacctccaggctggctgcagccgaggagccaggcagagggtcggaactgcatctctgtgatacctggtttgtgaagaaagatgctgagggtcaaagctgaccccagcagagaggactgtctcaggagggaaggaggggtgggagggaacccatcagggagcccgtcactggacaggctcacacacagctgctctcactcgaatcccagcatcgcagcgcaaacaggcccgaggaggcgtccacccagtctccaagcacgagggtcctctctagccagacaagccctgaaatcagagccgtggggccccacaagagtcagctcagagggaggtaaaagaaatcacaggggctgggcacgacggctcacgcctgtaatcccaacactttgagaggctgaggcgggcagatcacgaggtcaggagttcaagaccagcctggccaacatggtgaaacccactctctactgaaaatacaaaaatcagctgggcgtggtggcgggcgcctgtaatctcagctactcgggaggctgaggcaggagaatcgcttgaaactggaaggcagaggttgcactgagccgagatcacaccgctgcactctagcctgggcgacagagcgagaccccatctcagaaagaacgcaagaaagaaagcaagaaagcaaaaaagcaagcaagcaagaaagcaggaaagcaagcaagaaagcaagcaagcgagcaagtaagcaagaaacgaaggaagaaagcaagaaagaaatcacacctagggccccatcctggcccctggccctggagctcacccttcagggccacgcggttccggcggatggccatgatggcattgcgaatgtcctcttcatcagcattggaactcacgtgcacctcttcaaagtccactggtacacatgcgtgcctgaggcacggcagggtcagggaggctggcccagacccccccgcacctcctccaggaagcctgcccaggctacctctctcctgttgctacctgccctgacctggctctgactgagaagggactgggcccaccttcactgactgatggggacacgcttgaactccacaatgcacactgtggcaggactggtgccaccttccccgagcccaggccagtctggcgggatcacaggccatgggacgcaaggcctgggcttacaggtcgtcttgccatggcctcaccgagtgcttctgggcgcaatgcccctcttggcacaaagtcctcagggccccctggctgaggacaaggcggggacccaggagctccatacctgaagacggacttgacatgcagcatgagctctggcccgatgccatcccctgggatcatggtcaccgtgtgccgcccgccatacttagcggacggaggctgtgggaggcagagggtgaaggtgggccttcggggatcccacatgcccccagctcggcccccatgggctcaagccaattcccttcttcccactggcgctgaccccacaggctgccccgtcacaaggtgccaacttggggcagccccgtcccagacagggctgctcatccagggctcctgggtcagcagcagcccacccccacctggaatttagttaaccccaaagcaactaagagccccccaaacctaacaggcagagaagaatactcacaattgtttgttcctagaaaggatgagaaaggaagaagacacaatcagccaaggttccaagagcaaggccgtgaccaggaaagtgggaccttttcccagggggatgctggctagtacaactcccagaagaggggtgggtagcccctggagaccacgtctcagaggacaggacacaggccgtgcacacacgcgcacaattgcggccacatggagaaagacacatgcgtgggcacgggcaggtacttactgaaaagatgttcctcgaggggacctcgtgggcgcctagaacctggcagagaccaaatgccagcggttggtttgatgtctaacccagaaagccaagttggaaggaaaaacggaccgtccccactgtgcccaggcaggtcccctgtctgtgcagcatggcccactgccaggggcacaatagataattagctccaaagcctcagtccccagggccggcccgctggagcacctggaaagtagaaggcgctccagcctcctgcctccttccgctcttcagaaaatttcttaaaaggcgtgtccctgccctccctcctcttttttgcttctgattatttttttggccagttattcccgctcagcgatgtttgtaacatgcaaaaactggcaaactaaccctggtacagcagggaaatcattacaacaaaccacagatccatgacaacagtcacgttatcacttcgccgatcactttttcttattacaaaagcagcatgtggtcgctacagaaaaagcagaatagggagataagaaggtagcacccagcctccggcctccctgagacaagcactgctggccccctggggaatggcccttcggcattagaaatcgaaaacaaatgtgtagggacatccagccatttctggaaggttgataacagaaacccaactctaggaaggccttcggaaaggactgctggatgccgaatgtccccaacgccctgactggaaatgccggacagcttcagagccaaagctgcctgagccaaatgtgccaggtgccaagtgacctgctgtcctggaagaagccccacctagaacacacctgagacggtggcagagccaaggtcttccctgtcacttggggatgccctgccacttgaccaccaggcagcagcaaagtgttccagccaatggcagaagcatcatagccattggccaaagagccatgccttccagctagaagtccagaaaggctcgggcggagtctgacctctccctgtctgtgtgtccctggccggcactcatcagtccaagccaggggctaggagagggtgcccacaaggaccagagccccgaggatagctcagctgatctgtgtggcacctggatctgcaagcacaggcacggtcgggacttttctgtcttctctctagcgcttatcaacgggtcgggacttttctgtcttctctctagcgcttatcaacatctgaaatcatcttatttgggggctcttgtaagcacgcagaaagcggcttcgatggaccttcctccagggagctttccctgatgccctaaggctactgagctgggaccctaaggccctacttacccccttccctaggttatcactgcattgctccctcctcaacccctgagcccgagaggaggggccaagtcagtgtggtccaatactgtcaccctaggacccagcacagtacctggcccagagctggcacataaggaacatttcctgagtgaacaagcacatcagaaaatgaaaaaagatctggagactagggaggcctcggtccaaatccaccatccactcttcttgagatggcttcatggcctcatctgaaattcacagaacggaggtacctactttccgtgactgttggaaagattaggggacaggaggtgtgtgagctgctcacagtagctagtgccacacagcacgcctgccccttcaccccactggcccctcaggtcagagttcaaggctggtgtccctgggaggtcacgggtggacccctgcagctcccagcagtagttcctcctgggcttcagctgtggcagcaagccaatctcctgagagcatggacctccctcacagatggcaacatcaccaccagggctgagctgaacctctctgccacccggtccctgtgccaggtgttcctttgggctttggcaaaagacccagagagcgctccagatggacttccctgaccttactgtacagatgcaggcaccttccttcaggaggtcgcaaaggctctgccttgtgccctgacttccctgtgaagccaccaatcaaaggagccaagtgtgaggcaggatgcaatatgtacacgcctcccgctctcccatcaccctttcatggttccatggaaagaaagaacatccacaccccacatcttatgcctgctgaggcttctgtctttggcatatttctgttggaccatgtgtcaatggtggctgcatgttttcctatggcgtccaaatcagtgggattcaagacctggggttcctctgtaagggttctcacacccaggacggtcagtctcagggcaaggcactgcccagctacccaccgttcactgtcccctactcccaccccaacgcacacacaggcacacacacaggggaggtcagggaggaggcacacatgtcttcaccaagagcctacaggagcccagttgctggagccatcagagcctctggaaagccactatatactgccgtcctttcagcagcaaggtgggagaagtcagcatcgtcaagagaatttcattaggcacaagcagtctcccccagaggtcagaaggagaaaacatggcaagtagagatgtccctggggagtggccgcaaagtcacggagttctggaaggtcagagttgacaggatcctttgagaacatgaagtctcctcccctctgggttccaaaggggaaactagaacccagagagaggaggaaatggcctaaggccacgcagtggctcagtgtgggagcatggcctagaggtcaaacctcttacccatcagggccaggtgctggctggcagctgcttcagatggtttccagcccacctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcggccaatcaaccccggcgcgaagccctttccccgcccctggtggggcccctagccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggggaccgcgaccagctgggcccctggctcagggaggggccacgtcagtgctgccagagacgtcacaatgccggcccagccgttcggtgcgcgattggctgccgctgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcaggtagcggcccagccggggcttctttcttgcgagcctctgacccacggcaggtggtgttgggggcaggagggatgcgggggtccggcctttcagggtccgtcgctgcgggccgggccttcccccgagaggcaggcggccttgggacggggggaccaaagcacctcgcgcacgtttaccggcagccaggcttttccttgtctgcccatacgaagaggagtccccgagcctccatggtgcgcccggcccccaagctgcagcacggaacgtgacacatgtcccggctcccgctccctgcggggtcggaccggagcgaagctctgtagcgctgagcgatcgcggccaaaaacggggctggaggagccacataagctaggaagggacctcagtgaggagagggagcaagagcggggcgagttagatggggagccaaaggtgcgcagggccttgagtgccaggccgaagactggcttttccggagggccctgccttacccttaccagagttttcggcagagccgaccaggggtcccgtcgatttgcattcgtgaggggctgaggtctgaactccagagtgtgtttaggaggtggctgcagcagccagccccgggcccgggggccaggactggacaggggcggctttctccacattcccttttctgccgtccttcaggccagtagccttgctgcctgcaacgttttggcagcctaactggcctccctttccgcacactcctcatctgcccctcaggaattccctgaactatagtcagggacgtatccagaggacaagcctggccataaaacccttcgggggctcccctgcgccacaggaagcaggcccaacttaggcaggacacagaagggctggcgggatctagcccctgagaactgcctccacgctgttcctagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaagagcgcatgggtccccagctgatccgtgctatgaggcagggccgggccatcctgccctcagaccgggatactcgagctggccttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgagacagtggggtttcagacaggagggcgggtggggggtgctcctcactgctagttgatgggggacctgtgtcgatagagggagaatcaagattccaactcttggggtgccggagagatcagggcacggtgatgccagatcctagccagtgttgacaggtcaccttcctcacctgctttgtgtgctgtgcctacacgaggtaaccctgggctcaccacccgctgtttcctgaatgagtatctggaccgggagaaagggccaggagtcagcccaccccggttgccattggccagtttgtctgtgtgggtgttttgtttttgtttttgttttttgtttgtttttttgagatagggtctcactctgttgcctcagctggagtgcattggcacgatcttggctcactgcagcctccacctcccgggttcaagcgattctcctctcagtctcctaagtagctgggatgacaggtgctcgccaccatgcccagctaagttcccataagtccaaagaaggaaatggggccttttttgggtatggccctcttagggtaaagcaccccttgggcagcccactgggcacccctgaccccagcacctcccttgtagactcaggaaatcactcagcccttttgatcatcccgcccctgctcacagtcaacagggttcctatgcgtccagttaggcccggccatggggatctggccttgtgcccccgtagggaagaccaatgcagagggccagtcacgggattggtgagtgttacttggtacctcctgccagggacactgcagcccccaactgggcctagcctgcccacctgcaggccgtgtgagcagcgcacagggctcctctgcccacacccagagggggcagaaggtgaccctgcctttgttccctcacccagaacatggctctctatgctgacgtcggtggaaaacaattccctgtcactcgaggccaggatgtggggcgttatcaggtgaggggccaatggttcccttgctagggggctccctgctcccgggtgtgacctgaagccccaggggtggccggtcaaccagggccaggggccgtgggctctggctgccggagtgctgcagtgtcggcactggtggtcagggtggcccctccgtgtccactctgcccacactctgctcaacacccaacccaggtgtcctggagcctggaccacaagagcgcccacgcaggcacctatgaggttagattcttcgacgaggagtcctacagcctcctcaggaaggtgaggactcctgtagcccactgtgctcccctgtccctggggagcaggatgggctgggttgggaggtgctggcagcaagtcctgagctgggtggcctttctgtgatcctgtcccttcctcagtgtctcttgcccatttctctcctttccttttctggggcttgggccggtgttcctacctgtctttcccctcccctccccacccccacacgccaggcacccctgaccccagcacctcccttgcacctcccttgcaggctcagaggaataacgaggacatttccatcatcccgcctctgtttacagtcagcgtggaccatcgggtgagtggcctggtccctcctcctttttggggttgttgggctgagtgaaggttatcctctccacagccccagctctgctgctgggccgtgattggccagcatgtcttggttcccctggcggaaggtgaccagggctggctggtctgctcacctgtactcccctgagctggcttgtgatctcctttttttcagggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggggctgctggcttgcgttattgtgccttcccccgactgggagagctgggggcccagcgtcctcttgtctgcctggccagcagaggcaccaggcaggaaaggggtgggctttggtctagaactcccgtccctcctcccaatgaagccccccgtctggtccccacaaaaccctgtatccaccttcccagtgactctctcctggttctggtgagggcagtgggcttggccacctcctccccaggtggccccacaggctccatggggaaacagccagcctggtcttcatcacagctcctgtgttggaagccccgggcccattccgcacgcagaggggtttccctgcactgctttcgggcacagcaagtgcccccaccctgcccatgcggcgtgcagctgtctgggcttggcccctccatactccacaccctgaccatgccacctggcttcccgtgtgctgtgccttcatgggatattgagaaaatacacacccatggccaggtgtggtggcacacacctgtaatccccacactttgggaggccgaggtgggaggatcacctgaagtcaggagtctgagaccaacctgggcaacatggtgagaccctgtctctacagaaaaaatagaaaaattagctgggtgtggtggcatgcgcctgtagttcagctacttgacctggagaggtcaaggatacagtgagtcgtgatcacagcagtgtgctccagcccgggtgacagagtgtgagaccttgtctcaagaaaaaaacaaaaccccacctgtgaggggtacatcacttcctcctagagacacctctcccaagagcacccgcgccctcaggacaccaggcaggcatcccggcctggcaccacgcctggagttcatcctgcacctctcccatcagcctgattttcagcttggcacatgctggctcctgaccagctaatggtattccttagtggcactgagggcccatgaggcagtgagggtcttggagtccaaagggactgggtggaaatcccaggtgagcccttcccagccatgggacccaagtcggtttgctcagctgcgaggcagtgacagtgcctactccaaggtgtcagggagtccactgggaccagccaccaaagtcctgacatctgggtcacccattggctgttactggagagaaatggaattctccagagaggctgcctttttcttgtttgtttgtttttgagacagagtttcgctcttgttgcccaggctggagtgcaatggcgcaatctcagctcactgcaacctccacctcccaggttcaaacaattctcctgcctcagcctcccgagtagctgggattacaggcacctgccaccacacccggctaatgtttcgtattgttggtagagacggggtttcactatgttggccaggctggtctcgaactcctgacctcaggtgatccatccatctcggcctcccaaagttctgggattataggcatgagccaccgcgctcagccaaggctgaaaaggagggaaggcccaaaacttgcctgggaggtaggggctcctcagtacttcagctcggtggctagagagagcagcactgaggggccgggggtgtcaggagcaggtgaggactgcctgtgacctgggtctgtcagagtctcggggagggggtcatctatataagcagggagccctcttcccacccccaggccttgggaggggggttgggaggggccggctgccaagaataggtgggcttctaggaagagctgggcgctcaccccaggacagtgcagcaggagcgttggggctgaggggccacaccagctttgccagcagatgcagtttctagattccagaggagactcagcagcctgtgcagggcgggtggctggggcaggccgggtgcagcaggcaccggggcgactgtcgggcgcccggttgctctttttagttctggctccaccacgaagcctgatggccgtgggacccagacgtgaagttgctattccagggcatcagtagccaagtgctgccagccttcctggcgccacctctccctgagccagccaagggactccaggctccaggcccatatgagcccacatcccgtgaacactggagggcaccccaccattggaagaaggggggtgcctttaggaccatccaagtgagccccccagcagctagagggaggccaaggggacagtttgacctccatctccagtcaactccggccaattccctgtggctgggcccttggagccttgttcccccaagggacagggttagggagctggtcaagggttggatgtgccaagccctcatgggggtgaggccctgaggggtgggggaagccattatctccagcctctgccctctgctccccttcctgccatccagccagcaagcctcttcccctcttccctgctggtggggtgtgatatgccaggctttccctcccagagctgctgtgcggcagagaggcagctggcacccttgtgatccagccttccctgcagcgggactccaggcttctgggaacaggcactgggactttttccccccacagccttcttagcgtctaatccgtcactgacttgctgccccgatctcggcacttaagagaagtttaaacgaaaaaaaattttttttgagacgggggtctcactctgtcgccgaggctggagggcagtggcatgatcttgactcactgcaacctccacctcccgggttcaagtgattctcctgcctcagcctcctgagtagctgggatcacaggcacctgccaccacgcccggctaatttttgtatttttagtagagacggggtttctccatgttggccaggctgctctcgaactcctgacctcatgtgatgcacccacctcggcctcccaaagtgctgggattacaggcgtgagccaccgcacctggcctatattgtcttctttctggagaatttgaatgcctccttgaccacttccgctccttcatggcagcactgcccactccagggagtgccactcccatgagaggctgtgcccatgttttctgcggagttgtctttgaggccctgaccctgcccagcattgagcatggctcctaggacttgatagagcccgaaggtttgctgagagctcccaggatggaagggccctggcaacgacgcggttattcatctatctggccaagacatccactaggtgccttctgcaaactgagcaccttgctaggcactgtgggatcaccaaatggggagggcagcttccgccttccagagtggacggcatcaggccctgctgggagggatggggctggaacccacttctctgtggcatgtgccagcagcgggccccacctacggtttggcccatggagatgaccgtggcccttgcctggaggctagtctgaagtcaggcttctgccagccttctgcatctggtcaccaccctgtgactgtgacacctctgaaatgactcaggcgactctggtatatctcctggagtgccacacaattgtccatgggaggtcacagtcactgctcctgacatccaagacaaaccgagggctgcagcgtggctttcagttgaccctaaccctgcccccctcttccttctcccaccccaaactgacaactctttccccagcccaataagaatgaacacagggaggccacgattcaaccaagtacaaaggcagcttgctttattcttgagatgcagggggggaaggggtggtgcagtctgtctgcctccaatctggggctctccaagcctaaggggcaccccacaggcagcctagttcacacgtgcaaatcctgaggaggttgggggcctctccttcccagtcagcccaccgcctctcactggggtccaggttgcggatcgccaccaagtcctccccaggccgcatggcccgaggtcttccactgctgctcatggggcttggtttctagagccctcaccatctaagcaccttcctcagttcactcagaagagaagcccctgctccagatggtgtggggcgcagaacgggctctgtgacttcttggtggacaccctgcaggacccctccgttcctgcagtcttgctctctctgagtcactggggaaacaggtgccccccagaggctccccgttcccacacctcagagtggaagccaccagaacagctgcttcccattcctcccacctttccctccccttccctcccatccatccccagccctccctcccactcttcctccccaactcccttcccagccatcagtggagaggggagttccacttctgccaggctgcctgaaggagctgccagcccccagggcaggtccacaaaacaaaacaactattggcaagcacagaaagggagaaaaaccacaaaaatcaggggtgcctttgtctacaaataactgcagtgcgcagcggcggggagaggccgcgctcagcagcgaagccggacactctcttgtgctcctttcagctcagcttccctgtctgcaagtacacgggtcgggtggagagagcactgggtgtgtgtgtgcgtgcacgtgcaagcacacgcaagagcatgggggatggggaatgcacacgcacagctgaaggggtgcccatcacaggtgtgcccccagtgctggccactggcatggtcactttacttgggcagaaggaagaaaagcgtcccttctcctcaggggcttctctctgctaacaaagccctgtgcgcacacccagacgaggagatgtgtgcgtgcgcacagcgagcacgcgcgcgcgcacacacacacacacacaatctctataggagagtgagggccggggccccagggggttccctgggcctgggccgtgtacccgcccgggcagctcacacggtggtgactgagagaagagggttgtagacccgcttgccatcggcggagcgcgcgccgtgggccagcatctcctggatggtgatccagttgtccaggatcttcttgttccgcttcttcatggttttgcggtggctcagggcaatgatgttgagctcgggcttgctgtcgccattctgctgctcccgcaggcactccagccggctctgcatcatgaactcgcgccgcttccgctgctcacgggcccggatcaggtgctgcttccgctcctccttgctccagtagcggcccatcttcatctcgctcaccgcgtcgtcgtcggtcgtcataccgctgcgctcctcccggatcttcagggcacgggctttcagcagccgatctcgcacgggccgcttggccacgtagcgggttccgtcgctgcgcaccttcactttccactccatgcgcggtgcttcagtggccgcggccgccaccccgcccacccgagggccaccggccaagctcagggggccgtggcccagctcctccaggcctcgcgtcggggccagctgcacgcagctgtggtagtgctcgccctcctggccctggccgcggtggcgccgcgagaggtaagggctgctttcagggcccacacgctccagggtcaaccccgtcttggggttgcggcggccgcgctcctccgcgtgctgcctccggccggcctcaggatcccgggagagggaccggaacttggcggggctccccggtggaggagctgccttggcgggggtggcaacagcggggccgggaggggtccggttcaagttggagttgccggccatggcccgccgcagggggctctcgggcaggggctccacaagcagcggggtgctgcggcagctctccccagtgttgtaggcgctggtgctgtccttgtccgacttctcgggcagctcggagatgtcggacagctcgtgcttcttgggctcgctggccgccaggtcgtagaggctctcctcctccagcagccaggccttcatgcagcgctcacgcagctgctgcatcttctgcgcccgcagtatgttgcggcacttgaattccaggtgccttagctcctcctccagcatggccatctcgtggcccaggctctcgttgcggttgacgtccagggcgctgttgcctccggaggcccggggaaagaggaggcccagctggttgccgttctccaggtggcacttgatctccaggagctcacggtagcgctcatactcctcatccgtgaggcccgggacgtcgccccctcccagccccgccccctcggccagcagagagtccatgctgaaatggaagtcccggctctgcagggcgtccccttgcaggccaaacttgcgcaggcttcccggggtgttggtggagctcgggggttcgtcccccagcaggtcgtgctcagagctctcttcgttccgggtgctctcgtcagtccggcccaccccgctgtccagctcctggctgttgctcaggcctgggccggcatcgggagcccccttctcctcttcgtttccgggctagagcagaaaggtaagtaccgctcagttaggtcccacggacagggatgtcacgggatgtcacaggaggatcggaaggggcttcaggcctggttcatttccctgccaagcattgggagaccctgcacagcctcagcgccttccacccagttctctcctcctcgccctccccaccagcgcccttttccttcctcacctgctgggcagggggtgatttcagtttacgagcacgcagctccccctcattctcagagccaaagtcatccaggaagtcatcccggtcgctgtccttccaccttttcgccagctgtggagacaggccctggtgtccccacagcttcaaggacctccccatatacccttcttgtctgctctggaccccgcacttggcttgtttcggtgaagctcagcaacctgggggcagcgtcccagccccctcagccttcagaggccaggaggggaaacgggccctgagagacccctgcccacccgccctccatcaactccaggtcgttggcacatctgtgccctagtcacggccagcagcttccaagacagaaagcctgatgtcgtggccccgggtcgccctgccaggcatacacacctgactctcaggtcgggccaccagcagggagatgttggtgttctcttcctggctcaggatggccaccgcctcttcccggttctggacgtctacaccgttaatctgaggcaggcaggatacaatcaacaagcatgctagggctggccctggggcggaccctgggcgggtgcagggagcccaagcactctgggctcggctgggctaggctggggcttgagctctgggaggatgtaactaagtggaaggtaccagggagagggcggcctgactcttgcaagagcaaatgtgtgctcaggagagcatggagtggggcagagggagaggggccaggaggtttcagagcagcaggggccctggatgccagcagatcccataggcacacgggagccactggggtgagtgggcaggagagagatgagactcagcccgggtttaggacacggcaggctgctgggcctcagggttagctcttagtgggagagagctagggactggctaaagagaggtggctgggccgacgggcacagcggggccttgggccaggcctgcagcctgcaagtgctcacctggatgatgcggtctccctcacggatccggccgtctttggctgcaatgctgttgggatttacctgcaggacacacgcatcttggggacttggtgcctaacatgccctttcggtagaagggggcaggctcacctcaggggcccccaaagcaagctgaaggctctctggctccccttccagctctgagccccaggaagcagaggcagaggctgtggagtagtcacctctccccgcccctgccctgcactcctaggctcttctgcacggaagcctgtgcttttggtcagccccgggcattggtgggaagtaggacattgtccatctggaagggtggctttagtgggatgctactagtagggaggggagcgaggggccatccccctcctggggatacacaagacatctgcccaagatgggttcgggagaaggctagacagcaaccctgttgctagttctcaggcccatctgctgtcccacccaggcacaggcctctttctgcagatgactacctcactggacagtggctgaagccgtcgaccatcatcgcctcaccacgcagcaccctagctgtgatgccctgtttctggtagctgggaccttaagggcagcctctgagccacaggcaggccatgtggatgggcctcggggctggggcatacccgtctgcatacctctccgacataaatgcccaggtcctcctcgtcgtccgtgcggtagcaaaccatcaggcccagcttgtcccggtggctgcttttatacagctccacctcctgccacgaggggtccgggaggaagcagaggtagaaagccccagaaatgcgtgagtgagggagcaggcagcacagcccagcccctcagcccgcaacccctcagcccgcagcccctcagcttcctctggagccccctgagctcagtttccaggccccgctttgagggtctctcttaccatcccacgtggcgcacgtactcagtggtctccctcccaggaaatgcacgaggcacacacaggcacaggacacagaagacagacgtgcatgggacgtggactcaccgacatggacggaacacgtaacctcacccgcaccctccctgactcagccagatgcgtgccaggagggccacggggttgggcctgggcaggaaggcacacaggcgtcggggcggctcccgcagctggctgcgggccctggcctggccacccggctcacctcatactccagctcatccaagcggtctgcctcctgcgggccgccctccataaactccgccgggtcataatactcatggctgattggggggctgcccaggagaaggtgggggtcagaccagctggccatcctctcacacctcagccccagctcccaggcaggccgatcccagcgtgcctggcacggaggcctgctctgcttgtgctctcaagggtgggtggcccagttgcctcctgcagagccccttcctgggcaacatgcagccatgcaaagaccgggggcacttctcgcacctgagtgtgcagcgtccacgcagaggacctgcgcatgcctctagcgttcccgtcccccagaccagaactcctccaaccacgccagctggcagggaccaacttctccaatctccgggtgcccacccgcccgcccagcactggccccactcatgcaacgcccccaggagttatccaggccctggaggacttctgcagagcagaggggggcccaccctacctccaggggctgccctcctggccccaaaactaaggttggctgctcatggccctgtggcctacctccccgcagcccgggctaagattagcagaatgaggcagcgctcacgcggtcatgagccaccaggcctggatgaaaggcccttcttccggtcgggccaaagaaagaagctgaagagatggaggaaattcagagcaggtagaggaatgagacagacaagggatgcaagaagattcaaggagtgatgcttgtgaggcggcagaggagagaggatggaggaggaggagctgaggccctcaaccctggcacttccggcagcgacgtcccggacaggagggtcctccctcggccctgggggtagatacaacggggcgcctgctggagcccggcccaaggctagaggcctggaggttttggagcccttgggtaccacggtcagttctggaggccgaggggcctgcttcctgcccgagagggtggcgtgcggatggccgctccaggtggcctgtcctctctggaggcagggcccggggccctcctgagggcgactcacagctcagagaggacgtacggctccaggatgaccatgggcggggtgggcggacgcagcttgcccagcgccatgatatgctcgaaggtgatgtcggtctgagtgccactgtccaccagctgcaggtcgtgacaggagctgtccccccggaggcgggggctgcgtctcagcacctggatcaccaggggctccttggaggagcgcagggcctgcagagtttgctcctgagacagcttggagagctccttcccgttcacctgcggcagagacacgcctccgtaagaaccctcaaaggcttgctcctcccctctgaggtcaaggcagaggccctagctggcaggacctgggctgacaaccagcaccccaagccactcaagcaaggaatctgctgtctgcagccctggctacctttggtgcccctgttcccaggcaagccccactgctcagccttcatcccactgaaggccagctggggatcaccaagtcacaccaaggactgggggacccagcctctgtgcactgggtctggaggctgtgataccgccctacaacgtcctccagacactgcttgagctctcctggcctctccccatccggacccacttctttctagggcggcactgaggccagagctagcatgaagatcccattgagttccttggcaatgactggaccataacagccaacactcagtgagcatctgtgttgtgctcattcagcatcaagcaagaggatgaccttgactcttcagatgagccgagtctctcaacaaatgtctactcactagggagggccagggtcaggttgggggacaagtaggaagatgcctaaagatacagtgttgtgtcctcacagtgacaactgacttgcccaagagaaaaggccttgatgtacaagaagccccctggaactgcaaagtagcctaaaagaggtgccaagaaagtggtccttataaagccaccactaggccgggtgcggtggctcacgcctgtaatcccagcactttgggaggcctaggcgggcagatcacgaggtcaggagatcgagaccatcctggctaaacacagtgaaaccccatctctactaaaaatacaaaaaattagccgggcgtggtggtgggcgcctgtagtcccagctcctcgggaggctgaggcaggaaaatggcatgaacccaggaggcggagcttgcagtgagccgagatcgcaccactgtactccagcttgggcgacagagcgagactccgtctcaaagaaaaaaaaatgccactactgttttttgggcacgtgccatgtgctacattctgggaaagacccctgatgtgggtctccacaaaatcctaacccccaacaaccttgagggagatgccattattgcagatgaggaaaccatgtcagcaagctcagcaaggttgtggcactgagtcaaggtcatgagccaggacaggctgcccggtggccagaaggaggggtcagggaggaggaggccatcgcgggccagggcccaaggcggaagtaggacctaagcagctctgcgggatgctgtaggggtgaaggaaggacaatgaagggtagcagaaggaagcccattacgcacagcgcaggtggtggggcaagcagtgcccacaaggtcgaaggctgcttccgcagcaccctgggacagtatgctgcgaccttcaagtcctccttggggaagggaggcaagtagagaagggacgaatgactaaggaccaagaaggactgaacagactccaccagaattcagggcacgtgccatggggccagcaagggtcagcaggaagcacttctaggaggaggcagctcgaggcaggcgtgcagggtctcctcatgggctcagcggcttatggaagggctgttctgggcctggggaggctacacactagcattatgcccaaatggctatgccccgcaggtgagcgtggggacagaccttacccacagctaagggagcacacggctggccatgcacgcctcggtgggaggcggggaaggcttctggagcaggggacacctggcctccatcaggcaaagggaacagggccaagaaaagacccagggaggctggtttgcagttggaagcaaagcccccagtcagcacagagagggcagggcgaggagacccagagtccgcctagggatggagcaggctgggagcttgtgccagatgagagggcagaagggccctgggcatgggcgcaggtggctgcgcctgcacggagccctctgcttttccgagttgtgcgaatattagcaagtttagaagaactctctgtcctgcattctcacggcggcacctcccaccccgggtttctcacagagatgtcaattctgacggcaaaatcttgtcttagtgcccgcgatacagtagaaccaccgctgtacgagtcttttcgggaagacagctatctgaggagagcccagcttgtcctcggaacccctgtggcctcagcagcggctcctgcattactttttttctatttgactatgtccttgtagataatcattgaagttttctatgtctcccttctccccaaaattttcatattctgaaaagagctttttgtcaaaatcagttttgtccgattataaaagaaacacagttcatttttttgttttttgggggcttttttttgttgagatggagtcttgctctgttgcccaggctggggtgcagtggcacgatcttggctcactgcaacctccacctcctgggctcaagcaattctcctgcctcagcctcccaagtagctgggactacaggtgtgtgccaccacacccagctgttgtttttttttttttagacagagtcttgctctgtcatccaggctgaagtgcagtggcataatcttggctcactgcaacctctgcctcctgggttcaagtgattctcctgcctcagcctccccaatagctaggattacaggcacccaccaccacgcctggataatttttgtatttttagtagagatggggtttcactatgttggccaggatggtctcaaactcctgacctcaagtaatcctcctgcctcagcctcccaaagtgctgggattataggcatgagccaccgcacctggccatgcggcctgtttccttccagtctgttttctatgtgtgccattttgcagctgcaggccccttaaggtccatccacaccaacacaccagtggaccatcatgttcatcatcacatcagtaagggtggctttgattttttattataaagaatgtggcaaagacacattctggggtccattttatacatttttcatacttaaatctttgtgtaaccagtggttgtcaaggtggagaaaatttcttgaggtggaatttctggatcaaatactataaaggaaacagctttcagccaagaaggtatttgttggaagaccgtaagaatgtcagtcaggacagggcatgctgtgcttggtggagaggctacagttagaaaggcaggatggaagagggtgggcggcagcagagtgtgggttcaggaaggctgtagacaaagggacatgatggaatggcctcgacactctcagcagcagtggctagagccaactgaagctgggaaatttggaagccagttgtcaaacacagcgattattggtattttaaccgtagaaatgtacaggtaactgaatgatattaacaacaaaggcaataaatcctcggaacacatcactgtctaattatcttactacacttttctgtcatctgtgcttttggggttattcacatctggtatgggagatggaaatactatgtgtgcattcccccaactccaagttcagtgacatcgcagtggtggcttgaaatcggctatagtggcagcatttacaccagggaaatcggcaaatgctccaaatcagggctttttgtctgggaacatttaccaccttaccactgcccttgaggagaagccaacacacaagcagaagggctcggagctgtcctcagggtttcttcctgaactcccggggcaggacagcaagcaggcagtgggatgctcaggtgacagagatgacagagaacgcacgaatgcctttctacccggaatcattaccgagcagcagtgttgctatggaaactgaggagcgcttgctgggcgggctggcggaggctgggatgtcaagagggggatgggcgtgggcacagcctcagcacctcggatcagcagcaaccagagtgatcgcctgtgacagccaggcaggtatttgggtggaagccacgggctcctgaagccttctcgctctctctctctctcctcctcatcggtcatgctggacccccaaggaagaaatgagctcccctctggggaagggctaagggctaccaacaaggtgggaaaatatggggccatgagcaaagaggtatagggccaggcacatggtaaggagccacactgtggcccttctgatgacagcagctcttccagtcctgctcagagccttgcctccccgccccacccccaaccatcctgaggtagcacactggtaaagccacccctgtaatgccccaaccctcggattgcctactcgaccactccagtctctaaaaggcacaaacactcaacatggccaaccccaggcttgcttcccaccagactctccctcctgccccacctgcaaacgtttccacaccctgggagctcgccccaccaagacagaagacctagtccaagccctggccaagcaattccaattggatcaaagacctacagggacaaagcaaaacaagagaacaatatctttatggtgtgggatagagacgaaattctcaatatttcaaatggggaagcaataatggaagagatgtaaaacttctagacgacaaaagacaccctaaacacagtaaaaaggcgggctcagaggagagccttacaatgcatggacctcataatgggttttccagaatatgcaaagaattcctacaaaacaacaagaaaacacagacacaaacaactcaagaagaacatgggcaaaggatatcaacaggtgctcagggcaaaggggacccactagcaagcacttggagccatgagatgagaggagatgcccttcagaaccaccaccaggaggaccaggaggatgtgggcatgaaggccacagtggccaaacaccagggacagcccaaaggtctgccagcagtcgaacaaacaattcctggtattccgcatgtgcagttaatggaggcgcacataatggaggctcattcgtagtatgtacttggtggaaaacacggcagagaggcgagcagatgaagtgcgtaggggatgggtgggcacaggcggcttcaatctgcttttaataccttcttcaaggaaaaacgctcaggccaacaggacccacatcaaggctgggtggcagtgctggtgctaagtgatgcgagatgatgccccatacttctccagatgctacagcaagtccaggaggcctcaagatacccaggctggagctcagccttttatgtgtgattgtctaattacctccctttcattagacaacaaaccccaagagggcttcaccctgagttctacttccatcccaactcctaacagtttgctgaagataaaactttaatatgtttcttggctgaattaaaattttatatatttctgtaatttgttgaatatatattaaggacctgtaatttatctgatctaccttttaaaaaataataataataagagatggggtttcaccatgttgcccaggctagtctcgaactcctgggctcaagccatctgcttagtccccccaaaagtgttgagattacaggcatgacccagcccctgagtctgatgtacccggactctactaaaaatacaaaaattgcccagcacggaggctcacgcctgtaatcccagcactttgggaggccaaggcaggcagatcacctgaggtcaggagttcgagaccagcctggccaacacagtgaaaccccgtctcaactaaaaatacaaaacttagccgggcatggtggtgcacgcctgtaatctcagctacttgagaggctgaggcaggagaatcacttgaacctgggaggtggaggctgcagtgagctgagattgcaccactgcactccagcctgggcaacagagtcagactccatccaccccccaccccccccccaaaaaaaagtctccttcatcaagtgcaaacttctctcctttggaacaatccagaagaaatccactttgcttctctagtatggggagagtggggattgttgactgagctcattatcggaaaactctcactattgaatgtttccttcattgagagcaacctccctcctttggaacaatccagaagaaacccactttatcttgcaacacttcacgtacctgaagcccactcaaatgccccttgtcccccctcgcccaggttcccagcgactctcatcttctccagtgctcccgtgccatcctgaccacgtgctgggcatcatgcttcaccttagcgaggtcaccccgtggcagtcaaccctgttgactgggtagtgagctgtgagccaagcaaaccctcaaagcctgttcacaaagacccctcctccatcacgtgctagcacaatagattttgtacaaattttcgcatttcctttcaaataatcgaagtgctcagagcgccacactgaggaggcggaggagcacaaagatgaaaatacaagtccctggcactccgctgccccggggagtgcagcagcctgtgagcacaccacggctcagccaggggcttgacgtgccccatggcgactcttcagcacacagatctacttccttcctgatttgctgccaagatgggcccaagagggctgactctaggactgcagctccaatctcaaccacagttgacatgaacgtccttaatttccaccatggtccctgctctgaacaggggactcaagccttagcagggcccctctgcctgaatgtggcccaagtggccctcacatcctgcttgggacagcccagttcccctttgcacactgagagcactcactgccccaggtcccctgcaagcccagttcctcctcccagccgaccccatcaccctttctagacacacttagtctgaatcttaccccagagtgtaaagtggtcaaatttctggagaagaatttgtcaataactataaaaacccttgaaaacgttcatggtagcctttgatccagtcaatgtgctctaagtaatttagtctaaaacagtaataataataatggatattacatgaatttaattacaaggacgtttacaatttaattacaaggctgtgggctccaggtcggggaggggacctggcggcctggaaggggacctggggaaggaggaatgaagcacaggccccacccctccagaggaggtggccccaggccttccccagggaaccctgggaagctggttctttctggaaggctgcagaagggcctggccatgggtcctggaggccacttaggctaggcgggcctcaggccaggaggactgagccatgcgccctccccacagcgcagcccctctgcacacaccccgcagctggtccctctaagacttgcggaaagggctctgagtggccgagctgtggcccctgatctcccaacccagcatctgagcagaagaggacaggagctggggcactgatcgccccaggcccggtcggcagggtgggggccagggccggcaggatcccgggttgcgctgccttccgagggagccggtgcccacccagcggcctgcagcccaaggcagggtgccctgagaaagccaccgccacccccagcccctcggtgtgagcaagacccccagctggtgggtccccacccaccagtggggctcccaggcctgtcgggggctcggtggtgggcctggatgctaggggggcaacgtgcggcagggaccaagctctcccgcccacagatgagtgggagggggtcgtggtgggcatgggaagacctttccaacaatcaggtgtgttggggggtgagcaaggcaggggaggggccctggcaggtggggtgccagggaccccagggctggggctaggcctgtgggtggggcgtgtgctggggattctgtgggccgaggacatgtgactcccgggcaggctggagatgctggggggtgggcccgggaagcacgggagatgagggaagaggggggaatcctgccccacctgccctggacagggtgccccataggaaaggagtgccaaggagctgaagggagagacggtggatccagaacacaccccccatcccgttccgctccccaaggggcttggttggaaggtgggaggggacagagacaaagctgcctgggtgggtagagtggtcaggacagcctctctgggtcggtgacacttgagctgagacctaaatgatgacaagaaaccagccatgcttccttccttgtagcgaagggagctcccaggagaacagactgtaagggccagaccagcaggcaacggcagtggtccagaccacagatgatggtggcatgaccccaggggtggcagtagaggtggtgggatgtggtcagagtcagcttgggttttagaggtaggctgccaggacctgctgttgggctgggggcaagggacagtgagggcttgaagaagacatcgaataagcgcaggaaaagacgcgtcagcaccggccagtacgcacagaggaaacacacacccaaaccacagtgagataccgccgcacaccacgaggaggctggaatcagtgaaaggaagcacgagtattggagaggacgcggggaccctggagcctcacgccttgctgctgggcatgtaaaatagtgcagccagggaagcagtctggtggctcctcacaaggttaggtgtagcttatgtacatgacccagcaatccccaaagaactgagaacaggcgtgcaaagaaaacttacactcaaatgctcacagcagagtatccatagttgagaacaggcatgcaaagaaaacttatactcaaatgctcacagcagagtatccatagtaaccaagactcggaggcaacccgtgtccaccagtggatgaatggatgagcgagcacaacatggtacacccatcccgacataaaaagaatgaacgaccggcacacacgactgcatgagcacagtctagccaaggcaaagaggcagacagaaagcagacgaatggttgccaggacctggaggaaggggggcctggggagtcactgctgagggatatgaggtcccttttggggcgatgaacctgttctggaactagacagtggccacggctgcacaacattgagaatagactaaaagtcactagtggtaaatgttatgttatgcgtatcttaccacaagaaaacataaaattgccacacaggaccacaaggaccaggggtatcctcacagcagtgaggaagaccgaggaaggaaggactcagggattaggcccagggcaggaaatggaaggtttttatctctagcttgaacttcccgaggcatgtggacatctccagtgccccactccaaatgtctggcccaagcccaagtcagctaactgggtggcatgtgaccattgctgttcaattaaactaggaatttttctttatttaaaatcataagatgacggccaggcacggtggctcaagcctgtagtcccagcactttgggaggccgagacagacggatcacttgaggtcaggagttcgagaccagcttggccaacatggcgaaaccctatctctacgaaaaatacaaaaattagcagggcgtggtggcaggcacctgtaatcccaactacttgggaggctgaggcaggagaaccactggaacccaggaggtggaggttgcagtgagcccagatcacaccactgtactccagcctgggcaacagagcaagactccgtctcaaacaaaaaaagaatcatgagatgaagctgggcgtggtgtctcgctcctgtagccccaagtggtggaggaggtagggggcaggcggtagggctgaggcaagaggatcacctgagcattgggaggtcaaggctgcagtgagccgtgattgtgccactccactccagcctgagcaacggactgagaccctgtctcaaaaataataaaaatttaaaaataaataaataaaaatttaaaaagcaaaagcatgagatggaggagctcacctagggagtgaatgtagtcaagaacaggagaggcccaaggagagtcctggggcaccctgacactgagccggttggggagagagactagaaagtcccgggagggaagccgaggagctgctcaatgcactgggtcggagcccgggaggggagggcgaaggtggggcctctggatttgctaaaaggtgggagggggccgggtggggaagctcgacctgcatcgacacagccttccggagctttttgcagagaaggagcaggttgggttttcaggaacatcagaggggcggctgaataccgatggaagagcaattcgcaaggccagggaaagtgctggcaccgctttccccgcatgagggggacatgcgggcaagggaggggggacacagggacaggggagggggcaacaccgggcaggcgaggcaggcatgacgcgaagtcggccccacgggcagtcgctgtggggcggcgatctcccgctgggcaagggactggcgggccttaggggacgcgggaagcggggcgccctaggcggagagggcggagccccaggcgcgctcgccccgccccctgagcccggagccgcagacaaagagcgcgccgcgacggcggcggggtggctgcggctgcgggagcagggcggaccacactcgtcccggcgccgccacgctggtggctgtattggcaggactcctgcccgcccgccccgccaaccccgtcggaggctgagctctgtttccaggctctgccccaggcaccctcctgcacccagcggtggcaggcgcacagccgggtggggcgcgacgccctcttgctgatcaggaatctctgggaagccgagaagagaggccggagaggctaagaaaacagttgtggcctgggagactcgcaatcccaagtgcttgtcacacggcgcctgcgacccctttcactctcactggcaacgcgcgggatgggaggtgaagccacatcacttccaggggcccccgtggctgccacggaggtgggggggctgccaccttcggactccccttaccccactgctgtagagtaggaaacaagctggggaaggacagagacaggaagttatcctctgcccggggccgagctctgacctgcctgctggctctcagctctgccgtctggagtatccaggacaccttggaagcagttgtgactgtagcttccaggccaagtcaggcatcgggggatctcccaacgagtagagcatcagaggagaaaggagaagccgcaggctcactacattcacccactcagtgacccagcaaagtccccattcatgtttccccagctcgggattttgaaaattgtccgcccacaagcatgtgggaacatctgcagattccccacacctgctctcggggtttctacacacacatgtgcagaagcatttgaaagcaagatgccatcagtcccattctccgtggaaccacaacacccttagcacggaattccgcactcatacaatgggccagcctcacatctccccagctgtcccgctaacacccttatagctttttttaaaaatctaggatttgaggctgggcacaatggctcatgcctgtaatcccagcactttgggaggctgaggcgggcagatcacaaggtcaggagttcgagaccagcatggccaatatggtgaaaccccgtctctactaaaaatacaaaaattagccgggcgtggtggcttgcacctgtagttccagctactagggaggctgaggcaggagaatcacttgaacccgggtggcggaggaggttgcagtgagccgagatcgtgccactgcactccagcctgggcgacagagcaagactccatctcaaaaaaaaaaaaaaaaaaaaaaaaagcgaggcgtggtggtgcagcctatggtcccagctacttgggaggctgaggcaggagaattgattgaacccaggaagcagaggttgaagtgagctgagatcacaccatcacactccagcctgggtgacacagagagactccatctcaaaaacaaaacaaacaaacaaaaaatctaggattcaatcaagaagcacacatattacattcggttgttaggtctctagttattatgtctcctctctaatctagaaaaaaatatatatattttttactttaatgggaatgacttcttggaagagaccagtccttatagaatgcgccagagtctgaatttgcctgattcattcccgcggtgagattcaggctgagcgttttgacaagagcaccttgcaggagatgctgtatgtctcctccccagccctgcatctggcggctggcagggtcaggctgccccactgttggggaggctgtttgatcacatggtccaggtggcagctgccagatctctcctctgtaaagacgcagtttcccttcctgattcacaggtaatttggggtaatatttggagactttgtgaatattctgtccccaacgaccttacatctaatggttttggcatccagtgatgatttttgcctgaattaattactgcattggtggctgcaaaatgtctccaccaacatgttagaattctagcagggacaaagaggtgacaggcccggcaagtagcatggctgcccacgcccccaactgtggcctcctgggcaagccacaccacccgcttccataactctgtgcccaccctttctgcctgggggcaggagagacagaaacatgggagggcttcatctcaaaggcctttgagcacttagtcgggggaggggtgtctgggcgtccatgagagacatgtataccggtaggggtgccggtgacagggaagggggtcagttagctgcacatggcagggaagaacaagttatgtcctgtaaagccctcacgtaggcaacgactcctggatgttctgatttaccctctatgtgtgtttttttaccctctatttgtaaacaatttttaccctctatttgtaaaaaaaaaaaacaaaacaaacaaacaaaaaaaacaacacctcacttcaccacccatgttaatgtggtttggggctaccatagatctactcccggtccctacccaaggccctggctactcacagccagtgggatccacatcacctgggagcttgtgagaagtgcagaatcccaggccccatgctagtggctcagtcagaaagtgcaccttaacaaggacttcgggtggagggtggcgctgtactgactcagagcgcgccctggaggaaccagggcagacctcaacgaaggccttctgcatgagggcatctttctttcccctcacttctccttccctccccgaagcccagggtctgctgaagtctcatcaatccacctggcccccacctttccgggagagcggcggcctctcagacacctccatagtcctggctcagaagcagaaaggaggccgggcgcggtggctcacgcctgtaatcccagcattttgggaggccgaggcaggcggatcactagaggtcaggagtttgagaccagactggccaacatgatgaaaccctgtctttactaaaaatacaaaaattagccaggcgtggtggcaggtgcctgtaatcccagctactcgggaggctgaggcagaattgcttgaacccaggaggcggaggctgcaatgagccgagatcacaacactgcactctagcctgggtgacagagcaagactctgtctcaaaaaaaaaaaaaaaaaaaacacacaggaaaagaggggtgtcccacaccttgcacaggaaaagccaaccacttcctgaagccattctcaagatcaaccttcgggtacatattcacagctttccaggcacgtggcccagcaactaaacccatcctcccacccacctcaggctaacctgactggctaagggcacagttcacatctagcaacaatcaaagcaatattccctctgcagcgttttacaatcaaagcaatattccctctgcagcgtttttcattctcaatgctccaagcagccatgaggacaggcagaatgcactgaaagggaggacatcttgtccagccccaggctgctcagcctcgcctcctccggcccaactcctgtgcaaaatgaccacatatgcctccgctttgttccctgtccatctgttttttctttctctctctctctctctctccctccctccctctctctctctctctttctctctgtctttctttcttttttttccagacacagtctggctccattgcccaggctagagtgcagtggtacaatcacggctcacagaagcctccaactcctgggttcaagcaatcctcccactcagcctccccagaagctgggactagaggcgcatgccactacgcctgagcaattttttatttttgtagagacaaggtctcaatatgttgcccaggctgtcctaactaatattgtactacatcacacttcttcaaaacttggaggtccctttcctgagagaaattctcagaataatattggacattcttctgtcactgggcattaactgtgacatacccagatgtaaggccttctccatataatttcctttttcattattttttatttaattaatttatttatttgagacagggtctcgttctgtcacctaggctggagtgcagtggcttgatcttggctcatgcaacctccacctgctgagttcaagcagttctcctgcctcagcctcccgagtagctgggactacaggtgcatgatgcccagctaatatatatatatatatttttttttgagatggagtttcgagcccaagctggagtgcaatggcgtgatctcagctcaccacaacctccacctcccgggttcaagcaattctcctgcctcagcctcccgcgtacctgggattacaggcatgtgtcaccatgcccggctaattttgtatttttagtagagatggggtttctctatgttggtcaggctggtctcgaactcctgacctgaggtgatccgcccacctcagcctcccaaagtgctgggattacaggcgtgagccaccacgcctggtcaattttttgtatttttagtatagatggggtttcaccatgctggccaggctggtctcgaactcctgacctcatgatccacccgcctcggcctcccaaagtgctgggattacaggcgtgagccaccgcacccagccaatttccacttcttaatgaccaactgaatggcccgagggcagcaactccctcctccacccagtgagatcccgggggacacaccatctgttttccttgtcacaatggccctcggacgcaagcactcttcactgccatttcacagttgaggaaactgagtcactgagccagtgggccatgcagcgacttgcccctggccacacagctgtcagttggtggctgcctccattcctatctccacactgcactgccttctctggcagggcccctgaagtagaaggaaggaaaggacacctttctccccaggatgcgtgcatgtggccatggagttcctgttctaaagctttggtgaggtctgttgctgggtggtaacctgcacatcttcagtgtgcaaagggcaggtgttcatatgtcatacatgaacctggggaaccatcaccaccgtcaggacagtggccatttctatcttccccaaaagtgtcctcatgcccctctgcccatccctgcaaccacgaatctgctctctggcactatcgaatttcatttcagcagactggacagtcctcaggaaccccgagatgagaggggaaagggcattctacaatcttgggacaatgacacaaaacaggatgacctggtccagaagatggcagtcagaattcagtgtccagccctctgttcttccactccacaaggactttctcagagcctgcttcttccccagtcagcttctgcggcagaaccactgagttgactgagagtccagctttcccctggaagggtggaggccagcgtggatgtgctggcagcatctggtgctggtgaggcggggaggcagagtgcccatgccagacccaaatccctgctcacaggaagcccccatgcaagcaggagggagccagagaagccacctggcttggtgggtgggagagcagtttggaggaagacgtcgctgaagaggggacactggctgccagccacgctcccgcactcaagcagtactttctctcccccgcagttgcctacatgttggcgatggtctcccccttacaaaaaggggagcctggggccaggcgtggtggctcactcctgtaatcccagcactttgggaggccggtgtgggtggatcacctgaggtcgggagttcaagaccagcctgaccaacatggagaaaccccatctctactaaaaatacaaaattagccaggcatggtggcgcatgcctgtaatcccagctactcgggaggctgaggcaggagaatcgcttgaaccctggaggcggaggttttggtgagcccagatcgtaccattgcactccagcctgggcaacaagagcgaaactctgtctcaaacaacaacaacaacaacaacaaaaggggagtctgggggaggggcaaggccctgtctgcagtgtctccctgctgaatgccacgcacccaggatggctgccagcaccatgggggctcacatgcaggtgctttaggcaagaatgcctgggagatcaccagaagggctggccagctgtcctttggcctccctcgatgtggacagaggggagatgacaggcggtcctgacccactccccctgtaaagcctgagtaggatgggcgggagaccagtcctaagtaccaggggtttatcccctgaccatctccggcgtgctcggatgctagcaagcacatcatggtgtcagagagggggtgccaaggccaagacaagttcagcagagtgtggaccacgatgagatatatgacaagggggcctggtggcagtggagggacatgggctgcagaaaaggctccggagctggggacatgctgtttcctgccttccattctgggcaaccagcctgcttccttttcctaactcaacacgcagtaatcctccattttcaggggaggtcccagattttccaaactaggaggacatgattggaatataggaatggggctgaggttccgacatgacacacgaaagtgcctgtgacaacccacatccgtggaataaaggaaccatgtggtcatctcactagccacagaagcagcactgcacaatccaatgcctctcatgataaaaacacactaggaatagaatgggaacttccttaccctgataaaggacagctatgaaaaagccacagctaactttataccccctagtgaaagactggaagcttctttacctttaagatgaggaacaagggaaagacattcacaggcacttctattcaacattgtactagagactccagccagagcaaattaacaagaaaaagaaatcgaagggccaggaacggtggtttacaccggtaatcccagcactttgggaggccgaggcgggcaggattgcttgaggccaggagttcaagactagcctggccaacatggcaaaagctcgtctctgctaaaaatacaaaaattagctgggtgtggtagtgtgtgcctgtaatcctagctacatgggaagctgaggcaggagaatcacttgaacccgggaggcggaggctgcagtgagccgagattgcaccactgcactccagtctgggtgacaaagtgagactgtgtctcaaaaaaaaaaaaaaaaagaaagaaagaaaagaaaagaaatcaaagccatccagattggaaaggaagaagaaaaacgatttctatttgccaatgacatgatcctaatatgtagataatcctgaggaatctactaaacaaattatacttaataaacaattttagtaaggtcgcaagatataggatcaatgtataaaaatcaattttttttttgagacagagtcctgccctgtcacccaggctggagtgcagcggtgcaatctcagctcactgcaacctctgcctctggggttcatgcgattctcttgcctcagtctcctgagtagctgggattacaggcacacatcaccatgccccgttaattttttttgtatttttagtagagacggggttccactatgttggccaggctggtcttgaactcctaagcacaggtgagccacccgccttggcctcccaaagtgctgggattacaggtgtgagccaacacgctcagccaatcaattgtatttctatacagtagcaatgagaaggctgaaagtaaaattaagaaaacgattccatttatgatagcatcataaagaaaatactcatgaataaacttaaacaaaagtgcaaaacatcatgtaaagaaattaaagacctaaataaatggaaaacgcaccccatgctcatgaacaatactacccaaattgatccacaaatttgatgcaatctctatcaaaatgccaactggcttctttccagaaattaacaacctgatcctgaaattaatatggaaacttgagggacttagaatagacaaaacagtcttgaaaaagacgtacaaagttggaggactctcatttccttacttcaaaacttactacaaagctgcagtaatgaaagcagtgtggcgctggcttaagaacagacatttttctaaagaagatccacaaatggccaacaagcacaagaaaaggtgctcatcatttagctaacaggaagtgcaaatcaaaatcacaatgagataccacttcacacccagcaggacggccataacaaaaacccagaaaataacaactgttggcaaagatatagagaaattggaacccttatatgttgctggtgggaatgtaaactggttccagccactgtggaaaacagttcaatggctacaggcacacactccaaagaattaaaagcaaggactcaaacagatacaagtagaccagtgttcacagcagcgctattcacaacagcccaagggtggaagcaccccaaatgctcatcaactgacgaatggataaatatgttgtatatcacaaaatgaaatattatttggcaataaaaagaaattgactattgatacatggatgaaccttgaaaacattatgattaatgaaagccagacacaaaaggtcagtttctatgaaatgtttagaataaacaaatccatagagacaggaagtagattggtgggtgccaggggctaggaagtttgagggagaaatggggatgtgattgctaaggagtgcagggtttcttttggggtgatgaaaacgttctggaattactggtgtgggctgcacaaccttgtgagtatactaaaaaccactgacttgtacactttgaaagggtaagttgtgcagtaggagaatgatagctcaatacagctgtaattttggaagtgttgtgagtcattggcagaaaatggcttggaacacaaggctaggctagagacttgggggttcctggcctggggatcccaggcctctgtggattgtagatggaaggcgctgcagatgcacatgtgcttctttctgaaaatcaggcccatgaagtgcctcaccctgacaaggtgcggacgaggttactcaggggggacagggagaagtgccccctaaagatgggggagcacccgtgtttaaggaggccgggaggcaggcacggggtcccagaagctgacctgtcttttggaacaaaagctccttctcctctgaagaggctgggacctggtgatgcgtccacccccagaagcgcagtcccctgggacagctcatggcttgcactgctttccgtatctacttttttcagtcctcttgttttcccttagttgtgaaggatggttctcctcgtaaaatcccggctttgattgggccaaggaggaatgtagaaagtgaaagtttgcagccaaactcccacggtttcaaagggagcccagcaggaaagcgcacagagggcgcatgcggcagtggccctcctcctggcgggtctccttggggtgggcaagtcccttccatgaaggagagcttagggcgcagagcagggagggcccacccaagttcacctccctgaaggcaggcccagcccgacctgccgaggccttcccggagggctgtggggagccccaagggctaccggtgtcgtcccatggctcatttcaggcctggggtgcagctcgggtcgctctcccctatccacacgtccccacgaggttggccttaaatgaagtgcgacaccaatccttctccaggaaagtcaaaacggccccggaggaatcgcttggagaaatcgcttgccgtttgatggaatgactcccgaaaaggaagcaggaggatgggatccagagtccccgtcaaccaaccatcccagccctggaatccaacacggattccacaggacgccctctcggtcgcattcctatcccgctagggggctggcaatggccacacaaggtttccaaacagcgggaacaagagacgaggagtggcagccgggaactgagagggaagaaggcggaggacagcgaacgggagaagccgagggccccgcgcacccccggagaagggccggggagagaggaccaggagctccgccagggtggggcaagatttgcgtccccgccctgcccctcggctcccgcaccaggtggccagaggagctcggctcacagcgtgaagtcagtccccggattcctgggaattctcccccgtgcccagcccctccttcccccgcccccgcccccgccccggagttctcgccgatccctgcacgggttcccccacgttctcccaagccaacacccctcctgcaaagcacttgattccttcccagtccagaccaataaacccgggagttgaatccaggccactaaacgcatacctgtctgagccctgtctgctcctgggtgccttgaccttgacctccctccacttagccctaggaggtctcagcccacagcatccgggacatttctctagacagtctgcagggtgcacacagaaagtacacaaatgcggggccgggggagcctccgcgcacacagagacggggcacaggaacgcactcacgtagtcacgccacgcacaggcaagaagccccgttccgggccgcggggctgggctccaggtccgagctccgggccccgcgtctccttccctccccgcggggccctgctggtccacgccccgcaaagcccggccaggcactgccacccgcagagagcccaacccgctgatcccggcggcgcccactcacccgagacgcctaaggcccgggagcccatcgttcgggcagggccaggcgggagtgggtgtcggggtgggcacccagcccccggacggacttggaccgcgcccggggacgcccacgcactcccacgctccaggcccgccgggatctagattcggcgccccccgcacggcgggagcctggctccctcccccgccctgggtcctgcggggagagcgtgtgcggggaactgcgctcgttgctatgcaacctccatcccgcgcccgccgcaccgcgcctcccgggacggaagcgcgccccacccgggccaaccccaacttcccaccccacccgtggctggttcccacggagcgccaacacccaacagccccaggatgggagggtgcggacggctccctaccttgtcctcctcgagccctcccgctctcccacgcccgccgctccgggcctccccactggcccgctcctccccgcggagggccgcgcccccgccgcagcgccggcggccctacctgcagcatcactttgtactgctcctccggtttctggaccacgcacatattacatcccatgttgctggccggcgagaggaggcggagggcgggaacgggaagacgcctttcactgacccgggcgcgggacctcgggtcccgggccggggccaggggccataccctggcgcggggggcgggccgcctagcgggggaggggggcacgcccccgaggtgggggcagcggctcgcccctcaggttaactcttcgctggccgaggccaggcgcgggcatgctccctcgcacccggccaggagaaaaagggcagcgggggatgggcgggcgcgccgggcgttgccaggctacggccccccagggagcgcgggggcgcgccgggccgccaggggccgtcaggggccgtgggccgcgcgcctccccgcccgcggggcccgccgctgccgctgccgcctccggctcctgcccatggccgccagccccgggagcccggccctcgcgctcggcgccgcggcccggcccgcgacaggggggcagcggcgcggcggcggcccccgcccgcggccaggccagcgcccgcgctcccgcctcgcccggccgcgctctcggagctcccggcgcccgctcttcgtccagcagccgctggccgtctccagctcccgcccgggacgacgggcacgcgagcgcgcccacggcggcgggggaggggcgcgggcacggggcgcacgcgcgccgggaggggcggggaggggagcggggccggctgcgggagggagcggcgggggcgctggagccggcgcgggaagccgggggcgggcgctcgacggaagcgggcgggggtcctaggcaccccacgacacccggcgtccggtcctgaggggcgggcaccaggcgcgttgtctgcgcgatgccgctctgggagagaggggtcctgccaggaggagcagtctcctgggtcccccagagagagtccgcgatttcagcccctctccccggtcttggacgcagcagccctcacgcctctgctccttcctcgggcttcgccttaaatgactgcatccctccttcaactcagccattccctgctgtctttgaaacggacacctttgtttaaaacaagaaagaaagagagaaagggaggaaagaaaagaaagagagaaagaaaaaaggatgagcgaagcgtggggagggggtgggtcgtggggagagtggcctcggaggccttgggacccgggcctgcacacagcactggccagcctgggcccgccgcctacctgttcctcagccccagccctcacccggtccccgctttcacagcccttccatctcttcctcttctctcccaccacctccccgtcttcttggacaagcctggagggagaaggcctttgcctggaaagcagcagcgggtggaagtctgcgttcccagaggctgccccggctgcaggagatcacttggagaaattgctacatgcttcatttccaggtttgggcaagtgagggaacccccagccacacggggctgttgaatcggagcccttcctttcctccctggctcctcgttagaagagaaatcaagaatggcgggcctgcccagaatgtggagaagagaggcgagtttcttatccagggcttctcccagaaagcagaacttgagacaagggctggtgtgcaggttgcaacctgccacccaatggctggctagtcttgaggaatggcgtcatattgagggctcagcatcggtctctgcagctggtggatggaagaacattcactagcggcagtgtctagatgagccgtggtaagaggaagcccttgccgttgggcttatacagagcctccagccctcccaccatggccactggcatcgtgggtccatcgcatcctggggagaagctggctgacctccaccagatggtcccctctgttcgctagcttctggcgcgccccctccacactgcatgctccccagcggcatgggcgcgaagacgagcacggggccccacactctccctgagcactcccgtaggtacctcttcgccaaacctgtctcttcttccaatcttcctccacccgggtccctgaccagtcagcccagccattttccactgcccgggggtcatggacaccttcatctcaggccatttctccctctacaaagtagacaacctagtgtcttgctcccctagaggatgtcccctcactgctgtctctcagggccaccctgcaaagggcctcagtgtgacagcaggtgtttttcctagtggtgacatgagatgaccagtcgaggacctgggtctgagtcagtcatggggacaccccatcaccacctcccatgaggccataggtgtgagctgaaggggcataccagtgtgaaagagccgggtgaccgggggtctggactgcctgggcctcaatgtgccatctccacctcaatattcagttcacaatgggtggcttgggtcacacaggccctggatgccccatgatcaggctgtaagtctctcctaggtcccagtagcatggccacagctatgcttttttcagtggtgagtgagtagctctgccaccgaaggtgtggccctgccacagcctctatggtccctgctgggatccttccattgaggcttcctgagggttccgcacagcatcctggcctaccatggacagatccctccagcaccgttaggttggcgggctctcgctgctggtggcagagcagcttgccccgcagcccagtcctcctgcagggtcctttcttgctctggatcccactcaaaacaggtctcagttagccgggcgtggtggcacgcacctgtagtcccagctactcaggaggctgaggcgggaggatggctggccccaggaattcaatgttacaaggagctgtggttgcaccactgcactccagccggggccacagagtgagactcagtctctaaaacaacaaaacaaaaaaagaaccggtctcgcctgtgtgtccgaaaccccgctccattagacattccaccagtttggtgatctacccagcatcatgccagataaatccattttcttgctaaagttagagtcagcttctccctgtaatcagaaaaccctaacaaatatacagccctgggagagcgtccgggaggaaggacatgagagacagctgatcatggggcagttactgcgcttgacagtgcagcttgaggacagtgcagtgacatcccagcacagcagtcaggctggagcgggcgattgcgctcaagatagagacagggtgagggcggcaccaccatgctccccggggcactccagcattctttaacctgaagatgggtacccaggtgagtctggcccagattcctatctggatgggtcctatcttactctgtgctgatgaggtaggtccctgctctccctccacgtcccagagcttggacccactgaggatgccatgacaccccacagaagggctccactctgacccaccatagagagctgcaaaaaggccatggtgctcttagaagcaggacacacagaagatcccacccttctgactacagttgtccttcggtgtccacggggcatgggttccaggcttccccctactggggataccaaaatccatggacacccaaatccctgatctaaaatgacatactatttgcataggacctttgctcatcctctctaatgctttaaatcttctctagattacttgtattaccggatgcaatgtcagtgttacataaacagttatagtgtaatgatttttttttttttttttttttttttttgagatggagtctcactctgtcgcccaggctggagtgcagtggcgcgatctcggctcactgcaagctccgcctcccgggttcacaccattctcccacctcagcctccctagtagctgggactacaggtgcctgtcaccatgcccggctaattttttgtatttttagtagagacagggtttcaccgtgttagccaggatggtctcgatctcctgacctcgtgatccgcccaactcggcctcccaaagtgctgggattacaggcatgagcccctgtgcccggcctgatttgttttttaatttgtattatctttattgttgtattgctattttttatttttcaagtgttttccatccatggccagttgaatcctcagatgtgaaacccacggatatgaaggccaactgtattttttccactggatgcgtgcaatccccagtccccagcccagccgtgtcagatgtgtgagtggggacccatgtttcccaggagtctctaacgaccttgcccactggcttttccagaagggactgtcagggaggctgaagccagaccacgacccagaaactctgtccagctcccttctcctgggagccttggcctggagtaaccgggttgccctttccttacttggccatgagctgagtttgctgctttgttttctctctctccatgggtcgtgctgttggccttgtatctaaagaagtcatcaccaaacccagtgtcacctgatgttcccatgttatcctctaggattcgatagttttgtgttttacatttgagtccatgatctgttttgagataatgtttgtgaaggatggaaggtctgtctcagatcatttttctcacagttctggaggctgggaagcccaagatcacagtgccaactggttccatgcctggtgaaggtctgttccatcaatgatatcttctcatgatgtccttacgtgttggaaaaggggagtaaagcaagaccactgcatgaagcctcttttatcagggcactaatcctgttcatgagagtagagccctcatgaccgaatcacctctcaaaggccccaccctgcgataccatcatcttgataattaggtttcagcatatgaattttggaaggccacataccttcaagccacagcagtctgtgcctaggttcatttttccatgtggatgtccagttgttccagcaccatttgctgggaaggctaccgtttctccattgaattgcctttgctctttggtctatttctgctacactttttttttctttctttctttcttttgagacagagtctcgctgtgtcacccaggctggagtgcagtggcacaatcttggctcattgcaacctccgcctcccgggttcaagagattctcctgcctcagcctccctagctgctgggattacaggcacctgccaccacacccagctaatttttgtatttttagtagagacggcgtttcaccatgttggccagactggtcttgaactcctgacctcaggtgatccacctacctcaacctctcaaagtgctgggattacaggtgtgagccacctgcacgtggcctactacgccattttttcagatgggcagggccccggagggcttctcatgttctcatatgaacgtggtattttccttctgtctttcgttgttgttgcttcaagttgacagagccagattatcattatccatcaacacttgtccacccaaggccctctttcgttttattttctgtttagaaaataagctaaggccgtgcgcggtggccaacactttgggaggccgaggtgggcggatcacctaaggtcagaagttcgagaccagcctggtcaacatggtgaaagccagtctctaacaaaaatacaaaaaaaaaatagccagatgtggtggtgcatgcctgtgatcccagctactcagaaggctgaggcaggacaatcacttgaacctgggaggtggaggttgcagtgagccgagattgtgccactgcactccagcctgtgtggcagagactccatctcaaaaaagtaaatcaataaggctgggcgaggtggctcaagtctgtaatcccagcactttgggaggccgaggcgggcagatcacaaggtcaggagttcaagaccagcctggccaacatggtgaaaccccgtctccattaaaaattcaaaaaaattagccgggcgcagtggcaggcgcctgtaatcccagctactcaggaggctgaggcaggagaattgcttgaacccgggaggcagaagttgcagtgagctgagatcgcgccactgcactgcagcctgggggacagagcaagaatccatctcagaaaataaataaaataaaataaatacaaaataagctaatgaatgtctgtaagtccactggccagcccaggaatgggccccgtaccaatgccctactgaaatacacccaggtgctctgctgtctccccaacaccacctccccactccaagataaccagtatcctgcattttgcatttattattctcctgcttttgaaaattttgatagcagccagggcaacatagtgacaccacgtctttacaagaaattagaaaatcagccaggcatggtggtgcgttactgtggtcccagctactcaggaggctgagatgggaggaccacttaagcccagaaggtcaaggctgcagtgagctatgatcacaccactgtactccagcccgggtgacaaagcgagaccctgtctggaaaaaatatatcaaaaaaataaaaaataataaaataaaattgtgatagaacacatatataacacaacacttgccattgtaaccatttttcagtatgactcagtggtacaactgacttgtgttgtataagtagagcattcacaatgttcggccatcaccactgtttcccaaacactgccatcgccccaaacagaaactctgcacccgttgagcaatagctccccagttcctgctcccccagcccctggtaacctgtagccactttctgtctctgtgaatttgcccattctagatattttatgtaagtggaatcaccatatttgtccttttgtgactggcttatgtgacttagcatgttgttttcaggttgatgtatcttgtaacatacatcagaactacgttcctttttatggcgcaatagtaatctgttgtgcgggtgcaccacattttctttatccattcatttgtcgatgggtgcttgggttgcttcccacttaggttttttttcagcagggagtagagtctggctctgttgctcagaatggagtatagtggtgccatctcagctcactgcaccttccgccttctgggctcaagtgatcctccctctgatcctcccacctcagcctcccaagtggctgggactacaggcacatgccaccacactcagctaataatttacaattttttttgtagagacagggtctcactatattgcccagactggtctcaaactcctgggctcaaacgatccctccccctcagcctctcaaagtgctgggcttaccagtgtgagccaccacccccggcctagtttttttttttttttttaatatagctgtatcatatatgcttaaaattatatgttctttagttgagtttgggaggctgaggcgggcagatcatctgaggtcaggagtttgagaccagcctggccaacatggtgaaatcccatctctactaaaaatacaaaattagacgggtgtagtggcatgcgcctgtaatcccagctactcgggagactgagacaggagaatcgcttgaaccgaggaggcagaggttgcagtgagctgagattgtgccattgcacgccagcctgggcaacaagagcgaaactccatctcaaaaaataaaaataaataaacagcattgctgtaaacatttgtgtacctgtctcctagtgcaagggggagaagttgctcttgtatgtatgcctgggagttactgtaagatcagccagcatgcaactttacataagccctaattgttttccaaagtgctcctatcaatttacacttccactaacaatgtgtacaagatcctttttgatctacatctttctcatctatttttttttagacagtcttgctctgtagcccaggctggagtgcagtggcgtgatctcggctcgctgcaagctccgcctcccgggttcaagcgtacatctccttcaactcttgctatttgggggattccttcgtttttgccagactgatgtgtgcgaaacagtaccccaccataatcttgcatttccctgattaccagcaaggctgctcttttcttccatggtttctgggccacatgtgttttctcttctgttttgcctggagttgtcttttgcccgtttttatattttcttcttccttttgcttattgatttgtaggaattttttacatattctagacactaatcctttgccagctatgtgtattctttcatttgaagcttgcctttttactttctttaaggagtctttcataaaaagaagtttctaattctagtgtaattaaatccatcttatctcttcttttcttttcttttttttttttttttgacagggtttcattgcccaggctggagtgcagtggcacaaacatggctcgaactcctgggctaaagcgatcatcccacctcagctgcccatgtagctgagactacaggcacccaccacacccagataattttttaattttttgtacagatgaggtcacatcatgttgtccagactggtctcaaactcctgggctcaagcgatcttcccacctccacttcccaaagtgctgggataacaggcatgagccactgtgcccggctaccttatttttttcttaaggattaatgctttttatatctggtttaagaaatccttttctaatccaaggtcagaaagatactttttacattttcttttaagaatcttaaagtttcctttttgacatttaaatccttaatccatctggaaattatttttgtgtaagatgtggagggcctaatttcatttttccccattataaatcacctctatttccttctccttttgttaaataatccctctttcctcgctaatctgccttgccaccttgtcatattatatacgtatttttctctctttttttttttttgagacaggttctcactctgtcatccaggttagagtacagtggcacgatcacagctcactgcaacctcaatctcccaggctcaagtgattatcccacctcagcctcccgagtagctgggaccacagatgcatgccacatctggcttacttatttatttatttattttttgcagagacatgttgcccaggctgttgtcatatattaaaggtccatctttctggggtctctttagggctctctattttgtcccactggctactttgtctaccctcgaactaaggtcaggctttgttaattatgatagttttataataagccttgttatttgccaggcaagccctcctcgtgcatcttcagggtggtctgagctagtcttgacctttgctctaccatatacattttagaatgaactttagtttctcaaaacatcctgtggggattttgattagagtggcattgaatctgttcactcaatttggggagatttgacactatcttaacaatcaccattgaatatctctccatttatttaggtcttttaaagtgtgtttagaattttctgtacatctttcttttttctttttatgattattattattttagagatagggtctccctctgttgtccaggctggagtgcagtggcatgatcctagctcactgcagcctcaaactcctgggctcaagtgatcctcctgcatcagcctcccaaaatactgggattacagccatgagccaccatgccccgcccacatcttttattttacttacttctgagttttttaaattttttgttgctattataaatgacgtctttttacagagcgcattttctaaatactatgggtggtgcatagacatacacttggcttgtgtatattcatcattatgtccagtcagtttgctaaagtctcttttctttctaataatttgtctttataccctcttcggaatttttttttttgtttttttcagaagatcacttcatgtgaaatattgacagatgtatttccaccgttctaatctttatgccttgcatttcttttcttgctatactaccccggctagagcctccggaacaaagcccagaagaggtggcacaagtggacaggcatgctttgttactgattgttaagaaaatgcttctaggccaggcgcggtggctctcacctgtaatcccagcactttgggaggccgaggtgggcggatcacctgaggtcaggagtttgagaccagcctagccaacgtggtaaaaccccgtctctactaaaaatacaaaaattagccgggcatggtggcaggtggctgtaatcccagctacttgggaggctgaggcaggagaattgcttgaacctgggaggcagaggttgcagtgagccgagatcgcgccactgcactccagcctgggcgacagagactgcatctcaaaataaaaaatatatataaaaaaaagaaagaaaatatttctaacatttctctattaatacaattatgtgtgtattttatcaagtctaggaagttcccttttattcccagcttattaagagtttttgttatgaataagtgttgaattttagcaaatgctttttctgcacttgacgagatgaccagcgtctttctcctttatcctgctcctgggttaaaagacacttatgagccgggcgcggtggctcacgcctgtcatcccagcactttgggaggccaaggcgggcggatcacgaggtcaggagatcgagactatcctggctaacacggtgaaaccccatctctactaaaaatacaaaaattagccaggcgtgatggcgggtgcctgtggtcccagctactcgggaggctgaggcaggaggcagagcttgcagtgagctgagatcgcgccactgcactccagcctgggtgacagagcaagactctgttaaaaaaaaaaaaagacatttatggacattctaatattaaatcaccttgctttactgacattcgctgaacttggtcattattggctattttcctttatacacatttggatttggtttagaaaaatttttgtgagagtggggacgtccagcttcggagcgggaatcttcgctgcgccagcgactaaaaggagaattaaatatgggtgatgttgagaaaggcaagaagatttttattatgaagtgttcccagtgccacaccgttgaaaagggaggcaagcacaagactgggccaaatctccaaggcctcttcgggcggaagacaggtcaggccgctggatactcttacacggttgccagtaagaacaaaggcatcacctggggagaggatacactgatggagtatttggagaatcccaagaagcacatacctgaaacaaaaatgatctttgtcggcattaagaagaaggaagaaagggcagactcgatagcttttctcaaaaaagctactaatgagtaataattggccactgccttgtttattacaaaacagaaatgtctcatgacttttgtatgcataccatcctttaatagatctcatacaccagaattcagatcatgaatgactgacagaatattttgttgagcagtcctgatttaaaactaagactggtttgtggttaaatgaatacgttcagttcttgaattttaatagtaactccaattcagtaaatgctatcactgtttaccccttctaaagatatgattagacttcgttagtaatgttcaacttttcacaaagatggtgagtgccgtcttaaaacttactggagattggttttatatttagatttatatgactggttatgtgaatatatgtaaatactggggaaattccttcactgtcttagaaccaagcaagattcacctgtgttttgtgttcatttgcctcttaaaggcaacggttgaaggtaaataagggagcaatgtctatagttttggccttaactatgccaatctaattagaattccctgcattaaaaaaaaaaaagaaaaatttttgtttaggacttttgtctctgtattccagaccaaaatggacctacaatcttcctatcttgttctgtttttgcctagttaatattaaggttttgttgggtaatggtccttccttttcaattctctggcagagtctgtagagttgctagaacttgtctgtaaaaccatgcgggccggctgttttatttgtgggaagatttttaaaccgctgcttcaatctgttttatacttttagggttactagggctcgcttgcttgctttttttttttttttttttttgagacggagtctcactctgtcacctaggctagagtgcagtggcgtggcatgatctcggctcactgcaacctccacctcccaggttcaagtgattctcctgtctcagcctcccgagtaggtgggattacaggcacccaccaccacgcccggctaatttttgtatttttagtagagacggggtttcaccatgttggccaggctggtctcaaactcctgacctcaagtgatccacccgcctcggcctcccaaagtgctgggattacaggtgtgagccaccatgcccggcctttttttgtctgttttagtaaatttagtatatttctactttgtttcaggtttattgtcatcagtagttggtggtttatttttagtccttaaactgtctgtatacattttctgtattttcatataattcacaattttaaaggcaaaattaaaaaaaacaataggccgggcatggtggctcacgcctgtaatcccagcactttgggaggccgaggcgggcggatcacctgaggtcaggagttcgagaccagcctggccaacatagtgaaaccccgtctctactaaaaatacaaaaattagctgggcgtggtggtgcgcatctgtggtcccagctactcaggaggctgaggcaggagaatcccttgaaccgggaggcggaggctgcagtgagccgagattacaccactgcactccagccttggtgacagagactctgtctcaaaaaaaaaaaaaaaaaaaaaaaaaaaggtaatcacattacccactttaaagcatacatacaattcggtggttgttagtatactcacaatgttgtgccaccatcactaataattccagaacattttcatcaccccaaaaagaaaccccttacttgttagcaatcaatctccgttcccccctcctctagcccctggcaaccattcatctccttgctgtctctatggatttgcctattctgatcttttatatgaatggaatcatacgctatgtggccttttgtgtgtagcttctttcactcagcacaatgcttccaaggctcatctgtgttgtggcatggatcagtattttatttctttttatgcctgaatagtatatcaaatgatgagaccaaatcattgtactgttcttgcaacttttctgtaggtttttacattttcaaagtaagaagttgaaaagaaaaaacttatcttaagcaatcattggattaaagaggagagcatacagaagcgacaagcttcgagagcatcgtgaaaagaagaacacgtcttaccccaacctctacacacaactcaagctttccacgaggggcagttagaatagtcaagatatgcatgattaaggaggatagatcaaaagtcaacgacaaccagaaaaagaatgagagaagccaaaggggaaacaaaggaagggggaaaaagagaataaagattaaaaacataaaatagtaaaaattgtaaataaatacaaaagctgattctttaacaacagaaaaaaattgataatttcctaacaaaatataactttctgaaaacccaacaagaactagaaaatttgagtctacaaattaccattttaaagtagagaaggaagccaaactcagtagctcacgcctgtaatcccaacagtttgggaggccaaggtgggaggatcacttgagtctaggagtttgaggccagcctgagcaatatagtgagactcccatctctacaaaaacaaaaattaaaaaattagctggacgtggtggcacacacctgtagtcctagctgctcaggagggtgaggtgagaggatcgcttgagcccaggaatttgaggctgcactgagctacagtcatgccactgtactccagccctggcaatggagggagaccctgtgtcaaataaaataaaatagagaggggattctccataaaaacagtaccaaccctaagtagtttcaaagccaagtcctatataatctttcaagacaaaataattctgatatcatttaaactattccagtccacacaaaaacatttcataaagccaacaatacctaaacctaggttgatgcccaaacctcctaaacagagtacaaaaagaaacctgtgaacaactgtcacttctgattacaaatgcaaaaattataaataaaagataagcacatggattccagcgatatagcaaaagaataagacattatgtctgagcaagacataatattctattattatgaatagaatagaatttcgggtctactccagaaatacagaggtgattgaacatcaggaaatctttccacagaattcattactcagcaaattaaaggaggaaactcacaggatcactagttgctgactaggcatttgatgcatttcgacaggcgttccttgaaaaagaaagaacatctcttctaaaaggatactgggtagaaacacgtaaaggtggtagtgagagacagcatttccactcttctgcatagcaacacaaaagcaacggggtgcatggaaaccccctgccaactccattgttggccaaaggaggagtcagacagcctcctagcaagcaaagcagaaatctttcccaagccccaggtcctgaagatattctcctgttgtcttctacaagctttattgttttgccttttgttcttagatctacaacatacctggaattgatttttttgtgtataatgtcaggcagtggtcaaaatttgttttttctttaaaaaaaaaaaacaaaaagacttccaggctgaagatcctcaagaaggattctgtagggtcttattacaaggtccattttgggtcttgtttttaagcaatgccaggaagctgaccaaagtactctcttcctttaaaagcaacagtgcattgagatgcatctccctttgagggcagaggcatttgcttacacatatcggaacttgggcacttttacattgcaagggagccattggcaattctctggtcccatcacaattgcctgctggagaaaatgcacagtgtgaacccctggggaggggatattgccaattctatgacttgcacaactcgcaaatcaagtccttcctctcctttcatgccttcatggtctcagtgcccgccctctgcatccttgggacgaggccatgacccaaaggggctgctagggcgctagtcttcttcctttctgtctttgcaatgcctccagtgggttacctgtgatgcacaccgcattctggtttaatgcgtattcaattataaattgttttctttctcttctacttttgtggagaggttttctgggttgggagaagattttgtttttaattaaatttccccaacatactccatagcaatggggaaaggagttgtcccctttccccattgctatggagtatgttggggaaatgtaactcatctgaccaggcactttctcaggcatcagtcccaatcaagttatgttattataacaggtgttgtcctttccccattgctatggagtatgttggggaaatttaattaaaaacaaaagacagaaagggcctcactcttctatacagctaagtgggtctgtatccactacagtaggcaggtttcacaattcggagccaggtggcagctgaaactgagagatgaagagagttatcttcctggatgattaattacatttcgaaaagctggctcccggatcccagaggagaggaaacattcctgagttgtgaaactggccagagcttctttagccattaaaaacatctacatacatttgaaaaggacagagaaagaaattccaaaagataaaggaaaaaggtgcagggagtctcttaccttattttcaacagagagaattaagcctcttgtttttaatctgtatttgcccttacaatcttcttcctgtgttactatgaaataataacattgcgatatttaattaacaccattgttgcttttaccttcttctgggcaagttgcagatgcctaaatatccagctagcccgtagtaaaatgcaaaacaatgaccacaattgcaatagcatcagtttttgaattcagtacaatacttgccttggaggacaaccttcaaatatatcacatcaatggttcagggttcaatcagattctttgtaggcaaatgtgtaaacatttccctccatcacacattaattgtactagctgtcatgacatcttcattgcctgagctttcaaatggctaaccatttgaatattatttcatggctccttacaaaatcttatccaatccaagcttaaggagtagtttaactctggagtcttataaatttttaatgaagagttttccttgtaagacccccagaatttcttgagttttcatcatatatgtgtgtatgtgtatatatatagatagatatatacatatatatacacacatatatagatatatacatatatagatatatacatatatacacatatatatagatatatacatatatacacatatatatacatatatatatgtatacacatatatatgtatatatatgtaactttttttttttttgaggagtcttgctctgttgcccaggctggagtacagtggcacgatctcagctcactgcaacctctacctcctgggttcaaacgattgtcctacctcagcctcctgagtagctggaatgacaggtgcctaccaccaggccaggctggtttcaaactcctggcctcaagtgatccacccactttggcctcctgaagtgctgggattacgagcgtgagccaccatgcctggccctgtaacatcatattgacaataataatgtaggcactttggtaattgttttgtcttcctgagtggtatttctcaatgtgaactacaaagatacctatggccatatctaggatcgaagtcttttttttttttttttttgagacggagtctcgctctgtcacccaagctggagtgcagtggtgtggtctcggctcactgcaagctccgcctcccgggttcacgccattctcctgcctcagcctcccgagtagctgggactacaggcgcctgccaccacgcctggctaattttttgtatttttagtagagacggggtttcaccatgttggccaggatggtctcgatctcctgacctcatgatccgtcagccttggcctcccaacgtgctgggattacaggcgtgagccactgcgcccggcagatcaaagtcttactatgaacttccagggtgtaatgtacacagccctatctgttttttgtttgtttgtttgttttgagatggagctttgctcttgttgcccaggctggagtgcaatggtgtgatctcggctcacagcaacctccgcctcccgggttcaagtgattctcctgcctcagcctcccgagtagctgggattataggcttgcaccaccacgcccggctaatttttgtatttttagtagagacggggtttctccacgttggtcaggctggtttcgaactctcgacctcaggtgatatgcccacctcggcctcccaaagtgctgggattacaggcatgaaccaccgagcccaaactgccctatctgttttaagttgaggaaaactcatcctatcggcactttctcaggcatcagtcccaatcaagttatgttattataacagcctattaagtctccctggataacagacaaccctttgtttatctatccatactgggactggagagaacttacattgtacaattaatgaagtgacactatacctgtcttcgcagcctctgtctatatatgccagctttctatttgtctattgattagatgctgttcttttcatctgttctatagtcatactcccaatatctaattgtttccttaaatatgaatagacctgctaatgatgatattgtagaactgttttgtagctaatcgctgctgggctatgagtgagggcctcctacagcttgatgagattatgtcttcccagcattaaattattccaaacagatcaatttcaaagttaacaaataacatgtttgttagtaaaaatgtgagtcttacagtaattcaaataactactactgtggatagagcagccaatatcagttacaggaaaagtcctttgtggcaaccacaatgcaatcctcccaagagtccagctgcgtttttctttctctccgatggccctgtaggtgatcagtagcatttgaaaacattcctctcagcacagtggcagcccaggcctttcccctggaaaagctttgatgcagaggaaacctcccagtcaactgggatggtggacttctttggagggttacctccagatccttctgactttttaagtctcatggtttctaaagaagagaaaagccctattaagtattgagtatgattacgggaggattcagttaaatcaggcacaggaaggacaggcacagtggctcatgcctgtaatcccagcactttgggaggctgaggcaggtggatcacctgaggccaggagttcaagaccagcctagccaacatggcaaaatcccatctctacaaaaaatacaaaaaaataaaactagccaggtgtggtggcacatgcctgtaatcgcagctacttgggaggctgaggcagaagaatcacttgaatctgggaggcagaagttgcagtgagttaagatcatgccaccgcactccagcctgggcaacagagcaagattctttctcaaaaaataaaaataaataaaaacattaaaaaaaatcagccacaggacttggtcttggacccaagttagagctaggccatgcttgcttaaaggagtggctgtaattttaaacaaggctagtgggaaagttccaggccatcttaacattgtaggttgcagaatcttagccaatgagtctttcagagctggattcattaatctgttaattaattcattaatttttttatgctactggatgacagtaggaataaaatgactttttctgtctgattcaaatgctctggtattccaaaagggagattcatatttattaagagagtctttcccgttgtttatacttcctgcctaaggatcagcttctttttctctttcttcacagctgacaacagatgccctaattgtttcacctcaggttagcactattgcaatttgtctagcaagaccttatgtccccgccagatgagaaattgcagtaaagccaaagcatcagttttgcattgctcttcagtttctgaggctactagtagcaagtcgtctacatagcaaataatcatagatccctctggtgggagaaattcctctaagtgtttctgtaaatgactagagaaaataatgggagcattcaaaacccttgaggaattctttgccataaatatcagactttctcataagcaaaagcaaacaagaatttagattcatctgctagaggaatggaaagacagaaaatgcagaaaattgatcaattacagagaaaaactttgcagacaatggtaccaaagtcagaagagttgctggagtaaacagaacagcacacatatttacttctttaagtttttttttttttttttttttgagacggagtctctctctgccgcccaggctgaggtcagtggtgtgatctcggctcactgcaacctctgccccccgggttcaagtgattctcctgcctcagcatctcaagtagctgggattacaggcacgtgccaccacacccagctaattttttgtatgtttcttagagacagggtttcaccatgttggccaggctggtctcgaacttctgacctcaggtgatctgcctgccttggcctcccaaagtgctgggattgcaggtgtgagacaccatgcccggccttctttaagatcttatacaaataaatttagcagttgaccatcttcatcacttttacctctcttctctttcagaagtgtgagactatttcaaagtggtggctttttcaaattatcccttgtttctctattttttttttttttttttgagacaagatcttgctctgtcgcccaggctggagtgcagtggcaccatctcaactcacagcagcctcaacctcccgggctcaagagatcctcccacctctgcctcctgagtagctagggctagaggcatgcaccacctcgcctcgctaatttttctttctttctttctttctttctttctttctttctttctttctttctttttttttttttttttttttgctttttgtagagacagggtcttgctatgttgcccaggctggtctcaaactcctgggctcaagagatcctcctgcctcgacctcccaaagtgctgggattacaggtgagcccccacatctggcctctaattcttttataacctatttcattccttctaattgagctcccaacaaaggagattgttttacacacagctatggcttatccctttggtaaattgattttatgggttctatagctcaaattaaatcagcatctcgattctctagggctcaaaagatgccttgatttgtgtcagctcaggaagggggcttttccggcactgaatatggtaggcttggaggtgcatggcaggtctctcgccaataggtttacagaagagtcaggaggaaaggggagcacttgctccttaggcaaaggcagagggcccatctgatgggaattggagggaagggaatatgtagaaggctgagtcaagatacaaacaacctgtactgatggaaagcaagagcaagagctttccaaggcaaatgcagaataagtagcaccagtctgtatgagaaaaggcaaggacaggtcagcctggcaaacagtgaccgacatacacacacttaaccctaatctcttcccgccactgccatctcctcaatctatccattttgagccatttgcaaagtatctcctagctgagagttttatcctcctaggcccccacccctgattctcttgttcctgccatcctgcatgccccagtctctttggacaatccctcttccaatgtccttgcttcttgcaatgatgacacgtgtcttgcttcctttcctttctgggttgcccagaacaggagttactccctttcagtaaacagacctgagcagctaacacagagtttttcagtttcttcttttcttctttgactttctctagagtcccaaatactgaatagctgctcctaagcttacattatagtcagtcctgccatcctaccaccttttcccttatttgagttgttgttgttgttgttgtttgttttgtttcttgttttgagacagagttttgctcttgttgcccagggtggagtgcaatggcaccatctctgctcactgcaactgccacctcccagcttcaagcagttctcctgcctcagcctcccgagtagctgggattacaggcctgtgccactatgcccggctaattttgtatttttagtagagatagggtttcaccatgttggtcaagctggtctcaaactcctgaccttaggtgatccacccacctcagcctcccaaagtgctgggattacagcctcccaaagtgctgggattacaggcgtgagccactgcgcccagccatattggcactttttaagccttgtgttttttaatgtcccgttgaccaaagcaaatcacatggccaagcccagatctgagagtgtggaaaaatggactctatctcttgcagggaggagctgaaagttccatcacaaaagggtatgcatccagggatggcaagaatttgaggccatttttgtgatccaaggacagagattgtcctcggacataaaattcaaggctggcagtttttttgttgttgttggcacatcagatataccattgtcttgttttctggcttctgtagtttgtgttgagaagttggctgtcagtcaaactgcataactataaaagtaatcaacccacccaccagctgctttgaatgttttctctttgtctttgctttccctcagttttactatgatgtgcctaggtgtggttttttgtttgttttatcccgctcttggttcacgtgacttctagaaactgacttgatatatttcaccagtttggaaatatttcatccattaactcttcaaatattatctgtgccccattctttctcaccttgtttttctgaactccaattaagcatatattaggtcaagcatggtcgctcatgcctgtaatcccagcactttgggaggctgaggcaggaggatcccttgatcctaggagctcaagaccaacctgggcaacatagtaagacctcatctctacaaaaaaaaaatgaacaaaattagctgggcatgattgcatgtgcctgtagtgctagctactcaggaggctgaggcaggaggattgcttgagctcaggaggtcgaggctgcagtgagtggagattgtgccactgccctccagcctgggtaacacagcaagaccttgtcttaaaaaaaaaaaaaatacacgcacacacacatatatgagaccttctttctgtatcccctatgtttcttacctccttttgcattgtcttttaccacctttttacctctccaagctttagtctggctattttcttctgatttatctttctgtttactatttctctcttcagctcttgtatatcccacccattgagctcctaactttaatttgtatattttatatttctaaatttttcactagattctttttgtagtttcaaattatctgctaaatttctcaattctgtcttttgtttccttgaattattaaatataattattttaaagtctgtatctgataatgccattatttggagtccttgtggctctatttttattatattacttttctaatttcatttttattaaattttcttttctccttatgacatgttttgtttgtttttaagacagggtctcacactgtcacctaggctggagtgcaatcatagctcactgtaacattgaactactgggctcaagcaatccccctgcctcagcctcccaagtgctgggattacaggcatgagccaccatgctgggccttgtcctcgttattttttattgagtgctggacattgtgaatggaaactataaatcatttgaggccaaggacaatgttatcttcctccagagaaaatttacatttgtttctggcaggcagctggggcactagaaatcctgatcaccttaatccaattttcagggattgaaagagctcaaatcttgactacagtcccttaggggacagggatgcagtcctttagagggctattctatttccagtttacacttattcctagacctttgggtttccaacccaaagcacgaggagcttactagggccttcttccttggtgagccctgcactctgacttttgacccctcacctcttaagtctgctaactgttctgctcagcttcttgggccctcagctgtctctgctggaattagcggatggccataggggataagcagccttaaatgctgagctcatctctcagctcatttcctttctcccatatcttggtcccatatgcttcactgcctattatcacttggatattttcaagcaaatattttccctgttttactgagtctgtttagttgttctcagtggaggttgtggttcaaattacttattttgtcattgccagacacagaagtcattcagcactaggttttaggctctatttatattgttgagtctacatataatcttgcttccaagtactgcataacactccctaatgttttatctgcttccttagtcactacaaataatgctaccatgacctttgtcatgcaggccattgctctgtcacccaggttggagtgcagtatcatgaacatggctcactgcagcctcaacctcctggactcaatggatgctcctgcctaagcctctcacgcagctgggaccacaggcataagctaccacacacggcgaatttttgtattttttgcagagatgaagtctcaccatgttgctgaggctggtctcaaactcctgggttcaagtaattctcccacctcagcctcccaaagtgccacgattacaggcgtgagccaccacgcccagccaagaatttttgtgatgtatccccaagagcagaattacagagaattaccaaaattacccaacctagtgtatacttaattgatgagatactgacatattgttctccagaatggttgtgttggtctgtatctccaccagcagtacatgagcgctctctagccacacatccctgccagcatttgctattgcctgcatttctaggtgtgtgtgtatttgtcaatctaatgggtatgaagtgatactgttgttttgatttgcgttcctctgataatcaatgggcttgcacatcttgggtgtggcatgtctgctgctggtgctgccaacacttggtggggcatgtagaactgggcctctgacctccgaggaaggggtgtcatctggcgggttccgagaaggccgaaatgagctggagcctgaaaccactgctgctgctaagggccaactgagactggcgctacagcaacaggaatggaaaacaaacaggaaggagcaagacccttctctccttcccagccttccagtctccctctagtgtcccagttggtggaaactgacaaccagccagaagacaaagaaggaatgtaggttcagagtcccagcgccagcctcacaaagcagagtatggcaccttccccgcccctgcccctttggcttcgcaacatcagttcgaagccttcttgcataatttgaacttccctcagcagtaatgacaactttatgtttctgcctaacaagatccttcatacaaatatgctcctaccctcttctcaagaggggagacataaagtcccaacagtctttgtaatcatctccaaattacagtcacggtattggtgatattaatttctcctttaaataagtcatagtaccacttaactattctgtgacctagaggctaagttgtaaagtttaccatcaaaacaactgctattggccaggtgcaatggctcacgcctgtaatctgagcactttgggaggctgaggcaggaggatagcttgagcccaggagtttgagaccaacctgagcaacacagcaagaccctatctctacaaaatattacagataaaaaaattatccagtgtggtggcgcatgcttgtagtcccagctactcaggaggctgaggcaggagaaccgcttgagcccaggaagcggaggttgcagtgagccaagatcacgccactgcactccagtctgggcaacagagggagattgtctcaaattaagagagagagagagaaagaatcaaagtctgtaagtaccgtttcgtgtcagagaggaggagagatggcagagcctttagggaagactgtgaagatgtactgttggccctgccaggttaaaagaaatgtggtctttgaagtgcaaatacataagcttttcaaacctgagcaataaaagaaagtgctctggtggtcttttctctggtgttactatttgacagggcagtagcaagctagacgcaggggctatgacgctttgcttcagtaaagtgactgcgtctgaaacagcagctgcaatcaattcacctgcggtcattcttgaagagccatccaccttctgccaagcaccaaatagacaaatagcatacaagagacatcacgactgcaaccttcaagttcaaggcactaatctctgctatttccctcagaatcgtgacattgggttcctttctctccattaggcaagggttgttctggcatctcactatcattgaatttacgccacagttgagttccagtttaaatcaaccaaccacataggctgttagagtcactttcagctgcatggaccaacattaaatataggccctctggtaaatgcccccagctcaagaaattgtgcccaatccaatgttatatccatcccttttggtagaacatccttagaattcacttccacacatattcgcccaggtttttgccaatatttcttaacgaaaatcatgttattgttctggtgtataggttttcctcttgtgttttagtgtgtacctgtccacctgtggtggattgcaccctcattatgggacagggggtggttgtggtgggttctgagaggagaatgggtatcctcttgcaaggcaccagagggctaccaggtcagccctaaaaattctcttactccttgtacctgcagggctaacagtgctaaatcaaacacaaactttaattgcttgggttacagaatcgcaacgtcagttgattcccagcctcgccacgtgtctcacatgaaatgtcaggcagtggtcgggaggagtgagaccctgaaacttaccattgctttcaagctcaaggacgcaaacaaaccaatctccaaaccccatctttcaggatatgattcttgacaccactccagctgccaattttgctatcagccaggatctgatcaggaagtagaaaggatgacagctcctcccttggtgcatgcagttgagatttcaagtgatcttcctgccttggcctcctgagtagctgggactacaggcatgtgccaccacaccaggctacgttttgtattttttgtagacgaatgtctcgaactcctgggctcaagtgatcctcccagctcagcctcccaaagtgcaggcactgcaggtgtgagtcacagcacccagcctcctctgtttgaagagtcctaactcccttcgttccccagcctgaggggctgtgttaatttcctggagctgccatagcaaagtgccacaaaccaagtggcttcgacagcagaaatggattctctcacagttctgcagggaagaagcccgagatcaaggctgtgagagagcaggaggatcacttgagcctgggagtttgaggttgcagtgaaccatgactgtcccactgcactccagtctgggcaacagaggagattctgtcgaaagaaagagagagagagagagagagaaaaaggaaggtaggaaagaaggaaggaaggaagggagggagggagggagggagggaggggaaagaaataagaaaagaagagagagagaaagagaaaggaaggaaggagagagagaaagaaaggaaggaagaaaagataagaaagaaaaaggaaaggaaagaaagaaggaaggaagaaaagaaagaaagagagaaagagaaaaggaaggagagagagaaaggaagaagaaaagagaaagaaagaagaaaaaagaaagaagaaagaaaacagaaagaaagaaaaagaaagaaagagaaagaaagaagaaaaggaaggaagggaagaaaggaaggaaggaaggaacaaaggaaggggaagaaagggagggaaggaaggaaggaaggaagttggttagagagaggcccacagagctgaagctgggtctctgaggtctgaggtgggggcgtggcctagctagttgtggaggagtgagctcagtagagggacttgtggggctgggatccagacctctaaggagcaggggtctggctgatgctggggtctctgagctcaggggatggcctagtactcagattttggagcatagggcactgggtgtccggtggtggtgtctcagaggtgggatgcaatgaagctggtcttgcaagtgttgagagatctgaaaattggcttcaggcagtgccacggaaatgaagcacttgctgcaagggtgaagaagccttgttagatggtgcgcccaggaaggagcaggtcccttcttcctcctccagtcttgtgggctcccttaaacgcccccagctagcagagcctaggagggaggcgctggtaaagcaggagcatcaccaagcagaggacagcaaagggggtggcacgcccactccacaagccagcactgctccttctagggcacggatctcagagaaaggactgcatatgcccactttatccatgatggctaccattggaaacaacccacacgtccatcaacgggggaatgggtaagtgagtcgcggtgcatgcgtgcatacaatggctactagtcagcatcacagagggaagaagggacacagacgtcaacctggatgagtctcatggaagtgattccagaaagaagccggcacaaagggctccagagcgtgtgcttccatttccatacccgtcaggagcaggcgagaccatctacagccatagacggcaggacagggcttagatctgcagccagggattggctgcctggaggcacaaaagcattctctgtggtgatgcaaatgttctttagttggtccaagttgtggctgcatgtgtggataggcaggtgaaaaaaccaggcgtgcacttgattttctgcacagtaatcctcaataaggacttgtttcacggatttttagggcagtggagttactctgtatgatactgtaagggtggatccatgtcattatacctttgtccaaacccataaatggacaacaccagagtgaaccccgatgtcagctatgggctttagttcatgcgagcttctcactgtggctcaccaattgtaacaaacgtactacactgactcgaaatgttcatcatggggaggcgtaaggggagtgacggggtctgtgggaactccttactttccgctcaatttttctgcaaacctaaaattgctctaaaaagcaaaatgccttaattttttaaaaacccaggaaagcagcccagggccgatgtggcagctccaggtgctcaggccctcgggctgcctttgttgctgttccgccatcctcaacgtgcgacttccctttggtgcgacaaggtagctctccccatgatcacagatcacatttgcctttcagctgtaaggagacagaaagtggctggcacaaggccatgcgtggtggctcacgcctgtaatcccagcagtctcggatgccaaggcgggcagatcacctgagatcagtagttcgagaccagcctggccaacgtggcaaaaccctgtctctactaaaaatacaaaaataagctgggtgtggtggcgggcgcctgtggtcccagctactctggaggctgaggcaggagaatcacttgaacctgggaggcagagggtgccgtgagccaagatcatgccactgcactctagcctgggtgatcgagcgagactccatctcaaaaaagaaaaaaagaaagaaagaaagaaaggaaggaaggaaggaaggaaggaaggaaggaaggaagggaaggaaggaaggaagggaaggaaggaaggaagaaaggcgccagcacaggtttgccctgcaggtatgggtgcactcatgccccaccaccctactgggtgcatagaggctgggaaatgggtcttcagctgagctgccatgtccccaagccacaaatctagtgttatggaagaacagaaaaacagatattggagggcaataagtggacgctgttacaggtggggatcaagggggacaatgagtgtagaggagtcttgaggggttttgctgtaaacaggagcagtgaaacggggcaagagccagggggcatgcggaggcaggagcgggagcttccggtgatagaagctccaagggcatgttggtatgctgctgggcctgaccccacagggagagagaaaaattacaggtgcagaaaacaggaggagagagggggtctcaggggtggcagagaccactgcacatggtgggaagtgttcacctgagggggctagggctggggaggggacagatttgatgatgggaactcaaggaaagaaattctcgtcagatgctctcaacttgctcagtgaaacatgaaacaaagttctcaccttgaaagtgcagggcctgggggctgaggggaaggtgtgaggccttggagaaccagggaggaaactctagaattcccaaggaaggctggctctgcctgggtccacttgaggcttgtggtcataaatctaaggtgcttagtcctgggctgggtgtggtggctcacgcctgtaatgccagcactatcgggaggccgaggtgggagaattgcttgagcccaggagttcgaaaccagcctgagcaacatagggagactccatctctacaacaataatttaaagattagccaggcgtggtggcgtgctccagtggtcctagctacttgagaggctgaagccagaggatttcttgagcccgggaagtggagggctcacctgtgctgggttttctttctttctttctttctttctttctttctttctttctttctttctttctttctttcttttttctttctttctttctctttctttccttttctttctctccctccctcccttcctttctttctttcttgcttgctttcttgctttgtctttctctttctttcttctttctttctttctctttccctccctccctccctctctctctctgtctctctctctctttctttctttctctctttccctccctccctccctccctctctctctctctctctctctctctctctctctttctttctttctttctttttctttctttgtctcgctctgtcgcccaggctggagtgcactggtacaatctcaggtcgctgcaacctgatttttttacctgcctatccacacatgcaaccacgactcggaccaaactaaagaacatttgcatcaccacagagaatgcctttgtgcttccaggcaaccaatccccagctacagaggtaagccctgtcctgccatctatggctgtagatggtctcacctgctcctgatcacgccactgcacttcagcctgggagacagagtgagaccctgtctcaaaaaataaataaataaggtgctttgtactggtttagagggctgggtaccccagagagaacgatgccaccggggcacatcatgagtcttccactgagccatggagctgtgtcccttgagacaggggaagaggctcctgccgctggccacactctactctcatgtttgagcagtgaagggcccggccatggtgacagctaagcttggtctcaggaggccagcagaggcgaggatcctgagccccagcaacaatgtgacagcaacacccaaggcagccaacagccaggcctggcagggtgggtggaaggcccgggctctgggaaggggcagggaagcatcaggactgtgtggctgggccacacccgggcccgcctggcaggtcgctcctagcacctcccacagtgtgacgtggacaggggaagtaagtgttccgcgaaataacaaaaggtgctcttgattttcaggttttatttgcctgttataattctgatattatgtacatatatatatatacttttgtttttttgtagagggcttatcagtagaccaagcacaggcatacagggaggctgtggctgctgagcagtgctgggagaaccaatctttcctttttttttgtctgtttttatttttcctgggatgggttcatcaaagctaattgctatcaatcctagaaaccacctagggactcagacatctgcctacacactagtggcgtaaagggaaggacaggggtacaaactttcaaagtcacggtgtatttacattcccaaggtgggggcgggaggaggctgaggaagacaactgttcagacgatagggagggcagggctgctaaggggtcctggggggtgggggcggctggaagaggccggccagtgggcagtgggaggaggtgtgcccgccccgcagccaggtagtgacggaggccacttggatgttgtgtggtgggtaccgaaggcagcgtgtgtatggagctcctgaaagccggccatggggtgggctgggcggcgggaagaggcggtgctgccagagtgcgatgctgggagtggggggactctgggctctccagatggcctcccctgcccccgcggccagtttgcccggctcccatcccggttggagcagagatggcaaagaaaagacagcagatggtggggacaccgagttctgttcccagtcccagccaggctggctggggagtggctgggggagggggaaggtgccaaccctggtcctgaggagaccccaccatgtctgcccccagtcagggagcaagaaagacagcatttcggagaccctttcgggccacccctacttcttctcccccaaaccacagcctctctgcccaaatgggctggcaaaacagcacccaaaggcccctggcatgtgggagatctgcccaagctggggcagagcagcgtgtgcccaggaaggggtgcagctgggttttggcaataaagtggggaccgggtggtaggaaggggatccgaggcagcaagttctcctctgccccaactccagcctcccatgggcctgctggagagggaggggcctggatcccaaggccaggggcacagcatctcctgtcctggactccactattctagggccacggcagggttgatgggggaagtggcccctgagctgtcattgccccctgccgcctccttctccttcttgccactgtactggccaatgaacgaaccatcctcgttgaactgaacatccacgctgcccccataatcggccaggctgtcgtcactgcccaggggcttgatgtccccgttgagcgatggctggctgctgccaaaggccttctcctcgttgtcactgcagaggcacagggcaggtgcgagtgagagcactgccgagcccctgcaggagcctggctgggggtgaggcagacgcccgcctgccttccatttgtttagaatgcgctcagaaagagcagctctggccaccctggcaggcaggtctggagctgtcatctttgggcattccccagatcctggggactgtgagggagaaaatgtgcgctcggccaggggattatggggcctggttcctgtctgggaagctgtctggggcctcccttggggagaggggagcagtgaaggtatctgtgtggagaggaggggctggggcgtgttggcctctccctgaaatgaggagctgccgggcctgggggctgggaagtgagagtcctgtcagagccccggcagccaggggacaatggcacaccaggcgcacattgtctatagggagaccttgctgttggcccctccccaccgcccctgccttacctctccagggacctgaagtcacccggcagcacagagaagagagagagggggtgagatgtgaaggccagggtggagctgagtgccagcacccactcctgccccggctcacctgtactcgccgaaggtctcatctttcatcggtcgggcctcagagtccacctgggtgtcctccttatccttcactggagacacagagagggacagcttcttctcccgccccagcctgacccggggctccaggcccctctacgccccgcacccccagcactctgtctcaacagcgcccagaggcaagaggccttgaaagaaaccgctcaccccctgcggtccagccaccacttgcctgttgccccaaccccggcctgggaggatgatccccctgcctgcccccaccatgcgcctgtcatcttgtggggagctcggggaatccaggaggccttgcagaagggtggaaggggcgaggtgctcctctctgccctcggctccacccccgtcacgtggggctcagaggctacctgagtatttgccgcccttgctgcgcttgatgaagcagaggatgagcaggacgaggagcaggaggatgatggcactcacaaagccgatgaaccagccctcagtggcgaagccagcaggagggagcctcacgcggcctgagggtgagacaccagccccccgtgctgccgcccaagccagaacccgacctgaggccctgaagtatgctcttaaagttggggccctctggggggctaaggagtgacagggacagggaaaagggcatctgcggaaagggtatgaaagggggctgattcggggacacccagattctgggaggagaagcagacaggagccgtggagggagcctgggcagtagtggccattcaggggacagaaggacatgaattgtgcagcccccatgcttccctggcaggtgatggcgggcccccggcgcctcacctgtgccattggtcttcacagccatttggtgccggaacatcctctccttaaacaagtggatc

SEQ ID NO: 298 - DNA, 2276 bp, Homo sapiens
aaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtatttattgctacatcatagttgataaattgatgttatcgtaaagccatatgttctgttcaagtcttgtttgcttgaaatgattattcctacaagtgaaacactagactatttggagtgtatatggcttgtgttttgggatttttttttttttttttttggcttttgtttttgtttgtttttttgtttcgtttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaaatagaaatcaaaatctggcaccgaagcatgctaattgtttactgtaccttgtgaggttttcactcataaatttaaaccagtgtattttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgcctt

SEQ ID NO: 299 - DNA, 509 bp, Homo sapiens
attctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataaaaaaaaaaaaa

SEQ ID NO: 300 - DNA, 622 bp, Homo sapiens
tttttttttttttttttttttttgcaattctgtaaggtttattgaatgggtgggtaaaaagtgaacgacagctacaaattcaaaaataaaactcttggttattaaagtcattccaggcatggacagagggatgcgaggctggccttccctgtccacggtcctctgaggcagctgaagtctcccatgtctggaccccgaatcttgtgcagattgaacagtggatccggggtgctctgagcaggcagcagggagcagctctggtgacgcttcatgtggtagcctcactctccattctctgcccctctcgtgcccacaaacaccaccaagagattcacggtgagaaatatcagcaaacccagatcccagatcaccaactccatggtcttaggacttccttggactgtccttggatctaaggctgagaccttacaagcaccgcagctcagcctcttcttgaagacacgtcacctggggccactgggcacacaggacagaggtcagctgacaatcctgggacctcaggatccatgctctcccagaggacgcctctcacacacatggggcggcagtcatgttacactcccaggggcattctcaccccgcggacagtggaagcccctca

SEQ ID NO: 301 - DNA, 1468 bp, Homo sapiens
cgggggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcagcggaaggagcagctatgggagaagctggccaagcagggcgagctcgccgggaggtgcgcagggcccaagcccggttgctcaacccttctgcaacaaagggccaaacccggccccaggacaccgtatagcggccttctacgacctctgggccttaaacaaccccgacaagcccgttgtttggccaggatgcctttttcctggacagaccaagaagaaaggagtgaagcggccagcacgcctgcacaccaagccgtcccaggcacccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctgcggcaccaggagctgttccggctgcgcgggatcaaggcccaggtggccctgaggctggcggagctggcgcggcggcagaggcggcggcaggcgcggcgggaggctgaggctgacaagccccgaaggctggggcggctcaagtaccaggcacctgacatccacgtgcaactgagctcggagctgacagactcgctcaggaccctgaagccccgagggcaacattccttcgagaccggttcaagagctttcagaggaggaatatgatcgagccttcagagagaagccaagtttaaaaccaaggccaaaggtgaaacttggtggaagaaaccgggcgtttcgtgagaatccaaattttaacttgcattaaaatgcccggaaaactttccctttaaattaaaaaaaatttttt

SEQ ID NO: 302 - DNA, 1506 bp, Homo sapiens
ggcacgaggattgtaggatgccgccgggcacaggggctcatgcctgcaatcccagcactttaggaggccgaggcgggtggatcatgaggtcaggagatcgagaccatcctggccaacacggcgaaaccccgtctctactaaagataccaaaaacaaattagccaggcgtggtggtgggcgcctgcagtcccagccactcgggaggccgaggcaagagaatggtgtgaacccaggaggcggagcttgcagtgagccgagattgcgccacggcactccagcctgggcaacagagcgagactccgtctcaaaaaaaaaaaaaaagaaaaaaaaattgtagtatgcccagtttgtatctacaagatgaggaatcacttgctgtggaaaacccacacacagtgccagaactcctatgaggagtaaaaacagattttcctttatatccaaacagaaaccatgggagctggagtggctacgtcaacatcaaaagaaagacgccactttgggaggccaaggcaggaggatcgttttagcccaagagctgaagatcagcctgagcaatgtagcaagactccgccttgcctacttttctacgaaaagtttaaaacttagccgcacacaggctgggtgcagtggctcacccctgcaatcccagcaccttgggaggccgaggcaggcagatcacaaggtcgggagttcaagaccagcctggccaacatggtgaaaccccgtctctgccaaaaaagtacaaaaattagccaggcatggtggcgtgcacctgcaatcccagccactcgggaggctgaagcaagagactcgcttgaacccaggaggtggaggtcgcagtgagccaagattgcatcactgcactcgagcctgggcgacagggcaagactccgtctcaaacaaacaaaaaaggccaggtgcggtggctcacgcctgcaatcccagcaccatgggaggccaaggcaggcgatcacatgaggttgggagttcaagaccagcctagacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagcaaaaaaaaaaaaaaaaaaaaaaaaaaaaaaaaaa

SEQ ID NO: 303 - DNA, 469 bp, Homo sapiens
gaggaagtgcgatcgggaacctcctatatacttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaaaa

SEQ ID NO: 304 - DNA, 967 bp, Homo sapiens
  misc_feature 966: n = A,T,C or G
tcgctatacactgacccggagaacccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaacagaagaggaggttgcccagaagaaaaagatatcccagaagaaactgaagaaacaaaaacttatggcacgggagtaaattcagcattaaaataaatgtaattaaaaaaataaataaaaaagaaaaattcgggaaaaagttttttttgggaaagggtggaagggaaaaagatcaaaatcaagcatggtgtcgcactgtgggcgacccgtaacatccgggcaagatccacaaaatcaggggcccgtgacctcaaacgaggacggggcatccccaaaagacaccatgggaaacatgtgcgcaaacgcgcgcgcgcaacggcaaaggacaccttaacaaagagaccgggactggacaacagaacaacggacttgacacgtgtctaccccatggaaacacggggagaatgaaccagcagagacgtggacaactggacggcgcggaggaacatagcaaacagacaaaggaaacaagagaagagacccaagacgaggatgcana

SEQ ID NO: 305 - DNA, 833 bp, Homo sapiens
aaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattcaaaaaaaaaaaaaaaaaaa

SEQ ID NO: 306 - DNA, 866 bp, Homo sapiens
tcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaataaaaaaaaaaaaaaaaaaaaaaaaaaaaaa

SEQ ID NO: 307 - DNA, 1147 bp, Homo sapiens
cggcggtcggtcagcgcacagggcacggcttcctctgcttctcccaccacttagtctcaacccgggtgtgtttgcactactagagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattgaaaaaaaaaaaaaaaaaaaaaaaaa

SEQ ID NO: 308 - DNA, 1183 bp, Homo sapiens
ctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgagggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttaaaaaaaaaaaaaaaaaaaaaaaaaa

SEQ ID NO: 309 - DNA, 521 bp, Homo sapiens
ggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaa

SEQ ID NO: 310 - DNA, 1355 bp, Homo sapiens
gggaggcgtgagccaccgcgcctgtccaggaatcagttttttccaacaagtttttggactccactttgagaaatcctgacctgcactatgcctgaaacactccaaagggggtgctgatctggagacagatctgtcctgggacctgtttcagccctgtcagctcctggtggctgagttgaagggtgtggcccaaaaggcagggcaaagctagcttctgggttccttcagcccctgcaaggtttgggactctgtccacaggtccagacccagtacttattatgaactgttgggggtgcatcctggtgccagcactgaggaagttaaacgagctttcttctccaagtccaaagaggtacccgtacccctgaggtggggagggggagcaggaactttgagccagtgggggtgtgcttcaaattcccaggagtagaccagcatctctggtgggtgccacattttttcagccctcatagggagtggcaggtgctcaatggtaggggaaaggctgtgggcaggagccaggggtcctgtctgatgggctgggcttggttttcttgacctgcctgcctgctcttgagaaacctggaccagggcatatggtgaatgcagggggctggcaggtggggagggcttgaacacaggaggaagcaggagtccatgctctctggccttctgaggagtgggcaggcctgagtgagggtcactgaccaggcagggcctctgggtatgactggagccctggtgggtggatgtcatcagcatgggtcctggggagggacaggcaaagggagataaggggagtcctgccccaccccagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggtgatgcctgttctccccggggtgatgggcaaagggcaggagggtgggtgaattccagtgtggtcagccagtcctccacagcacctcgtggcccgtactcttgtgtctctcaagctaaaactgcttgaagttggtctctggacctctccttacttattaaaggcagcgctgcaccaaaaaaaaaaaaaaaa

SEQ ID NO: 311 - DNA, 541 bp, Homo sapiens
agcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgccgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcaaaaaaaaaaaaaaaaaaa

SEQ ID NO: 312 - DNA, 1148 bp, Homo sapiens
cttttacatatttctaaatagatagaactaaatgatcagagaatttcttctgtaaaaattggccaaattttatcaaaaatctaacatacgatacaatccaaattataaaaagactacttgggatcataatattccaaatgtatgacagttataactccatcttaacaagtgtgaaaagtacttgctctcatgttgctttggtccaaaagagtagagctaactcagtaacaggaaactaagtacccaatcttttgccaaaattaatttagattgtgactggcagcagaaatatccataatgaacagctctactataacaaagaataattaaagaatacttttcgtgaacatatcacagtatcaaatacatttttataagagaaaaatatgaaggaaatgataaaatagctatcacaaacaaaaagaagcatttcccccataaggtgaattagagggttgatgatgctaatatgaaaggaagttgagtactgtatttatttcttattttatacaactcttactctttacaaaaatggttatagtcatgcccataaaagtgtaacccatggcatttgaaagcaaacactctttgtaattatttaaaagggcctttttaaaaattataatacaaaggtctgtgctctataagcagtcctccactgtgcattgtaacaataaggcttacttttaatacaaagactaagcgtttgggagttatgacccactggatttacaaacatcaatttataaattgctttatgcaatctatgtgctatagggatactccacttcatcaagggttctccacaagcttggagatacttcgaagaattctctcattacatgaaatctggattccttcagaatcacctggactttacggaacgagggagcaaacaacggcacgtaataactcggacacgtaacaaacgatcaagaaggagaccacagcacgatgccaagcacaataggcgagaataccggatcaatagagcccaatggcgagagtcaaagcagcgtcacaatgagagcactccaggtaggagtggtgcattagacaagtgaggataccaggagaagaagagagacgatagagacataagagaggagccgaaacaagacacccaccacagaacaaagaagaagaca

SEQ ID NO: 313 - DNA, 1229 bp, Homo sapiens
gtctgacgggcgatggcgcagccaatagacaggagcgctatccgcggtttctgattggctactttgttcgcattataaaaggcacgcgcgggcgcgaggcccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtaaaaaaaaaaaaaaaaaaaaaaaaa

SEQ ID NO: 314 - DNA, 2083 bp, Homo sapiens
ttttttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaat

SEQ ID NO: 315 - DNA, 411 bp, Homo sapiens
gcccggaaacggaagtctcgttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaaaaaaaaaaaaaaaaaaaaa

SEQ ID NO: 316 - DNA, 1163 bp, Homo sapiens
ccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctcc

SEQ ID NO: 317 - DNA, 2250 bp, Homo sapiens
gaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagcacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaaaaaaaaaaaaa

SEQ ID NO: 318 - DNA, 694 bp, Homo sapiens
aagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaaaaaaaaaaaaaaaaaaaaaaaaaaaaaaaaaaaaaaaaaaaaaaaaaaaa

SEQ ID NO: 319 - DNA, 1641 bp, Homo sapiens
gccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaaaaaaa

SEQ ID NO: 320 - DNA, 1199 bp, Homo sapiens
ctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcacaactaaactcagctcgccttgaaggagataacattatgatttgggcagaggaggtgacaaaatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaaccttagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatga

SEQ ID NO: 321 - DNA, 632 bp, Homo sapiens
ctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtga

SEQ ID NO: 322 - DNA, 2210 bp, Homo sapiens
cccaaaaaacatttacccagaatacaaaaaaaggacagtatagtggtcagattcccagtgacaataaacaaatcctcctctcttcaatgtttactgtaaagccagttaactgccatttatttgaaagaagaaaagaaaaacaagcccccagattggtaaacacattggcaagttgctagactccaagctggctacccttgtcaaatctgttcgagttttttcaaaatacttgggctttttaacgcacccagcctgctgggcacagttaagtaaaaggcatttactataatctaagaattccctgctattatcatttttaaatgttttcacatttttaaaactgccttacccttttggatgtatttggattccataaaggtgagtacaatcaacgagaaactgaagtgggagattctacgactgcccagagggacacgcatgcatggggctggttgtgggtgctgtgtgcagtccagaggaatcatgggagaaaggaagtcaagtccttaaacaccctacagaaacaaacactgcaatccagtatggcttattcggatgcatttaccatgaagctaccagaagaaattcaacctacgaggctactcttaaatgtaacaggatcggctatgttgacgatgtacccctcccaggaattccttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggag

SEQ ID NO: 323 - DNA, 568 bp, Homo sapiens
ttttttttttttcacagtaaagtattgtcatttatgtatctttaacaaaagataaaatacaaaacggacacaacatcagcctttatgttgaaccaccctgtttaggtaggaaaatgaacattgtttttcattcttaaagtaaataggaattaaatctatttgcattgctgtttaatttcataccaatctaaagctcgacactatgtatatccaaagtacttgacaatttgactcagttactcacaccactgtttctgagatgctgacttaatgcagtatcctacaggtggtttttggtagtttagaaaagccagtgagtgggctgttaaaagttgatatactgatgtcagaggttttgttaggctgttttcactgattctactctgtcagtattatcttcacagtgttctgagaagaggcttcaggatcatggcaatctattactaatatccctagaagctatccttataattctttcaataaaccaacttcaggttttgtttttttgcaaattttacaaacaaagtaacagctgctggctataaatattaggatattctacaattta

SEQ ID NO: 324 - DNA, 707 bp, Homo sapiens
ggttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgctgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggttttatgtagaacggggaacaaaaaaacaaaaaaaaa

SEQ ID NO: 325 - DNA, 927 bp, Homo sapiens
  misc_feature 703: n = A,T,C or G
ggcaagggaaagaaggtggctccggccccagctgtcgtgaagaagcaggaggctaagaaagtggtgaatcccctgtttgagaaaaggcctaagaatttggcattggacaggacatccagcccaaaagagacctcacccgcttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaatgggggtcccttactgcattatcaagggaaaggcaagactgggacgtctagtccacaggaagacctgcaccactgtcgccttcacacaggtgaactcggaagacaaagggcttggtaagctggtggaagctatcaggaccaattaccatgacagataacgatgagatccgcgtcactggggtggcaatgtcctgngtcctaagtctgtggctcgtatcggccagctcgaaaaggcaaggctaaagaactggcactaaacgggttaatgtgccctgggggagtttctgtctacaatattgatataaaattttccttccaaaaaaaaaaaaaaaaaaaaaaaaaaccggcgttttttggggggaaagaaaaagccggcgtattccccccttttaaaggagagcgcgcctgggaatatatat

SEQ ID NO: 326 - DNA, 3535 bp, Homo sapiens
gcagtacacgggaggcttttaattccattgtggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcacaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaaaaaaaaaaaaaaa

SEQ ID NO: 327 - DNA, 582 bp, Homo sapiens
  misc_feature 145: n = A,T,C or G
caacaggtcaaaaagaacctttattactttttatgattgccacttatgctttcttgccagatgcctttggagcaggtgctttctgggctggagctttttgacccttctgagcttttggagcaggcgctgctttctggcctgtggntttctgggcaggaaccttctgggctggagcctttttactcgcggcggtgatcttttttgctggaactttagcagcagcagcagcagcagcagcagcagcagcagcagcagtacccttagtaccaggtgcttttttttgggagaagctttcaggagagctgccttttgaagcttcttaacttcattcttggattatctgttcctcagtttctttgccttccaaactttaaacggataaaatctggcaatcttggcgttcgttctccgggcctcagcttcctgggccaaccgggtgggctgcccaatttgtatttgatgtctgccttctgccaggcctgtcggaacatacttctggttgggcactgttcgggaacttgaaggatgaaatcagttgagctgcatgcaccggaaaggcattgctgttctcctcactttgga

SEQ ID NO: 328 - DNA, 501 bp, Homo sapiens
tcattttaactatgtttattgtgcacttagtaggccagatactcttctgatatttgagaatacagtggtgaataacacaaactccatgctttcaagattcccacacccagatactaagacatattaaaatttacagcaattaaaacagtgtagtttggtacaataacacatatagcaatgatacaaattaggggaaaaaaccctggcttctataacaagtgagtatacattaaagacagtattgcagaatggcttcaggattaatttgattaatttagagagagcctatttcaggtcttcctagctcatccacacacatcacctttcagtgttctttataggtacttaaaacttaaaaaaaggcccaggcgcggtggctcctgcctgtaatcccagcaccttgggaggccgaggcaggtggatcatgaggtcaggagattgagaccatcctggccaacaaagtgaaaccccgtctctattaaaaatacaaaaaaattagcc

SEQ ID NO: 329 - DNA, 3658 bp, Homo sapiens
ccaggatctcctctgggggagttttctattaccagaaacttcattacatcagaatccaaactcatgatcctctcttgaaaacagacactcctcttgagctcctgggctttctcgtttcctcctttggtggtgccatgacgctcccagctgccctggcctgccatccttgctttgttgtgtccccagacacccacagtcagcaagtcctgctgaatcttcttccagagagttgttgaattccagcctgggtgacagaacgagactctgtctgaaaaaaaaaaaaggaggaatgatactacctgttaatgatactacctgttaggattattggggtattaaatgagatgatttgacaaagtgccatttaaagtatatagcattagataaatattttatcttttgtggactttaacaaatagtttattgatggaaattttttaaaaaagcttttaagttacacattttaagttcctgctactgaaagcaggattaactagtctgtagaataatagtaattttttaattttgtctccttagctcattacctaaaggacttattgtaaataagctatttaagatcttaagaaatactgtatttttttaaatggaaggctaagaaaaacataaacagcctaagcatgtgcattaaaactttgttgacttataagattattcaaaatatgttattttaattttggaattatattgtttactttaggcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggacctttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgcaaaaaaaaaaaaaaaaaaaa

SEQ ID NO: 330 - DNA, 601 bp, Homo sapiens
tttttaacatttgatatttttattgatttttaaatttaaaatccagttttaaccacaaaattgtttgaatcacaagtggtaatacaatgtcttcaatatttttctaaagttatttttctatataataataagacaacagcatagcatataggaagttttcattccagtggcttttttatatatttatccttcttaggaaggacaaattaaattttttaaattaaacttttaaaatataacaacatctaacagaactgtacaaaacaaagagacattttttaaacaacttgccaaacttacttatgagtgtgttttaaaaacaactttgtaaatgtctgggcaaagaagcaagctgtcgtcctccctttaccttcatagtgagtttgtaaggctttgtctttgtaagcagaaagagtagactgtgttgttttttgccaaaaactgtttatacttaatctcactgaagtattgctatatggagaacccatactctgatcaacttgattttttgtgtgtaatgcttgatctaccaggtaacttcccaactgctcctaatgctagcgggctaatcccacattattattccactatcatccctgca

SEQ ID NO: 331 - DNA, 1381 bp, Homo sapiens
atgcgcgatctcccggagcatgcgcagcagcggcgccgacgcggggcggtgcctggtgaccgcgcgcgctcccggaagtgtgccggcgtcgcgcgaaggttcagcagggagccgtgggccgggcgcgcggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagaataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacgggagtttggcctctcatctcagtggatatatcctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagtcgagctttctctcagagcatgcttttctttattaaaattactgatgcag

SEQ ID NO: 332 - DNA, 464 bp, Homo sapiens
tgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatg

SEQ ID NO: 333 - DNA, 1552 bp, Homo sapiens
aactgtcgtacgtatgtcttctgtttcgtcctcgctttccggctgctgtttctccacggctctcctctttccccctcccttctctcccgggcggcttactttgcggcagcgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaaaaaaaaaaaaaaaa

SEQ ID NO: 334 - DNA, 444 bp, Homo sapiens
tttttttacacaattgcaggagattttattggccccatgacatccagtgacagtgtgggagcaggctactctccagggacatgtttttggaggcatatggagaagggggcccaggcgaggtggctcacacctgtaatcccagcactttgggaggtcgaggtgggaggatcgcttgaggccaggagttcgagaccaccctgggcaacagagcgagatcccatcactacaaaaattcaaaaaattagccaggcatggtggtgcacacttgtagtcccagctactcaggaggctgaggtgggagaattgcttgggcccaggaattcaaggctagagtgagccgtgatcaccagtgcactctagcctgggcaacagagaaagaccctgtctcaaaaaaaaaaaaaaaaaaaaaaagaataggaagcttctgatatttgtctttctgga

SEQ ID NO: 335 - DNA, 1216 bp, Homo sapiens
gtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttccgcaccagaatctatcactgcaacatcaacagtcagggagtcatctgtctggacatccttaaagacaactggagtcccgctttgactatttcaaaggttttgctgtctatttgttcccttttgacagactgcaaccctgcggatcctctggttggaagcatagccactcagtatttgaccaacagagcagaacacgacaggatagccagacagtggaccaagagatacgcaacataattcacataatttgtatgcagtgtgaaggagcagaaggcatcttctcactgtgctgcaaatctttatagcctttacaatacggacttctgtgtatatgttatactgattctactctgcttttatcctttggagcctgggagactccccaaaaaggtaaatgctatcaagagtagaactttgtagctgtagattagttatgtttaaaacgcctacttgcaagtcttgcttctttgggatatcaaaatgtattttgtgatgtactaaggatactggtcctgaagtctaccaaatattatagtgcattttagcctaattcattatctgtatgaagttataaaagtagctgtagatggctaggaattatgtcatttgtattaaacccagatctatttctgagtatgtggttcatgctgttgtgaaaaatgttttaccttttacctttgtcagtttgtaatgagaggatttccttttaccctttgtagctcagagagcacctgatgtatcatctcaaacacaataaacatgctcctg

SEQ ID NO: 336 - DNA, 123556 bp, Homo sapiens
gatctctgccttcatagcgagtccagtctgctgcttttactgtgccctgggtcagaactttgatgattagttacaggaaagggccaggaagagaatctgggctgtgattagatctgggaatgacctttctggggtggaagttgaggacatatgagtaggtgttctgtggaggaagggaggttcagtaaggatgccatgccaaggcagcatctgaatggcatctgggagaactaggccagggagcttctgtgatctgaagtgtacatttcctgagtatgtgtgcatgtgcacatgagcttgctgtgacccagtatgtgtgtgctctgtgtgtgtgtgtgttaagtgatgtccttcttacatcatggacaaacaggttatgctgtgagatgcagaaaagggattctggttactttgggggcagattctgcaataaaagcgcagatactggcaagggctccaccacccagggaggaattcatgataatggcataaagcatggcaaaaaagaaggaagaagtagaagtatgtctaaggataaaagtgccactttgatcaaaactattaaaaataggtaggaatgctgaataaatatgaacttagaccctgaattctcattttgggcgtaatagacttgaaatggccgctgaaattatactatcaatgaaatgaaattagtcatattaaatgtcgtaatcatttaatcgtattaaatataccaatatatctttggactcttctattcatttgaatagataagcactgccatctattaagtccgtgttgctgtatcctgcagaatggtatataaagctagaggtactttatgcacatgtatatttgattattttctgctattaaagcatggctaaaacctcagtaatttggaagtaggcagattagagggagaagtcttgttgaagttagtgggatatttgcataaaaatgcgcttaaatttttttcttgtttttttgttttattttgttttgtttgttttgttttttttgttgttgtgtttttgttgttgttgttgttgttttgaaacggagtctcgctccgtcgcccaggctggagtgcagtagcacaatctcggctcactgcaacctctgtctcctgggttcaagtgattctcctgcctcagcctcccgagtagctgggatgacaaatgcccgccacagtgcctggctaatttttgtatttttagcagagatggggttttgccatgttggccaagctgacctcgaactcctgacctcatgattcacccgcctcggcctcccaaagtgctgggattacaggtgtgagccaccgcacccggcctcttggttcttaaagtgagtaaagcaaagctaataaagctgtattaattaaaggttctgagaatgttttccttgatggtaagggtgggataattgtatgaagaatctttattatttgctttgaaatatggattttgctaagtcagggtttagtgtctggcagcagtttgcattactgaatagctcaagtatattccctgcagtcttagcccacgtagttctaaaggtaggtacaatggtgtcctttgacagtgctggtaaccctccatctcccttcatgaacatctgatcatctaccttgcatttttttctgttgcctaaaatgcctgttagaatgtgttcctttgtcttcaaatgttctattgtacacagaatgttctatttttttttattctgttttgttttgttttgtttttgagagagagtctcactctgtcgccggggctggagtgcagtggcgcaatttcggctcactgcaacctctgcctcccggatttaagcgattctcctgcctcagcctcccaagtagctgggattacaggcgccgccactactcccagctaattttttgtatttttggtagagacggggtttcaccatgttggccaggctggtctcgaactcctgacctcatgattcacccacctcggcctcccaaagtgctgggattacaggtgtgagccaccacaccggcctagtgtctttttttttttttttaaccctgagaaagattgaaggaatggcttgcttgaaaaaattatgaacaccacagccagtttgttcatagagcaaaaactgttccatggatgagttgggaggaggagtggtatattaatcccatctccaaagaaatacttgagactgggtaatttacagagaaaagaggtttaattgcctcatggttccccaggctgtacaggaagcatgatgacttctggggaggcctcaggaaacttccagtcatggaggaaggctaaggagaagcagcatgtcttacatggtggagcaggaggaagacagaatgagggagtaggtgctacacacttactaaataaccaactctcctgagaattcgctcattatgcagtaccaagggggatgatatgaagccattcatgagaaactgcccccatgatccaatcatctcccaccaggcctcacctccagcattggagttacaattcaacatgagatttaggtcagaacatggaaccaaaccatataaaatggagaggtgctgaaaagggtgtttcagaataggtagatatagcaacattgttgtacctccctttttcccctcagaggctggtatctgacatatggtcagtaatacattatatttcttattattctagccacaaaatttacacacctccactcccctctctaaatgaccaaggatttcatcagcaaaattgcaataatgtaattcttacgttttagccaaagttcctatacagtcggtgtaattgaatggaccagtcagttcagaatcagtcagttaaagatataaaactgttgccggggctatttttatatgccccactttaaagcttcagatttaaaacaaataacatcagtaaaatgaaagtgaagggatttgtatttcaatggtaactaaagtaattgtgatgttccagatttatatgttctctagacagataattacactgccatataggatttttagaaactgcttatttgaatgtacacaataaaaattttaacatatacaaagttagagagaatactatgatgaacccccacagactcatctcctggattaaaaaattatcgacatttttgctttatttatcccttaaatttcttgcaattgttatggcatactgtgaaacaaatcccagataacacttcaattcacccttcaatacttcagtatgtttctcttaacagataaggccttaaaaaacataatccaccatatcattaacagacctactaaaattaacagtctccttaatatttaatattcaattcagagtcagatatccccagtgtcttaaaaatgtctttttaattgtttgcttgaattactttccttaaaatgtcagcacatttggtctatctatctcttaaccttcttttaattaataacagctcctcccactcttttttttttctctgcagtgtattctttgaggaaacctggttatttgtctataaaatttcctatattctagatttgctttattcttttcatatccttgcccagttttctcttgggttgttagtgttactctctcaattttttagaagctctttgtttattagggatctgtgatatatgtcgcaaatatttatgcccagtttgtcgtttgcctatttactttatgatagttcaggctgttgagaaaatatttagtatattttcctttttttccactctcctcccatctctgcgctccccagtttaattgcttgtatcatttctgttagtgtttatgcctttaaatagtccagacactattatttttcagatatgaattataaattttgatttagccatgaaagatgaggaattcaatacactaatactctctatcaactttataagtgacatcattatgttatcataacatttacatatttttcctatgaccataatcttcccatttgttttaacatagcacataaatgggttaaataattactattctgtccatattttcaatttacctctttatgttagtaatttttttgctgttctttttagttgtttcttaggaataaaaaaacaactggggattatataccctgagtttctgagggtgaatgacagtttcattacctgtagagtttttgggtccccctttcttatttctccgctatttgttagcattgaatgctattttgtagaagtctgagaccactctaatattttccaatcatattgttgagagttctacttagttctcagagaatttttctttatatttgaatagaatatatcccaatgttattcactctgtcccaatgttattctgtcattttttctgaaacccagtgtcactatctgttatgtagaatcaaagcttatttcatttatgcaaagctttccttattttttgagtatatataatatatgctaacatgtacttatgtttactctcctttacctgtcctccatattttaaaatttcccagacttttacatgttttcttcatttccatttcattctgcttacttctctccatcttgttctctatgtcctttacaatgttttcagcattaattgtcaatctttgcattgctttcaatttggctttcatttctgtgataattttatttgtttttcttccacttctttgacaagtgcttctgggtcatgtttagcttctattgacttctacatattcctgaatctcataactctgatttgttgtcttgttgtttagctgtgattccttcatattaaaaaattggttcaacaccagcctggccaacatggtgaaaccccgtctctattaaaaatacaaaaaaattagctgggcatggtggcaggtgcctgtaatcccagctacttgggaggctgaggcaggagaatttcttgaacccaggaggcagaggttgcagtgagccaagatcatgccactactctccagcttgggcaacagagcaagactccgtctcaaaaaaaaaatttgatggtgatatgatatgatatatggtcatatgataggtcacatgtgtttcttggcaatatttttccaggaagtgctatttgctgtttttttctgtccttctccctctatggcagtgttcctggaaaccttttgggatcttatctacttcctagtaatgccactcttctgcagtaaggataattataaggcagcctcttttagtcctgtctcaacagaatttttctggcagaaataactcaatgctggtggcttctacatgacatacttctagtttgccagggatgagctaggtctgagaacactctccctccttttttaacaaatcatggtcatttcaatagtactctcctgttttcattatacctggatgtacctagaagatttctgacattattttcagaggcaacagtctgtacttactgttctagcccctgctgctcagtagttttgatgtctgaataacctgagatagtctatgttccaggaaagtgtcaagctaacttatgattgggactgaataagactcagctttggggataggagaaactgaaagctaaataacaaaatattaatggcttagagtactttttcactgctgtgtgtgtgtgtgtgtgtgtgtgtgtgtgtgtgtttcaaaaataagataataattttaccgttaattttcagaataactttttattgctctgtgtagcaagaggacaagtggaaggattttagtcatctgtggagaaggcgagccacatgcgtaggagacttgatcaatatgtatatgggatacataaatttgtgattcattggaataaaaagtggagggggctaaaattagcattagaaaatggaccttagaagagatagacaagcatatatggaaagactggttcattgtgagctgagaatggattgttctttgcacaaagtctgagttcaattagaatgggtttggtgatcagaaggactttgatccctgtcctggcgttgccataggctcactctggaaactagagacaactgagttgatttatctgattctaaacttctgcacctatatcatgggaataattatatctcaggaataatgtaagaaaaaaatctaactaatatcttgtttggtggttaagtgttagccctattcttcttttccttagtagatatttcttagcaaaataagaatataagattgacttttatgatagacttgagtgtcctgatagaaagacactaatattgggggacttggaatgtcataggagaaaaggtggtcaacacattaaaatatacagagggacattcacaagaatagatattaaatattaattaccatatgaagagcatttgacatttataacttattttcatattcattttcttacttgatacaacaagttggtgaggagatattgtattcgtattttacacattgcaatatttagactcagcaatgctcaggggcttgttcgtgatagaaaatgacagaaacttggccaggagttcctaccacaagtccagtgctcggtatacaatttcatgttgcctttgaaaatgccttttgcaagttacttatctcctttgggccttcatttcctcatttgtaatgtgaaatattttcattagcagaccattgcagttctttcttgcctttaacaacattagggcctttagaatgagtacctggtgctgtccttccaactctgtgattctctgattccatcctcatttttcaccatcactggtgtactggcaagaaccagtatgagatttgaggaaaaatacttggattactcttttttaaaaaaaattatttagatataattcccataccatacaattaacctttttatgtgtataattcagtatttttagtatattcacaaagttgtgctaccatcaccactatccgattccagagcttgtcatcatacaaaaaagaaactgtacccattagttactcccctcattgttcatctccctccctgcccctataactctctagtccttggaaactactaatctaatttctgtttctatgggtttgcctattctggacattttatacaaatagaatcatacaatacatgctcttttgttacttctttcaccttagcatattttcaagcttcactgatgttgcagcatatatcagaacttcaatccttttcatggctgaattattttccattgtatggataaacttttcattacctgttcatcatttgatggacatttggtttgtttccaatttttggctattatgaatactgcttccatgacaatccttgtataaatttttgtctcaacacctgttttcaattatagtgggtatatctataggaatggaattgctcagtcatatgtaatttttttatttaattttttgaggaactgccagattgttttccaaagtagctgtgccatttgcattcttaccagtagtgtatggattttccactgtttccactttctcagcaactccttttattgtctgttttttattatagtcatcctagttggtgcaaagtgttatatcatgatttttacccacatttcactaatgtttaatgatggtgagcattttttcatgtgcttatgggacatttgtatatcttttgttggagaaatacctacttttaaaaaatggactgtcttttcattgttgagttataggagttccttatatattttagatactagacaattatcagatacatgatttacaaatattttctcccattaatcgattggctttacacattcttcatagtatcctttgatgcacaaaaatgtttaattttgatgtagtccaatttatctgtttttttcattgattgtgcttttcatgtcatgtttaagaaatcattgcctaatccggggtcacaacaattaacacctatgttttcacagatttcatgttttacatttatgttttcatggttcatagagttttacagttttagctcttacatgtaggtctttggtccattttgaactaattttcatatacagtatgaggtagtagttcaacttcattattttgtatatggagatctagttgtcctgacaccatttgttgagaagactattattttctcctcgaagtctcttggggcccttattgaaatgcaattcacaaatgtataggtttatttttggaatctcaattttattcttttaatctatatgtctatctttatgacagtatcaaactatcttgttcatagtagctttgtagtagcttttgaaattggggattgtgagtcttccaactttattcttttttcaagattgttttggttgtttggggtcccttgcattttcatgtgagtcttatgatcagattctcagtttcttcaaaagctacatctggaatttaattgggattgcatagaacctgtagatcaatttggggagtgttgcaatcttaacaatattaaatcttatagttgatgaacatggatgtctttccatttaatttaagtattgtataattcatttcattggtgttttgttgattttattatgttttccatttatttttgctaaatgttttctaagtattttattctttttatattattctaagtggaatttttaaagttttgtcttcagattatccattgtttgtgcatagaaatacaattgatttttgtttattgatcttaatcttgcagccctattgaacttattagatctagtagtttgttttgtggattgcttaggattttctatatacaagattatgtcctatacatgtagagatagttttacttcttccttttcgatctgaactacttttatttctttctcttacctaatttttctagctatacctttaagtccaatgttgaatagaagtggcatgagcagtcttgttcatgatcttagagggaaaggattcagtccttccatcattgagtatgaggagtatgaggttagctgtgcagttttcatagatgctctttattggttgaggaaattccctctactcctagtttatggggtatttttttttatcatgaaaggttgttggattttgtccaatgctgtttctgcgtctatcgagataataatatggtttctgttttatattctactaaaatggggttattacattgactggttttcaaatgttgaatgaatcttgacttcctagaataaatcatgcttgttcatgttgtataatacgttttatatgttgctaaatttcttttgctagtattttgttgaggatttttgtctctattcataaggagtaattatatgtattttttatgatgtctttgtctggttttggtatgagggcaatactgccctcctagaatgagttgggaacttttccacacacattaatttgcacctgctttggtcacttaactgtaaattcagaagtaactgtgtcagttcatagatgttttctacatttctgtgcagctgcatagttaattccatggatttgtcatagttattaaaaattttcctatgtatgggaaattattttgttattacgaataagtttcaccatgaataaatttggacatactttgttttatatttgtggaagtatacatttacaataagtttttagaagaatgtttccttgatcaaagactaaacacatacgtaatttgtcagatattgctaaaatacctcccatagtggttttaccattttatacatccactaaaaatgcataaggctgcctgttttcttatgcaatttccaagataagggctattttgattttctgaatatctgatagattttttgaaatatctcagtgtaatattactttgcatttctcttattatgagtgaagtatttttcatatgttcagggccatttgtgtttctttttccatgaattatctgttaatgtcttttgatcatttatcttgttttttgtattttttattattatttaaaagcttttgtttaccaggaaaattagtcttttgtctatgatacgacttacatagattttctcccagtttgccatttgtgtttcatcctctttatgacatgtatattttgcaatgcaaaagtttttttttgttttcatgcagatagatttatcagtgctctcttttattgcttctagattttgagttatagttagaagactttctccacatctaggttataaaggaatgcccccaatgttttctttcagtacttctgtggtctcagttttttaacatttatatctctcttctatttgaagtttattctggggtatggtgtgaagtaagtattcaattaatttttttccaaagggctattgaggtgtcccaagccatttgttaaacactcatcacgtcttccatgtgatatgattatcatatatactaaattaccataagtccttgtatttatttgtgtactttctattcagttaaatgttctgtagaccttatttatgtcatgacctcacaatctatagaagctttagagtatgttttaatatctggtagcattagtcttccttttattgttattctttctcagagttcttacatgttttgttttctatatgaatgttataattcacatgtttaacattagaaaaaataacttatatttgttgaaatagccctaaatttgtatattaatttggggagtattgacattattatgaagttaacataggctatccaagaacaataaatgcccttttaattgttcaaatttacttttgagcctctcaggaatgttttaatgttttcttatataggttttagatactgtattcctaagtagcttttgaccgatttatctgtgtgtgtatatgtctgtataatattatttttgtgtgaaaattttaaatcatgccaaaaaacttaatttttaaatgttatgtaatttaattttgatatttgttgtctttggttttccaaatatattatatgcaaaaacttctaattcttatgcctccaactgttttctctcactatgaagttataatggacatagatggaatatttccattgtttgtctccttattgacaatgttcataaagaatcccaaacaacttatctataaacacatacatttatatttgtgtattttgtgtgtgatatataatgttacattatggcattaaattttgtacaacctgttttcagcatctgtgtaaaaaagcttgtgatttttttttagatttatttaagtggcaaataatagatttcctaatataatatcatccctctaattccagaataaatctcattttgcaataatggctttctttctttttacttttaatgttcaattggagtctgcttcgtattatgatttgaaaattttcttcgatatttatgagattggtctgtagttttttgtttgtataattttattaggtttgtgatcaatattatccttccttcattagcagaatgaaagtttttcttttattaggctctggaacaatttgagtggcagtgagattaagccatatccagtttcaatttaaaatctctatgaaggccaggggcagtggctcacacctgtaatcccagcactttgggaggccgaggcaggtggatcacctgaggttaggagttcgagaccagcctgaccaacaaggtgaaaccccatctgtactaaaaatacaaaaattagccgggcatggtggcagacgcctgtagtcctagctactcgggaagctgagacaggagaattgcttgaacccgggaggcagaggttgcagtgagctgagattgcaccactgcactccagcctgggcaatgcagcgacaaaaaaaaaaaaaaaaaaaaaaaacctatgaaataaatagtctttacaaaattagtacgtcagaattctctagtgaaaaataatatgtgctatttcagactaataaatagtttcataaatgttttactaaaagtttagtaatagttaaccttgcttaatatttgataatagttaataagttaacaaaaatattcaataaataatttgatattatataatttgaccttctcttcaatctcataaacctattattatgcccattttatggacaagaaaaccagaggtcagaagagtaaagtggcttcccaagccacacacttaatgagcagcaatatagtaatttaaccggctttcattaatttcagaactgccagaatttttccttccataaggacttccacattctctttctctgcctgggaagattttccccacctctttttacctagctaactccaacattctcttctaatgttaccttaaatataattttcccatggtggccttatctagccaatgccccacccctcaccccctacctctgctcccaaaggattcctgttataaactctcaacaggctatacttattcgttggagcttgtattaagtaatcatttatttaattagcttttttttttggtgggggggatgtcctattagaattcaagctccgtaaggtcagagtccttgctttcctcattctccattatatgcctaatacctagaataatgctgagcacctagtaggcactagtaaatatctgttgtatagatgaataaatgaatgattttaaacaaacattgtggaagaggttgctgcatgagatactcagagtctgaaggatatcagaaaattcaggcatcattaccttaatggataggaaggagactggcataaacatgccctaagaaggaaagtaggcatttctgtgaaagaaagacaatgcagagctctttttgtagggtttcaagtactttatgaggtattgtcatttccttcccacccccgcccccagccagagtcttgccctgttacccaggatggagtgcagtggcgcaatctcagctcactgcaacctctgcctcccgggttcaagcagttctgcctcagcctctcaagtagctgggattacaggcacccgccaccacacctggctaatttttgtatttttagtagagacagggtttcactatgttggccaggctggtctcaaactcctgacctcgtgatccgcccgcctcagcctcccaaagtgctgagattacaggcatgagccactgctcccagccctatcttttcctttcttaatttatcaaagaaaagtagtgaataaggacagctgggaatggaaatttttcttaagtttactaaataatgtacacagcttctgctctccgtatcactttattgtcaatgataacattaaattcttaggctgcgctggagattttagtacgtttgaaaaaaaaaatcattatcattgaaaacagtggacccgtgcttcctccccaaggaaattaggaaatatcactgatttcagtttgaggttaaaaggtacttttggagaaagataatgggttttaaaaaaaatgtcaacacaaggacatgtctatatgagcacagtagtttgactattttgaagttatttttcttcttttgtacctttttatttccatacccttttcttttttgtctgcatttcacccttcccttgactgatcagccaacaatggaacaattaaagtagttcctgtaaattcactcagactatattttcaggtctaaaatttctaaaggtgcaataaaaagagttccgaatgcaacattccactctgtggcgagcttgttgtaactgcctctgagatggtggctaccgtcatacatatgaatgagacaaaggaacttgagagaacattttgagtgtttttgtcttttaagcatttcatattcaatactttttggttatttccaaaactcctgctctcagaactgcacatggcaaatataaacatagttgatggtaatttctaaattttcaattgaaaattgaaatctagcatttgcatgacattctactctatgcatgctgctggtcttgttcaaatgtttactttctcagtgaagccttcccatgtctcagcctccttgccctgaagacacatgtacatacatgagactctatctttccctttccttatattattttagcatttaaattggattatttcagaagacttgagggaaatgttttgatcacttgcacggcagcggacatacttttaggagttagagagatgaggaaagagagtgtatattttatgagccttgctttgccctttctctaataacatcaatagcagagccctgtccctgagagatacagtttcatggacatgtgttcctgaagctaacataatgctgaacaatctcctgcccttcatggtagttatctcagtaaataatatctcaacgtcctcttatgtagagatattactgagtgaaacttgaaaaatgcctatagaggccaggtgcagtggctcatacctgtaatcccagcactttgggaggccaaggcgggcagatcacttgaggtcaggagttcgagaccagcctggcaaacatggtgaaaccccatcgctactaaaaatacaaaaattagccgggcgtggtggtgggcacctgtaatcccaactactcggggggctgaggcaggagaatcgcttgaaccctggaggtggaggttgcagagagccaagatagcgccactgcactccagcctgggtgacagagtgagactacatctcaaaagaaaaaaaaaagaaaaatgcctatagaatgtaaataaactcctcaaaattgttgaatgataggccattattaattataatttatattcaatactttaaaaatacctacagaggcacttgaagaggccaacgatattccaaaatccattttggtacaatctcttgggacactaagaacctctggctatacactacaggagagattctcttgtagagatgtctctggaaagcagatatacaatatctggctttggatttgctggcacaatgtttggccgatgcggaagtagattttaaatccctggggtaaattattcagttttgcaaaaagtaattatttgaatagaggtctagtgccactgctttgatggctcaatgatgacacggttcacatcagggatggaaatatttgtgctttcctatttgtttatagatctttgcgtatctcaggaggcatattaagccttttggtagaggctgaaatttaggtagaggctgaaatttaggtagataaagactgttggaagtacgcaggatcaccctcccaaggatcacccttagtgttaagtgttaggattagaatttagaaccccttggttcttgcttttgttaagaaatattgctaaagggaagtgtagatgaaagcagttttcaggaaggacagttgtgtgctagaactggggtggacttatttaaggaggtatggtgatcaattaaatatttggacattttaatgttagctgtcacgaatgtggtcccatggagcacatgatagcatattctccatggagagcataataacatttctgaatgcccatttatgccaagctctgtgctatgtacaccatacacattatctctaaccttatcacaacctttcaaaatattactatccttattcaacaggaaactgaggctcagtgagatataaatacctgcccaaattttatgactaatgagtgcctaagccaggattcaaacccaagtctatgtgattccaaagacaccaacaaaatgttttcatgtgaataatcatatacatcaaataactatatcatataatagaggagtgagcatatatgagacagaagtgacatttgaaggatgttactagtttcctgtggctactgtaacacattaccacaaaccgcgtgaatctaaccagcagaaatttttttctctcacagttttagagtccagaaatccaaaattgagtctgcagagttgccctcctctggaggttctaggagagtctgttcttttccttttccagattccagtggcttgtggcggcatcactacaatttctacctcactggtcacgttgcctcctcctcttctgcctgtcaaatctctctcagccgcactctttttttttatttgtggttttaatagaactacatgattttctcaaattcatgtcttaatttgaatagtcaatctctaactgcttatgtttgatttccttctatttatttatttacaggcagggtcttactctgccacccaggctggagtgcagtggtgtgatcatagctcactgtagcctcaaactcccgggctcaagcaatcctcccacctcagcctcctgagtagctgggactacaggtgtgtatcaccaggtccagctaatttttaaattttgtgttgtacagtggggtcttgctatgttgcccaggctggtcttgaactcctggattcaagctatcctcccacctcagccttccaaagtgctgggaatacaggcgtgagccaccacactctgtcagtgttttacattgcttccagtttttcactgttaaaaattatgctactataaaaataactggtttttattctcatacattatttatttagggcaaattctctatggttttctgccatagaggaatatgatttaataatctttttccttgtgagagcttatgctctgaaaaacgaaaggagataactcctacttttttttttaaattatactttaagttctgggatacatgtgcagaacatgcaggtttgttacataggtatacacatgccatggtggtttgctgcacccatcgatccatcgtctacattaggtatttctcctaatgctatccctcccctaaccctccaccccctgacaggccccggtgtgtgatgttaccctccccgtgtccatgtgttctcattgtgttcccacttatgtgtgagaacatgcggtgtttggttttctgttcctgtgttagtttgctgagaatgatggtttccagcttcgtccatgtccctgcgaaggacatgaactcatctttttttatgtcagtctcgctcctataaaggacacttgtcataggatttagggttcatctggataatccaagatgatctccccatctcaacatccttaacttaattatatctgcagatacccattttccaaataaagcaacattcataggttctggagattatgatgtagacatgcattttggcatcgctaccattcagcccactacagtacataatgaatttgtattagtcagggttctctagagggacaggactaatagtatagatgtatatatgacagggagtatattaaggagtatcgatgcacatgatcataaggtgaagtcccacaataggttgtctgcaagctgaggatcaaggaagccagtccgagtcccaaaatctcaaaagtagggaagccaacagtgcagccttcagtcgtggtcaaaggcctgagagcccctggcaaaccactggtgtaggtccaagagtcaaaaagctgaagaacttggagtccagtgttcgaggacaggaagcttccagcacgggagaaagatggaggctggaagacttagccagcctagtctttccacgttcctctgcctgcttcttttcctatccgtgctggcaactgatagatgggcctacccagattgagggtgggtctgcctctcccagttcactgactcaaatgttaatgtcctctggtaacaccttcacagacatacctaggaacaatactttgcatccttcaatccagtcgacacttaatattaaccatcacatctctatggtcagactgagttggactagggtctttgaccccttctcccaattatggcttcctggaggagatggaagtgttggggttctccaaaaggcctgaggagatggttaggtctgatgaaaagttgaacagacaaagggtacacagagcacgtagcaggcttattcctgtgggctcaaaccagccaacatgaaatccttaatagaaagtttaaatattctatgggataaattatttttagagtgaatattcacagtgtagactctgtcttcaaggaacttgcattctaagtggtgttataaataaagtttcggtgctgcaaaagaaatagcactcgaatataaaattttctttttttcttctcagcaaggcgatttacttctatagaagggtgtgccctcagctgggcgtggtggctcacacctgtaatcccagcacttttggagtccaaggcaggcagatcacgaggtcaggagatcaagaccatcctggctaacatggtgaaaccctgtctactaaaaatacaaaaaattagccaagcatggtggcaggcacctgtagtcccagttacttgggaggctgaggcaggagaatggtgtgaacccggtaggtggagcttgcagtgagccgagatcatgccactgcactccagcctgggtgacagaatgacactccatctcaaaaaaaaaaaaaaaaaaaaagaagggtgcaccctcacagatggagcaatggtgagcgcacacctggacaagggatgggaaggggttcttattcctgatgcacgtggcccctgctgccatgtcattcccctattggttaaggttagactgcacaggctaaactaattccaattggctaatttaaagagagtgataggatgggtgagtggtttggccagaaaaatggttatgacagagcaggaaatcagaatgagtcagggtggagcaggaaatcagaatgagtcagggtggagcaggtgatcagaatgagtcagggtggagcaggtaatcgaaaaaggttgctttatgaggaagttaagtttaaaagtagaaggcaaagaattgaacacactgacattgattctttgaagagaaatttagaactcatatctaacagtggcatgacagttaattgaataaaacatgagtgtatcctaaacagtcaatcagagcctgtttttcttatctcattgtaaaaaaaaaagtctatagcaaaaaataaatgttaagagaagaaacccccatattaaggggaaaacacaaagtttgcagagcagaataacacccaaacaaacctgctctcagacaaaactactacccttcctttctgaacaatgatgattagagtcataccatcactattttgacttagggccattaggattaatcctcaaatatcccaggtctcctcatctttatattttccttgtatatctttgttttaatcctgtctctcaactcttgtaaaccttatactttgtcctctggaaatcagagttggtattcgagaaaatcccacttaccttcaacaacttgtcttaatgtttccttcgtctacttattttaacttaaatctggttctaccctaatctgtggctcccactaaagttgtttttttttttttagatggagttttgctcttgttgcccaggctggagtgcaatggcacaattttggatcactgtaacctctgccttccaggttcaagcgattctcctgcctcagcttcccgagcagctgggattacaggcacatgccaccatgcctggcaattttttttgtatttttagtagagacagagtttcaccatgttggccaggctgacctcgaactcctgacctcgggtgatccacccgccttggcatcccaaagtgctgggattacaggcgtgagccaccgcacctggcctaaaggctttttaaatggtgatttttctttctctgacacaatgcaattactattgatcctggagttaacatagtgttctccttgctcctccttgctagtggaggactattctcctatcctcctccttccagcttggaaacttatgtccttagattatacttcccgttaccccttgtgatggtaaaatttacatgtaaccttgactgggccaagggttgcccagataattgatcaaacactaatctgtgtgtttctgtgagggtgtttttgtatgagactaacagttgaatcagtagattgagtaaagcagattgtcttctctaatgtgtgtgaacttcatccaatcatctgaagacctgactagaagaaaaaggctgatcttctcctgaataagagggaattcctcctgcctgactgccttcaaactgggacattggctttttcctgccttcgaacttctactgagacatcagctcttcctggatctcaagcgtgctggcctttggatgggaactacaccattggctctaagtggttctcaggccttcagactcaaactggaactacaccatcaactctcctgggtcttcagcttgctgcctacagattttggatcctgttagcttccagaatcatttgagtcaattttgtataatctctttctctatgtatattgctctctctctatacatacacacacacacaccctatttgctctgtttctccagagaaccctgactaataaacctccttgttacagtaatctactgactttcagtttattccctctcaattattgaggatgttttactttgtggcataatattgctcttaccaatatcatttatgtttcaattcttgttgatgtcaatatccaggtgtatgatgatcctttcaacaccctggcctctcatttcctttaccccatcttcagtgttattttcctcatcaactttaccacttgttcctatggccataacttatcttgtcattatcaataactgcaatccctccataacgtcaatttcaaacatcccacttgaccactaactcactccctttggtactctgataattattttacccaatggagacctccaatctcataactcttctaacttttctctttcacgtctcttccccttcacaacccaaatatatcctcactttcctccacactgggcttagagtccatggtccaccattaaaattactctctcatattatcttcaactcccttggctctctctcttggtaattatacccatttgacaaaatcctaagtctaattaagttgaacatgatcaaagaaaatcatacagtccttctaactggtctcactttaaactcaatatcgctagccccaagtgagtccttaatgctgcctgtcaattgtgctatatttgccaattccattaacattctcagtaactattccatgccttctcccttttcaaaattcaaatatccactaactccaacttgcttcctgtttacatgagaaaataaaaacaatcaaaagagattttcctccatccactctccccatatcttttcaccaaccagtttctatgcccatatattcagcatttttcctgttaataacggtgaactacacatacttctagctaaagcagttgaacttaacctcatccctactcaccagcaccaagatagccctcctataattttcttcttcctatcccatattattaaattttccctttctagtgggtctttctcataaacataacctgctgatatttctcccatcttaaaaaaaaaaaaaaaaaaaacgaaccaaatcaaatagctctcttgatttcactttcttctctggctgctgtcccatttctctctcctctttacagcaaaagtcctcgaaaatatagtctacatttgttgattttgagttttctcctccaacttttttgttaaaggctttaaatcttaccacttttcccaccaccttttataaaggttactgttatgggctgaattgtgtccccccaatttcctatgttgaagtcctaatcccttgtacctcagaatgtgactgtatttggagataggctttttaaaggagtgttaggttaaaatgaggctattaaggtgggctctaatccaatatgattggtgtccttacaaggtaagaagttgggcacacagagacacaagggtgcagagtcacaggggaaaggacatgtgtggactcagtaagaaaacagcttgtctgccagccaaggagagaggccccagaaggacccaaacctatcaacatcttgacctcacactttcagcatccagaagtgtgagcaaataaatttattttgtttaagccacccagtctgtggtatagtgttatggcagccctagaaaactaatatacttactggtgacctccatgttgctaaccctaaggcccattctcagtcttcatgtaacttgacgtatcagcagtatttaatatagttaattatttcctctcccttcatataatatcttcattttgctttaagggcactataatttcttcgttttcttcatacctcactggtttttcctcctcagcgtcctttgatgacttcctccttcacttccccaattctaaactttggactactccagggatcagcctttggaccttcaatacattattcatcattcccattaatgccactctgctctgagacaccattctttgcctggataatagcaatattttcctaaattgattccctgcctccacacttgcctgtttacactctattagccacatagcagccacagtaatctttttaaaggattgtgttaagtttctactcaaagctctccagtgattcctctctctatcaggataaaagctttctcacaaggtccttgtgatcttgctcctacctacctctttaacttatgccacaactctcctttcccttcattctactcagctccattggcctctttgcttttccttgaccataccacacatgcttccaacagaagatacttacgtttgcttcattttgcctggaataaactttgcccagacatttgcatgtctttctccctaacctgtttcaggatcgtgctcaaatgtcacctgcacagttaggtcttccctggctatcctgtttaaaatctgaatgcccctagcagcactcatgactctagttccctgctttcccctatagcacttaacatcatctagcataaatcgtgctttacttactgtacctacttaccacacacactgaatagaagcttcatgaagacatgaatttttgtctgttttgttcactattgtgtgcctagctcctaagacagggcctgacagaaatttggggctaatgatagtatttgttgaatgaatcaccaaattatagtatgagctcaaaatttcatggtttttctttcaatagcacttgatgaaagagtaagttattgagaaattaaaaaaaaactttcaaaaacatttgggattcaagggaagaggatgctggaaaccatagatagaagtcaagtcctatgattgcttatttctgactgtgatcatatttctgaatgtgtcttagtttttatattaaaagcacactggtttgaatagtttccactttggtgaaaattttggagtttcttgagttttttacagctaaaaaggatactgaatattgtatgtgtgaaaactgtactgtgaaatgtgtgaggaaagagggggctgctggaggttgagacattaaaatattgcccactgaagcaggatattttgccagctgcttattactaacatgatttttctgtatccttaaaagcatttgttttgaagtacacatgccattataattgcccagtgtccaaataaagccttccaaagcataattgttactaaggaaagtccatgaaacctgttaaaaaatataaatatggaagcttctttctttttgtctaggcgttatgttaccagtaaaaccaaagtcttagaaacaatttctttgtctttctagattgtttacttcatccctttgtcttatgtgctttgtgagatttaggatatttccttcctgttgtatcagtgagttttctttcctttttcaatttttatgaggacttgtcaaatgattctttggcttatacctagcatagtggttggcatattgtagaaccacaataaattttgaatgactataaaagtattcaatttttaaaattcagtcccctttgcctgagtttctcaaagggcaatttgtgaaacacctgcatcagtatcaccaggatgcttatttttttttaaatgctgactcttatagtctgttcaccatttactaaacagcatggaatcactgaaatttgagaaaagttattttaagctgctactgtttgtcacactgagctcagttgtctattgtagcacatatcacagtgtgacaattaaacacatacataaatacagcatatggttaatgccatgaagtgagtcgacatggtgctttaataaacaataataggataacttactttcaaattggcagtcaggaaaggtctctggatagtgacatttaagttgtgacgtgaaggtatttaaagccatatgacactcctgcatttacaggttgagaagaaggggaggaagatgatccagtaaaagagactgtttaggagccaccagggagaaaggaggaaaattagacggatgtggcatccagaagtcagaggaatgtgtttcaagagagggagagtcggcaagtgtttcaaatacttctgatagatctaacaagttaagaaaaaaaatattaattggattttacaatagggaattctctgtgatcttaacaaaagcagtttcattgtaggtgctgagtatcaaaagcagatttgggggatatggaaatataagcagaaggtaaggagttggactcagcagatatagacaacatggctgcaaatgcagagagaaatacaaatttggtgttagaatggtgtgtaaattctctgatggcttccattttcttagaagtttgaaagagaagtcgatggtacgattcagtcgttccacaaagtggacaaagatcagtaagagaagtatagtaggattgctgcctcaacatgtgttttcttacaatttgtcattagaaattcaaattgaatttagtagaactggtcattagatttctgcagcaatgtttaactgcttgcatgtaggcatagagaagtcagataatttgattcaacggtggtgaagctggaagcagagctggagtgggaggaagagtgaactcaaggcaaaaaagttgcaacagagagaaaggacaactcttttgacaagaaatatcagtgtgaatggaaatgaagaaatgcaacagtaattggataggggtgttgggtcagtgcaaggcgaacacctacatttgattggttggttggtggagttaatgagagagctacttcagcatgcttacagtcttgtgggaaagagccagctgagagggagaaagaaaagcagagtttagagattggaaaggaagaaaacattgaggaattagtcaaattcgtaaatatacaaagtactgatatgatagaccagataatgatggaagactccaaagttacggacgttttagagatcactgagatggttattcccaggagctatgcaaaagagagtgaaagttgctgcagctgctggcacgtgagagcgagcccagatcctgctgccactgccccaacaaagcactttggccagtacctgctatcagagtgttgtggccagcagtctgggaatgccttggtccctctagcacagaaggttgctatcattgaggggccagcaaacaaagctgggagaatggtactagcttctccccagagttagagcacgcagcccagggtactgagctgagccttagcccccttacaatcttccagaaatgaagtcagtcaactaacctcactttaagccacaaataaacccccaagggcaacaaagaagataaagcaaaacaacaacaacaacaacaacaaaacccatccaatgaacagcaacttcgaagactaaaggagtgtcagcccacacagatgaaaaagaaccagtgcacgaactctgccaactcacaaagccagagtgcccttttacttccaaaagatcacactagtttcccagcaatgattctttttttttttttttttttttttttgagacggagtcttactctgtcgcccagcctggagtgcagtggcacggtctcggctcactgcaagctctgcctcccgggttcacgccattctcctgcctcagcctcccgagtagctgggactgcaggcgcccgccaccacgcccagctaatttttttttttgtatttttagtagagacagggtttcaccgcgttagccaggatggtctcgatctcctcgtgatccgcccgtcttagcctcccaaagtgctgggattagaggcatgagccacagcgcccggccttttttttttttttttttaatttgagacagagtctcactttgtcacttagtatggagcacagtgttgcgatcatggctcactgcagcctcgacctcccaggcccaaatgatcctcccgcctcagccttccaagtagctgggaacacaggcatgcaccaccatgcctggctaaatgttttttgtacttttcgtagagacaggattataccatgttgcccaggctggtcttgaacccctgagctcaagcaatctgcctccctcagcctccaaaagtgctgggattacaggcatgagccaccatgcccagccagcaatggttcttaaccaggctgaaatggctgaaataacagacatggaattcagaatatggagaggaatgaagatcactgacattcaggagaaagtcgaaacccaatccaaggaatctaaggaatataataaaaatgatacaggagctgaaagacaaagtggccattttaagaaaaaacaaactggcctaatagagctgaaaaactgactacaataatttgataatacaatttcaagtattaacagcagaatagaccaagctgagaaaagaatctcggaactcaaagacacattctccaaattaagtcagccagacaaaaatgaagaaaaaagaatgaacaaaacctccaagaaatatgggattatgtaaagagaccaagtttatgacttcttggtatctctgaatgagagggagagtgagcaagcaacttggaacacatatttcatattgtccatgaaaatttccccaactgcgctagagaggccagcattcaaattcaggaaatacagaaaacccctgcaagatactatacaagatgaccatccccaagacatatagtcattagattctccaaggttgaaatgaaaggtaaaaaatgttaaagccagctagagagaagggccaggtcacctacaaagggaaccccataaggacaacagcagacctgtcagcagaaaccctataagccagaagagattaaggacctatatacagcattcttaaagaaaataaattccaaccaagaattacatatccagccaaactaagctttacaggcaaaggaaaaataagatcctttttagacaagcaaatgctaagggaattcattaccagcagacctgccttaagagaggtccttaagagagtgctaaataggaaaatgaaataccattactagccttcacaaaaacacatataagtacatagagcattgacactataaagcaaccacataatcaaccagctaataacacgatgtcaggatcaaatacacatatatcaatattaaccttgaatgcaaatgggcaaaacctccgcctcccaggttcaaacgattctcttgcctcagcctcctgagtagctgggattacaggtgtccacaacctcacctggctaatttttgtatttttaatggagatgggttttcaccacgttggccaggctggtcttgaatgcctgacctcaaatgatccactggcctccgcctcccaaagtgctgggattacaggcatgagccaccgcacctggcccataatttcatcgttgtgttaaacatttgtcttttcttcatgtagaaccagtacaattctagctattactgttccatctatctagatttctttctttatacacgtacattaaggtaaatgtgacaataatactctacatgtatttttaaaagattccttttactcagtaacatgccagccccataaatagaaatctacatatggatttaatgactgcatagtaaattatagtatggtaattaatttaaccaattccctggtgatttagtgatatacgtgtagatcgctttctacgtttttctgtgtcatctattgttaattgtctaataaacagatatttctccttgtccatctttcttgaggcagagtgcatctacacccttcaaattcataattgatgttgcaaagccaatatatttgtcctccccagcctcttttgacatgtggccagttggatcagttatagagatatgtaaggaaatgttttctgcatggcttctaggaaagatttccctccttaattagtagatggaagctcacaaggagctatttctcactcctctggctgctgactattgctgtgcctttggatgcagttctataaggatgtgatgtctaaaactatgtcagcccccttgtgtccatgagacaataacctgaagactaaagtcaactctgagtgttttttctgtttttttgtttttttggtttttttttgagatgaagtctagctctgtcgcccaggctggagtgcagtggtatgacctcggttcactgcaacctcccgtgttcaagcgattcttctgcctcagcctcccaagtagctgggattacaggcgcccaccaccacgcccggctaatttttgtgtttttggtagagacagggtttcactgtgttagccaggttggtcttgaactcctgacctcatgatccgcccgcctcggcctcccaaagtgctgggattacaagcgtgagccactgtgcctggccaactctgaattttatagagcaaaacagaaagcccctgactcctctttgatccattttagcaacctttggctctcctgcttccacaatatatacaattattttatgagaaaataaaacttaattttgaagcttattgggtatttgtcttaccactgtgagaaatgggaaagttctgcttcaaagattataaaagtcacaatttcttactataagagtgttatccactattagtatattgttatccactaattgttatccactgttagtatatatattcgaaatcagctatcctagcttgctgcggcatgcctggacagaactagacaagccccagcccgtagtgcatgccattccttgtttggagatgcttccttaactatccctgggcaacttccttttctttctttgttctgttccccttacccaattaaaaaggttttaaatgagtagccaattgggtaaagtgtaaaatgtgaggtcctattccagccaatggaaactggacacagcagtagggtagaaacgtcagttataaataactctgtctcctttgtttggtgtgctctcatggctggacagctattgagtagcaccctttctgcagaaagtaaagctcaccttgctgagagatcatttgttcccctcgttaattctttttttgcgacaccaaaaacttcattcacaacactactaaagcatccatatttgcttttaaaaacgatactatattaattatccttctgcatatgtatttgcacattcacctttatttctattacttaaagtcctaaaagttgaattacaggttcatggatatgagcattttaaatttggatacaaatttcccaagtgaccattactcagttacattcccaccaacagtatatgaggatatctatttcctcacacttttatcaatactggttattataaatctttagactattttcaaatgtattagaaagataacttagtatggaaacatgcttaactaagtggataaagagttggctctgaagtcagactgcctgggctcaaatcctggcttttcctatttactgggcttgtggccctaagcaattccttaacctctctttgtctttgtctccttaatttgctctcttccattcattctcactcaccacctataaccaagtctgcctgtgtgtataatgttgtataggttgtggaaagaggtagctgattattctatccgggcattgaagctaatattagtgtgaccgtaaacttcaatgtacaaaccaggagagtaaaatgagctcagacaaatgtgtgagggagcagctccatattggcaccctgacaacctcgcatgactcctcataggctatataggcaaggctcaagtctcatgtaaaatgtggatatgaatggtacctatttcataggttagtgtgagggttaaactggcaattagtgcttagcagacaggagaacattcaatacagggtaattattgtctattattttattagaatttcttggatactagtttttttgtagatctgtatgtttattttccactattatttattttgaggggaattttcttttcatgttctttgcccagtgatgtcatgttgtgtttatcttgttattggtttcaaaaccttaaacttagtctccttatatgcaaaacaaagaggttatatcaactggtttttaaaggtctttctagcttgtacttcatatttgcaagtgtcttgatggcagaaccatgttggtgagagggacctggacacctaagagttcttttaggggatacatgtgataatttaatacttttatacaatttgtaaagatcaaatcattatacttaggatatccattgccttaaatatttgtcttttcttcacactagaaccagtacaattctagctaatttttaaatatacagtagattattgtaaactatagtcaccctactgatctaacactacgtcttatttcttctatcaaaccatatatttgtacccatttcttataaagctgtttgacatagtagtttatgagacatctgcacttataaatctgcttttttgttaagcaatattataatattctacgtatttatcctcaagtgcttagaagaaaatgttttaacatcttgaattagtttagtcacttcttcaaggccagcggtttttgtcttgagattcagttgtttttctttgcaaaagagtgatatcaaattacacatttaaacctgatgaaagtaacttttcctcctagaatgtcctgggtaatagatttgctgccaaattgtctccctgtgattagtaatggcattagcaggagtaacctacatgagtgagataaacaacatgagatcaagactagcaataatccttctgctttgagtttaggttatgacacatcttcgaggcagcaacagaaattacataagtttattgtttatttttcctacagattctctatgggacacatcttgcatgtatcaaaccttcctcaaattttaattaagacctctatcacctatagtcattaactaagctcacttacagagttgtaggagaagcatggattttgatacttcgggatttctggagaagatgtgatctctgttctcatgggaaaattaggacatgctgtccacttcgagacacatttctagacctcaaagtggtaccatggtgctagggttgaagtaagttaacctttctgagtctcagttctctcagctgagagaactgctacgaagtaggcattattatcattttgacataattttttctttatgatgttgtttttgtttcatacatttcaagaccatgcctaatcagataaataagtatttacctgagctgtattttctagttctttcatcattttaccttatatgcttatctctttaatcttcttagaatgtatttttgtatttggtatgaggcaggaaacctaatcattctatttctaaacactttgccaatggtttcaacatcatttatttagtaattcatcattctgccacctatttgttgtgaaagttttatcgtgtattcctgtgtgcaaatagaaccatagctatttcttgatttctccattctgtttcagttatttgtctacttaattctttgtcaatatcacattgtttattgtggctttataatgtatattaatatatgtcttttattgtttgcttacacaatcttttccagttattgttctatgtaaagctaagcatcatttttaagttctaaaaaacacattaacaaatattagaggtgggcttgcactccttcatttactctcactccccacctataaacaagttggcctatgtatgcagtgttttgtgttctgtgtattgtggaaaggaggtagatgattatcccttttagatgttggtgctaaaacagggtgaccatataatttcatgtctaaaccaggacacttttaagagggaaaagggttaggagttccatgctggtactctggcaaccttgcacgtctccacataaactatataggcaaggctcaaatgcaggtttgtgtgtcttggtgaaataccctgtgatcctcccaagaacatgacaagattggcagccttacgaagagctgtcttcagcatttgttatttgcctccttatcttgcaggaggctaccacaaggcagattctcatccttctcatctgcctccctgataccaatgaggcatgggacattctacttcactacctcctccttagggtacagctgtgaactacaaaatggcttagctgatctagagaagacacctcggtgacaaagtaaccactgcccatgttgtctttcatctggcccctttgatttttttattgtcctggaagtcaagtgatgcatgaagctgacaccatgctgatcttgcttttgctctctgtataagtaataaactgtatgaatctatctgggccaattgtgtctttaccaaaagaatccgtcagcctgcttgacaaaatgttaaagcagttgagattcaggaacaataagggtaaatggcaactaaacaaacaaaccagtgttgttctcaacattattcctatgatccaaaaggagctcagtggtggtttgtccataaaaattttatgcagtcagcaatataactgggttcttcctcggtaatattttctggtaagcttttgagtttgccattattgtggcgggggcccatggggaaggcagttaattagacggtctatttagatgtcagtctttttttttttctatttttttatttttttatttttttgagagtttcgctcttgttgcccaggctggagtgcaatggcacgatctcagctcaccacaacctccacctcccgggttcaagcaattctcctgcctcagcctcccgagtagctgggattacaggcatgcaccaccacacccagctaattttgtatttttagtagagacggggtttctccatgttggtcaggctggtctcaaacttctgaactcaggtgatctgcccgactcggcctcccaaagtgctgggattacaggcgtgagccaccacacccagcgatatccgtcataataacatactgaatctagactactttggaaagtacagttaaataaagagaattgttataaacattcttgttgtatatctttccagtcctcttgttatgtgtatttcctacatagttataatgatgtattatatataattttgtggggcttttttaacttaacattcatcgtacatgctttataaacattttaacaactgcatgtgttttcattaaatggatttaaacgctttcttgttacgtgaagttctttcttttcttttatatgtctttttaaaaacagtagccaattattttgtaataaacgtactcagcctttaggatagattcccagtagagaaaactctttttttcagcctcttgatgtatactgtcaaattgctttttaaagggtttgcagaattacattcccaccagcacctgtagtaaccactgtctacctctgaaagttcaaagcaagctccagaatctcataattgtttaaattaactttatggcaagttgaggatcatcatgtctataaggaccaagcaaatcaatagaaacactaaatttatcagctgacagagcacagagatacatgtatgtatgctcacttttatgtgtgtatgtatctcctatctatctatctatctatctatctatctatctatctatctatctatctccctccctatcatctatctctatcatctatcatcaccagctctgtctatacatctatctatatctagtatgataaacaagattttgtactgatgtcttcaactctattactatgtagatcattctagccttctccccttgcttgtcataacctcccacttcaagaatgagacactttgctctcacaaccatccatctgtttacctaattgttcaattacagtatacatgcttggtggttttagaattgttaacctatagccccatgggaaacaactttaccaactaaagtacagcactttgatgtacagttccttttgcttttagtcttaccgtatgcactcatttccaaagttacttatgtcctcactttttccctccacctccttaagtgagattgtttcatacatttgttatacagttaagatgatttcatcacagtcttaatttcattcttggatcccccaactttataaattatttttaaaatttgcatacattaagttatactctctgtgctgtaaagttatatggtttatgacaaatgcatagcgtcacttattcatgaatacaatatcatacacaatagtttcacctccctaaaaaatctcctgtgctttagccattaaaccttttcctccccaccactgagccactggcaaccattgatctttttactgtccctgtagtttttcctttcccaacatgtcatataatttaaatcatatagtatgtagcctttctgactagtttctttccttttttcccaatcttttaattaatttatttattttttcttcagcttttattttaagttcaggggtacatgtgcaggatgtgtaggtttgttacataagtaaacgtgtgccatggtggtttactgcacagatcaacccatcgcctaggtattaagttttccagattcctctgtgtctcttcttggcttggtagctcatttctttttattttattttattttattttttaacataaactccagattttattgtcttgataataaaacaaaagatgacacttagaactggatcacttggccctttctcttcttatctcctcccagctcaaaatgcttgcatcttttaatagccagtgttcgcttagatctgcagttgggctcaacacactcaagccttagcacaatcttctttgtagttttagcctttttccagaaaatcggcttagtctgcccaccatagccactctgcttcctgtcataacaccgctttccctgggcaggcaccatagccactctgctccctgtcataatatcgctttccctgggcatgcagagaatgcttgcccttctttttttttttttttttttttaaatttttttttttttttgaggcagagtcttgctctgtctcccaggctggagtgcagtggcgcgatctcggctcactgcaagccccgtcttccggattcatgccattctcttgcctcagcctcccaaatagctgggactacaggcgcccaccaccacgcccggctaatttttttgtattttagtagagacggggtttcaccgtattagccagggtggtctcaatctcccgacctcgtgatccgccctcctgggcctcccaaagtgctgggattacaggcgtgagccaccgcgccgggtgcacttcttgtactgtgtcactttgtggggttggcgcttgccacacttcttacagaaagtccggcgggttttaggaacattcaccatgattgcgtgagtggcatcagcacagaaaggaaacagctcatttctttttattaccaaataatattttattgtaataaatgttacaatatttatacaatattgtattgtttatccatttctctattaaagggcatcttggttacttccagttttgtgtgagtatgaataaaccttcacatatatgcttttgtgggaacacagattttcaagtgaattgagtaaatacttaggagcacaactgatgaatcttgtttagctttgaaagagattaccaaactatctttcaaagtgactctaccattttgcatccacactggcaataaatgcaagttcctgttgtgcctcatcctcaccagcaattgctattgtgttttagattttatgcattctagtagccagtagctgtgtagtggtatcacactataatttgcatttcccaagtgaaaaattatattgagcttcttctcatatggtccttttctatctgtaaatcttctttggttggttggctgttgtgatatttagaccattgtttggagaaggttgatttctttgtgattgttgagttttcaaagttctttatctccttggatacaagtttttttatcagatatgtattttgtaaatattttattccactctgtggaatgcctttcaccctcttaacagtatcttttgtgaacaaaagtttttaattttaataaaatctaacatcaatatttttcatggatcatgcttttgatattgcatatagaaactcttcaccttaggccgggcgaggtggctcacgcctgtaattccagcactttgggaggccaaggcgggaggatcacttgagatcaggagttcgagaactgcctggccaacatggtgaaaccccatttctactaaagatacaaaaaattatctggacatggtggcatgcgcctgtaatcccagctacttgggaagctgaggcaggagaatggcttgaacctaggaggcagaagttgcagtaagccaagattgtgccattactctccagcctgggtgacagagtgaatgagactctatctcaaaataaaataaaaatcaatgttaaaaatatagaaactcttcaccttacctaaggtcacgtggattttctcctaaacttccttacaaaaaaagtttccttgccacctcattctcacccctcagcatatatttggatgttcttaatctttcattatcttattctttgagaaacattattcatatagaattttaaaagttgggccttaaaactagacagcttctcttcaagttgtggccccagcacttcacagcaataggatcttttgcgagtcccttcacttctgtgagcttcagtttccttttcttcaaaatgtgtccatggtatctaccaagtcgagctgtgaaaattaaataagataatgcatgtaaaacacttagcatagttcctggtatatagggtagctattagttgtgtgtttgtgaatttcgtatacagaagtataattctatgacctttaatttctttttaaagccagggtgaagaacttttcttttataaataatagtatctaaacctactgaataaaatttgatgttaaactgtatgtttaagagattttttattttcatttgataggttttacttataatcaattaagaatatatgtatgtgtgtgtatatatatatatatatctatatatatacacacacacacatagggaaagaggtatatagaaagagagagagagattggtagtaaaccatagacagtacctgctacataataaccctaggcttctttctccttatatacccagagaaatgaaccaaatggccaatatgtaataacaccctcattacatgatttcctctaggttgaagtgactctaatggaactctaagttcatacaggaattactgactccatgtctttataagctataggaactagacttgagcaagctgtatctttcagtgtttcagcttctcttgcttagagagcatacaaaatcacttgttattaattataaatatagtttctattcgttaaatgtttccatgaatcagacactgcattaagcattttaccttcattatctcatttaatcctttcaaaatcttcttttggcaggtgctatccttgttcatattttgctggggaggaaatatgggttctaagaataaagtaacttttacaaaggtcacacaactgatagatatcagagtatgagttggaacctagggatgtttgattccaaagtcaattctcataaacgctatgctcaactgcttctcatggttcaacggaaatgagcataacaagttattgagagataacttagagtgatagagtgatatctaggaaaatcaaataaggcttaaacgatgatattctttccgggtaattatcaataacaataacttaggtctctgttatagaatatctgtctttggactggactatccaacgattttcccagtagtgcatgtaatgtgacaaccacttatgtctcatgatgatcctcattagacaaatgatccaggactgaaagcaaaatgactctattttatatcttgaaatgtgtgcagcagagaatccagttagtgtgtgaaatttgtatttttaaatactaaaactactaattgtatagttgatgtaattttaagaaaatcagtcattttgttttgcaaagtaagttggatgtcaatgttaaaatttaagtgttcatgcatccattaaacttctgcatacgagttttcttttctaactggatattatatatttcttagcaaaatatttattgtcagcatcttcaacaacttttcttcacaattattggcttgtgatttgaatttagcttcacagaacatatgacagaacttaatttattgtacctctgttatgaaattcatcatagtacgacagttctcaaacctatccatgttgtgcttatttcagattacattagcactcctcaggatctagacacatacattcttcacttctttttgttttgtttttgagattgagtttcactcttattgcccagactggagtgcaatgacatgatctgtgttcaccacaacatctgcctctcaggttcaagcgattcttctacctcagcctgccgagtagctgggattacaggcatgcgccaccacgcctggctaattttgtatttttagtggagcggggtttttccatgtcagtcaggctggtctcgaactcccgacctcaagtgatcggcccacctcggcctcccaaagtgctgggattacaggtgtgagctactgcacccgacccaaattcttcacttctatgtggtatttagtactaagcacttcctgagtacttcctttgagttcaacaaatatgccttgagatgaatgaagctataaaatggccttgagaatatttcaggtcataatctcaagacatttcattgttatcagaaagttttaatattctacctaatgtttgcctttaaataatatacccaagatagagaaatacatctgaaacagtgatgtctaatgtaagattccaagttggagtcctgaacagttatagatctcttatttgggtttcacatcaaaatttgccgtcatcaaggttaatatactttatataccaatagaataattttatcaaaaatgcctcaggagtgtgaataatcccaatatttttcttaccaccaaaatccttttgtaataaattgttcttagcttttcactggatgcgatacgtagcttatgttttttgatatttgatatcataagcatctttaggaaataaaagacatttgaaagccatgtttaaagcaacctctgctgctgcatgttaaattagcatttgtcctttctcactgattaatgaggagtattgatgtggcttgtttatgacatgttcccctgtgttagaagactttatcttacttatccttcagattttatttcctctacagttttctaaagctgttaattttctacaggtgcttttatgctagggacagagatgctcagataagatttgcaatgcatagaaaaagcttttactaactgtctgctctattggtgggaaagtgaagggttaatgatgcagtgaaagaaaataactgaatttttgttatgggttgcttaagaaaaacatatttgtgtagcaattacatttaatgtaaaataatatttacattattttttgtaggctgaatggtaagatatatgtgaatatgaagaaagctatgaagtgccatcataaatatcatcattatgctatttcttattcaagttgctttcaaaggaattaccacccctccctccacttcacctgctgccccaaattaagacaatatagactataatttttgaattccatttattgggtttttataatttctcttctaacttttccttcatgagtctgtcactcagaaatgccctccttgggggtaatcacgaataattctaggttctctccctgttaaacagcccttgaaaacaactcacatattatctgttccatcctcaccaatttctcctcactcctgccctccagtctcctcttcctcaagctaaattttcccatctcctgccaaacttttccttgtaaaaatgttgtcttccggccaagcgtggtggctcatgcctgtaatcccagcactttgggaggccgaggtgggcggatcacctgaggtcaggagagttcaagaccagcctggccaacatggtaaaaccccgtctctactaaaaatacaaaaattagctgagcgtggtggtgggcacctgtaatcccagctacttgggaggctgagacaaaagaattgcttgaacccaggaggcagaggttgcagtgagccgagatggctgccactgcactccagcctgggcaacaaagagcgaaactccgtttcaaaaaaagaaaaaaagttttcttccttttacgtacaacattctgttgtgatgactctgtctcgtctagtaacagtggctggtgccaggtcaagaaatcccctatcctacaccggtaaaactggtttgtttgatccaatttcaaaccttcacttggtttctgattgtgtgtttttgtttaattgctctggaattgagaggacacaatagtgagctcattctgtcaccttagttgtttgtctggggtgtctcaggaaagtgaatattggaagatataataatacgaataaaagctactgcatattgagtgcttactatgtcttaatcactttatacatcttcttccatttcatcatcataacaacacattgagcctattatcattattattccctgacagtgtgttacagtgtctgttgaataaaggaatgaatcaacattcaagagattcaaaaactttcccaaggtcccacagatcttaaacggcattctgttggaccctaagtctgtactgtttacgtgttatatgcatagtctcttttaaggaagattttgaggaatggcagtctcccaagcacttatacacttggcaccatgacattttatatttattgttactttgatctttatatggcttctcatttattaattattcaaatattttatatatatatattcattgagtacctactgtgtgttaggtgtattttaggcactaggcaagctctagtgaacaagataaactgtttttaacttttactgtttatttttcagcacattctgccatttaaactgtgccccttaggttccgaggaatatatggcaaatccatatatattcaataccatttatgtctctcaattttctgtgcataatggatattcaaacatttgttgaaccatatgatgatgtcatagaaaaaaactctaggttgggagctaaggtccggctcttgcatttactaggcccgttactttacccaaatcactcagctatatgaacctcaatttccgcttcttgaaataggaaaaataaaccctccctcactaactcatggaatcttgctatgaagatcaatgagctgatgaagcataagttatttttaaggtttcagattctgcaaatttctactattcctgttattgtcatttttgacagactggataagcactagaaagttattttcaactcggaagggaaggcagttacagaaaatagaaaataagactaagaaattaaagttagcatgttggctttggacttcctatcattctagttacagtcttttgagctccctttaattttttaaaatattttcaacatgttatactaatagcaactgacactaaacgtttaaaatactagaatgatacaaaaattagctgggcgctgtggcatgtgcctggaatcccagctacttgggaggctgaggcagaagaattgctcgagcccgggaagcggaggttgcaatgagctgagattgcaccattgcactccagcctgggtgacagagtgagactccatctcaaagaaaaataaaataaaatactagaatgtgcctgaaaaaaaaaattgtagtgttgatacttttcagttataggggttagaacaccatagtttaaggctttatctcttgtctttatgctcactcagaatggaaatagctgaggaatattagataagaaagaagtaattgggagaatatagctaagtggctcagtattttagctagtgtttagtgcacaaatggagagacaaaaataaaggctcctggccaggcgcagtggctcacgcctgtaatcctagcactatgggaggccgaggtgggtggatcacctgaggtcaggagttcgagaccagcctggccaacatggcaaaaccccgtctctgctaaaaatacaaaaattagctgggtgtggtggtgcatgcttgcaatccctgctcctcgggaggctgagacaggagaatcacttgaacccaggaggcagaggctgcagtgagctgagattgtgccactgcactccagcctgggccacatagcaagactccatctcaaaaaaataaaataaataaataaataaataaaggctcctaggtctttgtgagttttcttcttggagaagtttcaaaccacttatatttgttgcatatgctgattattgttcatgacaattccctcagataatggaaaggtatagtgatagcagcaaagacaggagaaggtagagttttaagaatattttccggccaggcatggtggctcacgcttgtaatcccagcactttgggagtccgaggtgggaagatcatgaggtcaggagttcaagaccaacctggccaacacagtgagacctcatgtctactaaaaatataaaattagctgggcatggtggtgggtacctgtaatcccagctactcgggaggctgtggcaggagaatcgcttgaacctgggaggtggaggttgcagtgagctgagattgcgccactgcactctagcctgggcaacagagctagactccgtctcaaaaaaaaaacaaaaaaaaagagaatatttttctcagtgtcattattttagaaacaaagttccagtctggtaacttctcttaatgttgctgttgctgttaatatttaccaatctgcatagtcttcctcttctacttccaaagctttgaagtaggaacattttgtagtgaacgtttcctaactgttttaacagaaatgcaatggccatcatggtgcattgacaaagtagggaaaataattgcacaaagattgtgagggaaagaggatcagagagagcacatcagtaatgataatttattacaccaaagtttgacaacaaagctacaacatggaagagtggaaattacaggtgactggtgtcgacaggagtttagaaacttgcattagtacgtcatcttgttggtactgtgttacatagtgtttgcactaccatctctttttttgttttttttgagacggagtctcactctgttgcccaggctggagtgcagtggcgtgatcttggctcactgcaagctccgcctcctgggttcacgccattctcctgcctcagcctcccgagtagctgggactacaggcgcccgccaccacgcccagctaatttttttgtatttttagtagagatggggtttcaccgtgttagccaggatggtctcgatctcctgaccttgtgatccgcccgcctcggcctccaaaagtgctgggattacaggcgtgagccaccgcgcccggccattgcactaccatctcttacgtttccttgtttgctccttctgtttgtcctatgagatgattaaggcagtgaattgttttgtttatacccatccaatttatttctctattcttttgctatgagaatcctttttggtggggatatatcttctccccagtcataagggagtgcaaggtattgtgatagaatgtttaacaagaaccacatggtttttcaatggaacagcataaatgaacacatgaatagcgatatttagagagaatataagtgatcttgaagacattatttgcatccctggatgtagttgtgcctgaggtctcttccacttttcttttttaaggtgacatatttcccttttgccgcggttagcttaaattgggtttctgttccttgcaactaaatgattcatgaataaacaacccccagttgtacagaagaggaaacagaatcagagactgtgtgcttcttaaaaccatatacctaatgcatggttaaggcccagatccaggcttcttgaccccaaggcctatgctttcttcttacacaactgttctttagttctagctccttaaataactgtagaactttgaacaaattgaatgcaatgctaagcctccgttttcttcgcttgtaaaatgaggtcgctggattaatgatctctagtgtcatcatcagctctagttttctctcattttcttttttttttttctgagacagagtctcgctctgttgcccaggctgcactgcagtggcgtgatctcggctcactgcaacctccgcctcccaggttcaggcaattatctgcctcagcctcctgagtagctgggattacaggcgcccgccaccacgcctggctaatttttgtgtttttagtagagatggggtttcaccatcttggccaggctggtcttgaactcttgacctcatgatccacctgcctcagcctcccaaagtgctgggattacaggcatgagccaccgcgcctggccttctctcattttcagttcaagtattcattttattttattttatgtatttattttttgattcagagtctcgctctgtcccccaggctggagtgcaatggcatgatcttcggctcactgcaacctccacctcccaggttcaagcaattctcctgcatcagactctggagtagctgggattacaggctcctgccaccatgaccagctaatttttgtatttctactagagacagggtttcaccatattggccaggctggtctcttggccaggctggtcttgaactcctgaccttgtgatcatcctgccttggcctcccaaagtgctggaattacaggcgtgagccaccatgtctggtctgctttaaataattatttttaattaaacaaataaaacatagaaagttcttgttttaaaaattccaagaattacatattaaactacagtacttttgactgctgaggaaaccctcttccctccccaacagtgttgtgtgtatcccttaggagtttttctatgaatttacataaatacagatatttctatagaaatatttagtttgcactgtctttacttgtatttttaaccaaaattgtcacataatgcacacattgttgtgcagcttccttttatcatttaactataagtcttgcagatcttccaagtcagtgcaaatattaagttggtgcaaaagtgagccagtctgtggtattagtctactacattttgtttacttattgatagatatctggatagtttgaggttgttcattataacaaacaaggctaatatgggaagccctgtccataattgctttgtgtgagtcttccaagacagaaagcaaggaataccagtttacatttccacattcaattcatgacggtttctctttgttcatatcttcttcagtctgtttttttttttttttttggagacgggagtcttgctctgtcacccaggctggagtgcaatggcacgatcttggctcactgcaacctccacctcccgggttcaagtgattctcctgcctcagccttccgagtagctgggattacaggcatccaacaccacgctcggctaatttttgtgtttttagtagagatgggatttcaatatgttggccaggctggtcttgaactcctgacctcaggtgatccacccacctcggcctcccaaaatgctgggagtacaggagtgagccaccacgcacaacctcttcttcagcctttaatatcatctaactttgaaaacattagcaattaaaatattattttattttattttatttatttatttatttttgagatggagtctcgctcttgttgcccaggctggagtgcaatggcgccatcttgactcaccgcaacctccgcctcccaggttcaagtgattctcctgcctcagacccccgagtagttgggattacaggcatgcaccaccacacccggctaattttgtatttttagtagtgacgaggtttctccatgttggtcaggctggtctcgaactcctgacctcaggtgatctgcccacctcagtctcccaaagtgctggtattacaggcgtgagccactgcacccagccaaaatacaatgtgcatttctctgatccttggaggaggttgggcagctttgcctacatttgtgatctttttcttccccctgtggattgccatattctgcagtcttaagtatttggctctgtggttaatctggttagccattgtcacagtgttacactgtaaactgctaatagttgtgtgataatggcaagcttcttcccccagacaaattttagggtcaatgttactagactggcttgaccaccaaagtgtccttggagaatggttatagaattataggaactcatgtctggaaagaacagaattttagctgtcatttagtcctacccaaccatctgatgtgtaaaccctgtcttcaaaatcttagccaaacattcaactaatgcttcaactgtcagcctcctgagacagcccactccatctgtggataattctgttgatcataacagtcttgcttgtattaaaccagatcttgtttccttgtagtttctaccctctgccttgagcctcagagaacaaatctgcctcctcgtccacaaaacagcctttctgatatgtagtgacagtttccataataatcgaagtcatcttttcttcatgttaagcatgctggttcccataagttatccttatatgatgagattctgagggggttttcggtcactttgtgatcacattctgttgaatacttactagtttatccctttttaaaaaatgcatcactgagttcagtgtcttagagtaagctgaataataataataataataatggaagctagcctttattgagtatcaagtagtgtgccaagcactttacttgtattaattaatttaatccttacaacatgactaggaatgaggcatttgaatccccatttggacaataaggaaattgaggcacatggaaattaggtaatttacctgtgactgcactgagtggagtggaactagaatttctcctattacggttatcatatttcagtgtatatgtccctaagattatatgatttttaactctaattgatttatattaactgtcaactcaaacccccaagtcttatttgaatgtattactggtaagccaccacttcccatcttgtacatttgagttctgaagccaagtccaagtcctggaaaactgcacttgacctcactgaatctattatagtttgtagcccacagtgcttttcaagacatcttgctcatcccatttctctcccctgatatagttagctggctctcttctggtagtgcttgacttcacacttcacactgtcatctataaactatatactacatgttttcagcttagctataagtggatgagttgcttaatttattttactttccttttgtgtttgcatgcagaaagtagcttcccagaataaagagcagtgagcattttcccacagttgtatggtggttatctactcaattgtcccttcctgctcaaaggatcaaaagcatttaccaatttgttatacgcttcatgtaacagttgtttgtgttgctttcaattttttttttcatcagagatatgcttgaaaatgatactgtgcacaggacttgtcaacttagtttctgcctttctagttaagaaaaatgtatgttttagtttattaactataaaataaaatgctccttcttctcttcctaggcttaaatggaataattagttaaaaaaatcaagaaactatcttatacacatttccactatatttttctactttgaatccgaaagtaaactgagtggtatagtgaaaagatcaagggatggggcttggtgagttcatgggcaggagacctggtttccactactagttttctcattatctggcagtatgaattgccagaagttttttctcttctctatgctgtaaaatctgtaaaacgaggggactggaataaaatgaggtaagacacttcattacttaaaaattaccttgaattcaatataaatgttatatagcttgttctcttccaaaatattaaaatggctttgtatgggtgctttgtaaacctctccccaagctttatttaaaaaatatttctggatatttgtctagaagaaacattgcctattaaaacttagaggacaaaacattctgagcattacttagtgctgggtcatataaaaatagcaataacatttggctcattttagattttttttttttttttgaggtggagtctccccttatcatccaggctggagtgcaatggcacgatctcggctcactgcaacctccacctccagggttcaagcaattctcctgcctcagcctcttgagaaactgggattacaggcacatgccaccacacccaactgattttttgtatctttagtagagacggggtttcaccatgttggccagacagatctcaaactcctgacctcgtgatccacccgcctcagtctccctaagtgttgggattacaagcgtgagccaccacacctggtctttagattttttttatagcctaaattcttatatggatggctctaggcaaatcagagaggtactttcacatttttggcatttaaatgggagtcagaggcccccaaccctgtgcttctaccccataatctatcctctgaaggatgagcccccaggaatgctgggagcctctcaaaattcattcacacacctgcacaatcagccaccaatttattaaaaaacaagtttctgtgaaaatgctcatttgctttctgtgtctgaaagaaaaaacatcacatgaaaaacatctgggaaatatcttcaaacttatttgcaaatatatttgtggagatttttaaaagacaggctgaattgtttccttttttaaaggcaacgtagatttaaaaataattttgtagtagcttatgggtataaacgaagatatcagtgaagataacatttatttatatgcatttttaaatgctattttcctgcttgttttcgccttgtgctttattgtttatttatattttcaatatgttatactgaggggaaaatataatgtttttctttgcactaagtctatgggtacatttatcatttaaaatataataactttaaaataaaaaattagagaactttaaaatatatatatggatttttgctttgtttttgtttttttttaattgtcctcaataatatgtttgcaaaagaatataactggccgggcgcagtagctcatgcctgtaatcccagcacttttagaggccaaagcaggcagattgcatgagctcaggggttcaaggccagcctgggcaacagcccatctctatcaaaaatacaaaaatttgctgggcattttggtgcgcatctgtatgcagttccagctactcaggagtctgaggtgggaggatggcttgagcctggaaggtggcggtggcagtgagcccagatcatgccactgcactccagcctgggtgacagtgagaccctatcttaaaaaaaaaaaaaaaagaaatagaatacaatcaatgccagcaatatacatcatggcagaagtgaaataatttgtatttatttgtccccatgatttctggaaaaaaaactttttaaggagataatgaaatcataaaacttaacaatacttaacatgttaatctaagtatgtttttttttgtttttttttttttgaggagtctcgcactgtctgctgggctggagtgcaatggcacaatgtcagatcactgcaacctccgcctcctgggttgaagcgattcttctgcctcagcctcacgagtagctgggattacaggtgcctgccactacatccagctaatttttttgtattttttagtagagatggggtttcactatgttggccaggttggtctcaaactcctgacctcgtgatctgctcacctcagcctcccaaagtgctgggattacaggcgtgagccaccacgcccagcctaacataagtatcttaactctgttttcatcagaatattaattactttattaaggactggagaaaaagaaactactgctaacattgaacataagcttagtagaaatgtatacatatagattatataatatatacacacatgatacatatacacattacataggaatagattaatatgaagttaaataaacagattttacctgttcaactacctagtagattgggaactcagaagaaaactgatggggaaagggtagaacctaggcctatcaaagagtaaattaaggcactaataccaataattacatacaataattatgatatgcatggaacatatctaattacatcactttcccactcaccatctcttctttttttttttttttttttttttttttttttttgagacggagtctcgctctgtcgcccaggccggactgcggactgcagtggcgcaatctcagctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaccatctcttcttaagacaaatattcacattctcttctagtcctaagatactggattaatctgtaatcttcaaactcttctttggtatttccttatctataacttccaagcttccaagtttctccgtttctctagttggctgcaatagctccgtgctcagattcactcggcactccttgcctgaacatctttttgccttaagagctaatattttatttattttcacttttagtataagttagtccacaatcagtcacacaatcactcaacaagtgtttcatgagagattcccacttgtgaagtactcttctaggcactgggtgattttgcagtgaataaaactaaccaaatgtttctgccttcacatagcttccaaatcagaagccaacaaatatataatttcaatttgttctgtgaataaaagaaaagagaatagagagttggcataaggaatgggtgtgaacagtgcttctacacagagatgacatttgaatgacataaggaatttgttaagtaaatatctggaggaagagtgttctgggcagaggagatagccaagttcaacagccttgttgtatgaagcagcttgaaatgttcaagaaaaagccatagaagaccagtgttctgctcttctgccaggtgaggacacagcattcttcccctctggaagatgcagttacagggtgccatcttagaaatagagagcagcactcaccagatacctaacctgcttgtgtgttgatattgaacttcctggcctcctgaactgtaaattactcagtctaaggtactccatagcggcacaaactaagacagaaattggtattgacaagtaagtgtgctgctctaacaaatacctaaaaatgtgaatgtggctttggaactgggtagaggttggaagagttttaaggtgcaggctagaaaaagcttggattgccatggacagaatgttaagggcaattctggtgagagcttagaagaggagagctgtagagaaaggctcagtcttagagattacctaagtggtcatgaacagaatgttcataaaaatatggacagtaaaggccatcctgatgaggtctcagatggaaatgaagaatatcttactggaaactagagaagaagccatccttgttacaaagtggcaaagtacttggctgagttgtatccacgttctgctttgtggaaggcgggatttaagagtgatgaactagaatatttggtgaaagaaatatctaagcaaattgttcagggtgctctatggtgtggcccagctgcttatagtaaaatgcagtaaaagagaaacacattaaagatagaatttataatcaaaaaggaagaagaatgtgaagatttggaaaattgtcaacctcgccgagtaaagaataaaaacctgtgtttaggagagaaaaccaagggtgtggccaagtgaccatttgatgaggagattagtatagataggaagaagcctgattccttttatcaaaacaatggaggaatgaccctgaaggcaattcagagatcttccaggctaccactctcatcacagccacagagagctagttgcttgagggcagaatggtttcaaggcagggtcctgggaagcctgaagatcctcagagtttgctgcctaaggccacctcaagtctctgcttcccctattccagtgcagtgctccgcagcagtctcagctgtggctcaagtgggcctagttgcagcaagggcagcttctctggaaggtacaggctatataaacgttgacagcattcacgtggtgcttactttgcagtcacccagagcgaatgagctgtggaggcatggatacctcctaaatttcaatgaatgcctcagagaaacttggggtccaatcagagaactactgcaggatcagggccactgcagaatgcctgcattagtctgttttcatattgctataaagaactgcctgagattggataatttacaaaggaaataggtttaattgactcacagttcagcatggatggggaggtctcaggaaacttacaatcatggaggaaggcaaagaggaagcaaggcactttctcacaaggcagcaggaagaagtgctgagtgaaggggtaagagccctgtattagtccattctcacactgctaataaagacatacctgagactcggtaatatttataaaggaaagagttttaattgactcacagttctacagggctggggaggcatcaggaaacttacaatcatgatggaaggggaagcaaacatgtcctttttcacatggcagcaggaaggaaaagtcctaagcaaaggggttttgaaaagccccttataaaaccaagagatctcgtgggaactcactcactatcacaagaacaatatggaggtaaccgctcccatgattaaattactgctcactgggtccctcctatgacacatgaagataatgggaactacaattaaatatgagatttgggtggggacaaaaccaaaccacatcaagccccttataaaaccatcagatctcctgataactcactcattatcaaatgcccccatgattcaattacttccatctggtcccacccttgaccagggtgtggggattatggggattacaattcaagatgagatttaggtggggacatgaagcctgaccacatcagtgcccccactagggcaatgcccagttgagccatggggtcagggctaccacagcagatctccactggggaaatgcccagtggagctgagaggtcatggatactgcagagagcccccactagggcagtatttactggggttattgggggaaggccacctccaagaccccagacctgcacagccaccagtctgcaatgccagcctgggagagctccaggtacatgaaatcaaaccctaagagctgtggcatgggctgcacccaacaaatccaaaggggcaaagttttttggaggcttggggaatcaaccttcactcatgagtgtctggaaagtgggacatggagtcaaatgatattattctcaggccttaagatttaatattgtttgtcctgttttgtcttgaacccaaaagcaacctattaccccttttctcttgcctagttttatcttttggaatgggaatgcctatcccatgactgtctcgccatggtattttggatgcatataactggtttgatatcacaggctcacagttggaggcaaatttgactccgaatgaatcacaccttgagtatcacccatatctgatttagataatatttgcatgttctagatgagactttggatataaactttaaaggttatgctggaatgagttaacacttttgggatggaattaatgtattttgtaagtgaggagaacatgaatttcgggccatcagtggtggaatgctatggtttgaatgtgtcccttccaaaattcacatgttgaaacttcatccccatggtggtgatattaaaaggtgaggccttttgggaagtgattaagtcaggagggcagatcattataaaagggcaggaaggaactaacttaagccctttttgcttttcttctacatgtgaatacaacatttctcccctttgaagatgcagcaacaaggtaatatcttagacaaagtgtgcaaccctcactacacaccaagcctgctggtatcttgatcttggacttcccagcctctggaattacaaaaggttaatttattttctttataaactactcagtctaaattattttgtatagcagcacaaatagactaagatagttatcgactttttctttcatattttggattttttatgttgtatttaagaaatctatgccaaatccagattcatgaagatgttgtctgacattttcttctagaaattttatagttttagatgtgacatctaaatctaagttccatcttgagtaaatttttatatatggtataaggtatggattgaagtttattataatcattattttacatatgaatatctaatttttctagcacaatttgttgaaatgactatcctttcccaccaaattttacataggcctttgtcaaaaatcaacagaccatttttgtgtgggtcaatttctggactcaatattctattccattgatatatctgtctgtcttgataaccattttttaaaaacaagtctataaatcagctaatgttgataatgttagttcttcatttctgtttttacttttaaatttttaatggatattctgattcctttgtatttccacatatattctataactggcttgtcttttttcttaagcctgctaggtttctgattgagattacattgattctattaataatttggggggaagatttgaaattataacaatattcagccatcaaaccctcaataagccccttttgaacccaaaagggacctattaaccctttccactgttcatatgctatatgaatatatgatatttcccctatcatattatatatggtaatatgcttcaatttatttaggttttctttaatttctctttacaatactttgttgtttctgctctacagttcttgcatatttttgtcaaatttattattaaatattttatatttttgttagtggcagttttaaaattttaatttataatttttactgctagcatatagagatatcattttttatactgatcttagattccacaaccttgataaattcacttattagttctagaaaattttttgtagattgtaacatttttttaaaatttagatgatattgttgtctattaataagcactgttacttttttcattctggaaagattttatgtctttttcttccattattacattggctagaacctctaatacaacattgaagacaagtagtcagcactaatatctttgttttttccttatcttgggaaagcattcaaccttttatcattaagtatgctgttgaaggtttattatagatgccttttatcagaagggagaattacctttctaatgctaatttgctaagagagaggttttatcaagaatggatgttgggtgctcgcttcggcagcacatatactaaaattggaacgatacagagaagattagcatggcccctgcgcaaggatgacacgcaaattcgtgaagcgttccatatttttttgagaaatgcaaatcaaaaccactatgagatatcatctcacaccagttagaatggcaatcattaaaaagtcaggaaacaacaggtgctggagaggatgtggagaaataggaacacttttacactcttggtgggactgtaaactagttcaaccattgtggaagtcagtgtggcgattcctcagggatctagaactagaaataccatttgacccagccatcccattactgggtatatacccaaaggactataaatcatgctgttataaagacacatgcacacgtatgtttattgcggcactattcacaatagcaaagacttggaaccaacccaaatgtccaacaatgatagactggattaagaaaatgtggcacatatacgccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtgggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaaaaaaaaaaaaaagaatggatgttggattttgtcaagtgctttttgtgtgtctattaagatgatcatgttttcttttatagtctgttaattgttaatgatactatttttctaaagttaattcaacattacataaaactcacttggctatggatatgttatccattctgtaaactattcattttagtaaaaattggttagaaatttttgaatttgttcatgggggacattagtttgtgattttcttgtaatttctttgtctagctttggcatcaaggtaatgttgggcttgtataatgaattagaaagcattctctccttttacttttctagaagattttgtgcagatttggtattatttcttcttttgatattcgttagaattcttatgcaaagtcatctggccagaaattttctttgtgtgaaagttttatttaaaaatttcatttctgtttttagatatagtattcgggttatctatttatttttgtgttagcattggtagcttgtcttttcaaggtatttgtcgttcatttcagttgttgcatttatttgcataaaggtttttatgacattcaattgttatccacttaatagatgtggaactttagtgatggcacctctagcattcctaatgtgtatgttttttccagattgatctggctagaggtttatcagttatattaatcatttcaatgaactaccttttcattacattgattttccttagtatatttttgttttctatttcattcatttttgcttcagttttattattttctttattctgtttattttggatttaatttgctcttttgtcttattttctaaatatagaagctaaggccattgttatgagaccagtcttttttgtctcactctgttgcccaggctggagtgcagtggcacgatctccattcactgcaacctctgcctcctagattcaagcgattctcttgccccagcctcccgagtagctgggattacaggcgtgcaccaccatgcctggctaatttttgtatttttagtagggatggggtttcaccatgttggctaggctggtctcgaaatgctgacctcaagtgatccactggccttggcctcccaaagtgatgggattacaggtgtgagccaatacacccggccgagaccaatcttttatgatgtagaaattttagtgctatgaatttacctccaaatatttttaaatctgggtcccacaaattttggtagtttgtcttttcattctcatttagttcaaaatattttctaattgtatcttattctttccttgatccatatcctctccagaactatgctatttagtattaaattacttgggaacttcttagacatttttttctgatattaattcctagttcaatttcattgtggtcagagaatgtactttgtatggcttcaatcattttacatttattcgacttgtttaatgatcctctatctggtttatcttggtaaatgttctgtgtgtgcttgaaaacactgtgtattctactgttgttgtgtcatgtgttctaccaaagtcagttaagtcaagttgtttgatattgtttttcaagtctgtatattttactgattttttgtctgcatcttttatcatttattaaaagaagaatgttggcatatttgactataattgtgaatttgcccatttctcctttaagttttgctattttattcaatgttgactttgaagcagtgttattttggatacctaaatattaaatatttaaattcttatatttccttggtcaattctccctttatcagtttacagtgtccctcattttgcatgtgatattcttgcctctgaaagctaccggatcatattatacaggtattctagctttgttttgaaataatgtttcctctttgcatttaatgtggaaattactcttctaatgttttcaatgttacaggtagctttaatttgctaaggtggccataataaaataccacaaactgagtggcttatacatcatgtatttgctcacagctctggaggctgtaagtttattatcaaggtgttgacagggtcggtttcttcggaggcctctcagaatctaccatgtctcttgcctagctaaatcagtgattttctggcggacactggcatttcttggctttcagaagcatcattccaatctctgcctttgtttttatgtgacattctcactgggtctatgtccaaatttcccctttttattaaaaggccagtagtattggattaagtcttgccctaattacttcatcttagctcattacttctacaagaaccttgtattaaaataatgtgacattctacagcactgggggttgaaacttcaacatattaatttgggggaacaaaattcaacctgtagtgttggtattttcttctcagtgtctaatctgctatatatcccattcagtttatttttcatttcagacctgtaatttatatccatagaagtttgattttggtatgttttatatctttcatatgtttacttaacatgttcaacctttcctcttatttattgaacatatataatatagttagaatacctgtagctttttttttttttttttttgagatggagtcttgctttgttgccgaggctggagtgcagtggcactaccttggctcactgaaaccccctcctgggttcaagcgattctcctgcctcagcctctcgagtagctgggactacaggcgcctgccaccacgcccggctaatgttttgtgtttttagtagggacggggtttcaccgtgttagcccggatggtctcgatctcctgacctcgtgatctgcccgcctcagcctcccaaagtgctgggattacaggcatgagccactgcacccagccgtctgtagccgttttaatgttcttgtctactcattctataggtgccattttctggtctctttctattgaatggcttttctgctcttattttctttccttcatgcgtgattggtaactttttatttgatgtcagacaatgtggattttacctttttggtggtgtttttcttctcctaatattattttcacacttaaatctgagatgctttaaatttacttggaaaaaaaaaacattgattctttcaaggcttgtttgtaaacttcattagacagaaccagactagctattaatctaggactatttttcttccactactgtggcgataccctctgacgaacctacctaatatcatgtgaaatacaaggcttttcactctgacttgtgggaacaagaaatgtttgagctctaagaattgtttttttctgctgtttacagatagttgcttctccagcttcagttagtttcctcacattcatgcactgattcatgctcaactaaagctgagaaggaccttcaacaaatcgctgcagttatcttattttttgtgcagctttcttttctcttgtattcttccctgaaaattgtagctgtatttccctttttggactcctagctctgtcttctcaacttagggaggccactggattccatttaggttctccgtttctttttattttatttatttacttatttgtttattttgagatggagtcttgctctgtcgcccaggctggagtgcagtggccagatctcagctcactgcaacctccgtctccagggttcaagcaattctcctgcctcagcctcctgagtagctgggactacaggcgtgtgcccccacacctggctaatttttggatttttaggggagacggggtttcaccgtgttagccaggattgtctcgctctcctgaccttgtgatccccccaccttggcctcccaaaatgctatgggattacaggtgtgagccaccgcggccggcctgagttctccctttctatgatgtagcctgaagtctcctttcagacagtaagccaggacaatcgtaagggttcactttgttttccctctgtaaggaattattttctcacactacctaatttctaacgcttaaaaaacatttatatatatatatatgtatatagtccagtgtttttagttgtttctgccaggaagataactccattacaagttaccccatctcagctagacagttcctaagagaatacattattggccgggcatggtggctcatgcctgtaatcccagcactttgggaggccaaggcaggtggatcgcctgaggtcaggagttcgagaccagcctgatcaacatggagaaaccccgtctctactaaaaatacaaaattagctgggcgtggtgacacatgcccgtaatcccagctactcaggaggctgagggaggagaatcacttgaactcgggaggcagaggttgtggtgagctgagatcacgccattgcactccagcctgggcaacaagagtgaaactccgtctcgaaaaaaaaaaaaaaagaatatattattatataactttttattatgaaaataatattttcttataaaaatttcaagcagtgcagatgtatatacagaaaaacttgcatttctaccattctctccaccctctattctcccaaaattcaactgaattactggtcctcaaaggaaacagcttgcaattggtatgctcacttacagataattttatattcatttaaatatatatacaaagattcataatatagtcatatacatatatgcaaatattaaaaatacataattatatattttttaaacagggtcttgctctgtcgcccaggctgcagtgcagtggcatattctcagctctctgcagcctcaacctcccaggctcaagcaattctcccacctcagcctcctgagtagctgggactacaggcatgagtcaccacacctggctcttttttttttttttttttttttttttttttttttgtagagaagagttctcactgtgttgccctggctggtctcgaattcctggactcaggcaatcctcctgcctcagcctcccaaaacgttgggattgcaggcatgagctgctgcgtttggcctacataaatattttgacataaatgagatattaagtacttttgtaaattaattttcttgtctaattctgtatctttgtttttcctctatatttgccatacatatctatgtcaatattttaattgtctgcatataacttcatagtatggatacatcatttttaaatgtaggtatttctctattgatgtacaaatgtttttcaccagtttttctgtttaacaaatgttacaatgaacatttttgaatcatatgttttcgtgcacatgtgtagcatttctaaaaggaaaattcttaaaaatttaatgagcattttaaagtttgctagaaattgccaaaatatcctgcaaagtacttgtactttgttctaacagtattaggatttcctattccctcatgatttttgttgtcaatccaatggaagaaaattgcttctttgttttaatttatatttactttacgaatagtaaagttgaatatcttttgttatctatttgtagttattaatctgtgaattgttgccatatttttctattgggttgtttgattttttatttatagaaaaaatttgtatagtcatttgtttgttatacatatcacaagtattttctcctaatctcttctttatattttaactttgtataagaaataatttgccgtatagaaatagtgctggaaaacatgtcttttgagaaagaacataccttgttctatttttttccgcttttgaaaattccatctcatccaccagctgcaggacaaatcactgaactaaatgtttaactggttttgagaaagagaaaaacagcttctgacattcacaagctatgcccagttgttgctaggagctggcttggcactcacagctaggccttggtattactctatcaggaacatcagcattaaatgaggccgctgtgtgaccatgacggatgaaggcgaaaacaagaccgctctgcaatcatgtctgaacacagacagaacatggacattgtgcaagtcacaagaatgaccagttatctcactattctgaataatataagttgctgggtttttttcttttaccaattacaagtctacccttgctttagactgccctcacaatagataaggtgtattaagatacctgatcatcatattaccccgacttcccgagagtattcaacccagagaaaaattctgcttcctcaaaatctcccgcaaatcacctaatacaaatccaaacactataacaaatccttttattatcttcctactgagatgcccccataattgataaaaatagttctctatgatgtatattctctcctactgtaatgagtaataaacccgatttgttcaactatagtgtgttcctgatagtctttagctagagggctttcaaataataatatgaaaacattgtggtatatagtccaactgctttttatttttattttatttcatttttaaacatttatttattttaattgatgagtaaaaattgtatatatttattgtgtacatcatattgttttgaaacatgtatatattgtaggatggctaaatctagctaattcacatatacattgcttcacatatttatcttttttgtggtaagaacatttaaaatctattttcttagcaacgtgcaagaatataatgtttttattaaccacagccaccatgctgtctgcaaaatagatctcttaaactaatccttcctatctagctgaaattttgtatcctttgatcaacatcttcccgacccttatattttattagaatgagtcatttccagtccgatgaaatccattactgttttaaagccccattccgtgtaggtcacatactagtttaagttttgagagatactatgtatattcggataaattgtatcagggagtcagtataggatccttgaagagcattgtatttgatatgagaactggatttacaacattctagaaggaggattttggggaaatgtgttaatcactctaagtttttgcttccttatttgtaaatggagataagaactcttatcttaacactgttgtggtaaggattcaatgagggagctttttgtaaactaaagctaaagttctgtaaataggaaagactttcaaaatagtaatggttgagcttggatggaactgattaaactcacatctcctttcatcaccccttatttattcatgggaaacagaaagcacagagaaggagaattcttttactttaggtggagatggactccaggttttttgactcctagtctagcatcctctatacttcatggaaactgttttctattttatttctttttgcttctttgtaataataaaaaattctagtaaatgattttttggtacatcatgctatcttccgggattaactcctcagagtcctccaaacaatttgcaaagttaatgactcctgggtgtttatgagattatggttaagtgaagttaagccacaaaagtctattaaaaaataatttccagacttttcatatgcaaattattcttgtggatttacctcccacccttgtttatagtatgttgaccatcttctttctaagcaagattcagggtcttatttcatcatgatttcacctgttgtgattgggttctgtgttcttatgtttgttctgcccagcagtataggtttaaaaaagaaaaaaataataataatcttggagcctgaggaaagtgttctcttcactgatggaagattgctctctgtttgcctgtcagctctttgttctggttacttattctttctaacatgcttggctgcacaaatcacaaaatagagggataaaaagatcttttggaatctgtatttgctatgttgcaagctcagttaccatatggaacacaaaagcccagaaccttaagtatgaaacagcattttgttgttttgctttcttccttaccattttagcaatgtgtcttttatcactacggaagtgaagtctttactgaagaaattaattgtgtgtgtgtgtgtgtgtgtgtgtgtgtgtgcacttgcccccgtgtattgtgtatgaagtgagtgatggggggggcaccaaaattgttataagaagcaacattttatgccgtaggcaaagatggtactttaggcattgtaaataatcagatatttcttgtgagccttctgaatattgctcaggaattgattactcaagcatatccattattcttcttctatgttgtcagaataaatgtttattatagcattacttaaaaggttttggataatgagaattggctgcaaggtagatgaaagatgagacaaatagtcaagtgagccttttcttcattcatttcctcattcacttttcacacaatttttttaatgtatatatattttttattatactttaagttctagggtacatgtgcacaacgtgcagctttgttacatatgtatacatgtgccctgttggtgtgctgcacccattaactcgtcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttgtccttgcgatagtttgctgagaatgatggtttccatttagtgtcagagactctgttctgggcatgagaatgcagagtgagcaagacataggactacccttattatgaagtaagtatagggagacacatgacagggagacaaagagctgcctgttgatagtgacaattctataattcctctgagctttgtagatgaggcatcttctatgcactccactacatagactgagcttcattagtcctacgccttttgggattccattgataaggcctcaagaactgcaaaccaaattggatattaatgtagatatattcttaggaagacacatctgcttttcaggttaacatatgacatttttttttttttttgagacagagtctcactgtgtcgcccaggctggagtgcaatggcgcgatcttggctccctgcaacctccgcctcccgggttcaagccattctcctgtctcagcctcttgagtagctgggattacaggcacacaccaccacacccggctaattttttttttgttttgtttttgtatctttagtagagacggggtttcaccatattggccaggctggtcttgaactcctgacctcgtgatctgcctgcctcggcctcccaaagtgctagaattacaggcttgagccactgcgcccggccaacatatgtcattcttgaatcagacattaatggtcataaatgtgtctggccgctgatgaggacattggtataggtaacagaattttgaggaaattttgtaactaatacagtatttatttaaccatgaatctgttgccaaaataccagaaaatgtaaaatcttgtgataggaaaaaaattgcaaaagtagaggacactttggaggtaagttttactgataaggaaatggaaccttaagagtttaaatgatgttcccaggatcaccagctggtaaatactagagttccaaacatcaactcatttaattctttcaacaaccttttattttaagtactactattatttgtatgttacaaattggtgactgaggtccagaaaaggtaagtaatttggccagggccctgtggctagtaagtgtcagagccaggattcaggccaagaagtttgactccagagtcgatgcttttaactttacaccattctgtctcttcaggaatagctgtactcagtttccagactccacttccctcaacccctcccacttttcttttcattctattatggtgccaagcacacacatacacacctgctaaaagacatatatacccccctataaaacattttaaacataagcatgtatatgtgtatacattctttgcttctcagtgtgtctgcggaatgatgattgataaatgactcaaatcagaaagcaaaagagactgattctgttttatcatcagccagaaacaggaagcttcctttaggcattctaagcataaggcaagatgaatggggtgctaattagctcttctagctctatcagcctgctgtcctttgtttggggccaagaatgaaagaggttagattgtgcctaacaatatggtccactggcctgattacaaggctccaagagggcttttgcaacatgagcatatggacgttttgcaatatttacaggaggaaatgtatgctgatcggcatacaggctgcaaatggcttcctgttgtaagcttcttcaatgtatttccataggtatggttgctcatactccacttggatatatattttttaatttgaagaaaatatcttactcaattataacctgagctgtgatttttctagtgaatttaaaataaaataccattgatatagtatagtacaaagaatattggtcttagagtcggaactcatgaagttgggtcccatttttgccttgcacattaattaccatttcttcatagctggagaaaatcaaatcatcaggcaccctggtttaactttaatgctctcaaaactcaagtcaggtctcaatacttcctggaatttcaactgtttttctatagcaagttcactttttcactgtctgagaactcattttcatatgttccctttccttaaacttcatatacccacctgtcccaatccccttatttccagttgtatacctcactgagaaaatcgaaggaagccatggaaagaggtctgctccatcttttgactgtgatatctccaagcctcatgttaatataccccttttctttatttcaaaccaaaaaagtgtccctgttcctatgaaggggcagtccctccacaattgcactgggtcccattctctttcacctccccaaggattttgctctttcagttgcaccatctttctcttgcaacatcagtttctcctctattggatcatgtctgttaacacccaaatgtgttaaaataactactatcttcaaaataaaataatgaaaaactttattcaccctaaatctcatctatagtctaatttatctgctctcctcactgcgaaacctgttataagagttgttggctgggggcggtggctcacgcctgtaattccagcactttgggaggccgaggtgtgcgtatcacgaggtcaggagatcaagaccatcctgaccaacacggtgaaaccctgtctctactaaaaatacaaaaaaaaaaaaaaaaaaaaatagccaggcatggtggcgtgcgcctgtagtcccagctactcaggaggctgaggcaggagaattgcttgaatctgagaggcagaggctgcaatgagctgagatcatgccattgcactccagcctgggctacagagtgagactccatctaaaaaaagaaaaaaagaaaaaagagttgttgatactcactgtttctttttctcaaaattcctatcgctccttaaaccactcctgatttcaatctgtccactccattgatcttgcttttgtcaaggtcatcagcgacttccatatttccaatttaacggtgacctaccactcttaaacagttggtcattctctctttgtttgaacatcatcttcccctgtcttttataacttcacattgaactttgttttcttcctacctcactgaattctctttctcactctcctttactggctcctactttattcaacccctaaacatttgtcttaggctctctacttatttgctactttcactagattgcacctcacctctgcttccaatatgcattttttttgttttactgtgtgtccaccatttttatttcgaactgttgggaataacactcaaaattctaaggaaatcgaacagtcgaacaaaggattcttagcaaagccattttacttctgtgcagtgaggtgcctccttggccagtcgccatgagaacacacctgaacaaaggggcaccagagcctttattcctgatgcaagtcctgcccctgcaccctttccccattggctggggtcgggtcatacaatctaaactaatcccggttggctaaacatttgatttttttttagtcaaggtgggcaggtaaaagaaagcagagaggaaaggggaaggggtggctgtaatgagctagaaagttagtcctctttccaaataaggaaaggaatgtgagctggtactgataacgcctggtactgtggcgtgcctgggcatctaataaaggcaaaaaggaaataaggagaaaaaagaaaaaagaagggaggagggtactatgaattaaagaataaaagattgatcaggttatttgaagagaaacttcatcatatcccacatcatacatagcatttatcaaaagctgattagacatagtttgtgaaggaatatagttgaggtttagattggagggtggtttccgatcagattttatacgccttgaatactcaggtttacagtctctatcttatagtcatcaagtaccaaatataatttttaaagcaggttgaatttatacaaacaggaacagaacatggaagacaatggaggtgaagtctgtcagttaaaagagtttgagtgttgtaacatcttaacgtaaggtgaacatgacctgaattaggtattttgtgggagtgcaaatgtaatgaaccacaaaagacattccaaaatacttgacaagagtaggcaaacggctgaataggagggttaaaaaacagagaattgtacctccccatggtttttaatccaaatgacttggaggataaagtgctgctaatattggtaatgaacacatttctctccagagactgactgactccaaatttgaagccaaatttacttttatggctatgcttaaactgacataatgatatattggtctgctttcttttatgaaatcagctctaaaaataaatattcttgtattcagactttctgtgtgttctgttttcatctttttactgtagctaaagatcactttgtgactttttcttgtttttggccaaaggcttttgcaaaagcaatgaagttatgacctagttctgtggcagaacaagtatggtctacagggaaacctgacttggagcaacagatgtggttttagacatgttgggtttaaggtggtgtcaagatatcctagtgaaaatggcagttacagaactatggctcaaggtcaaagaacactctgaatggtgaatgcagactggaaagtcattcaaccatgatataatggcctggagacacatagctagtagtgtcctaaatatttaggctggggtttacatttcgcaactagcagatgacataataaagccaaagagagagagaacatgcgagcagaaagggaaaaaaaaaagggaatgaatagccaagggacacatttcgcaaggctcaaacaagttgactatactgaatgttgggagagctgtcaagggaagtaaagactgaagattttgtaatgataaggttgaccttgaagagtatattttccgtggagtagtaggggcaggattcttggagaaaatgagatgactgaataatgatgaaaaggagataagcaaaaaagaaagaagataaatagctttagggaggtgttttcaagggaaagtattttttaatacctttaataggttattgctttattcagtgaaaaatatgtgcctattgtaagatttaaaaatacaaaaagtacaaagaagaaagtaaaaaaaccacatgtaatgcaacaatacagaaaaataaccacccttattgttttgataattttcatacttgcaggtttcaattaacagcaacataaaattgattgaaaagagtatgttaggttttttttggaaaataattgctaaacatacaatgttaatatttattgaaaatacatttcttggccgggcgtggtggctcatgcctgtaatcccagcactttgggagactgaggcgggcagatcacctgaggtcgggatttcgagaccagcccgaccaacatggagaaaccccatctctactaaaaatacaaaattagctgggcgtggtggcacatgccagtaatcccagctactcgggaggctgaggcaggagaatcgcttgaacctgggaggcggaggttgcggtgagccaagatcgcgccattgcactccagcctgggcaacaggtgcaaaactccgtctcaaaaaaaaaaaaaaactacatttcttaatgagatggcccatattgttcctgttcccctctcatttactcccattcattcttgtagacatagataactattactaattgctagaataagagagggtccattattaattctattttgatttttttctttgtcaaaaatagactttgtttccatgaatatgtatataggaatggaagaaggatttttttttacagcaatttcactcaattctttgaattcttcatgaattacataccaaaaactatgtacatgacaattgcaagtcattcaattttgttgaaaacaaagcattggaaattgcttgacttacaaaaggagttgctatctagtctttagaaattgttcaccttgtcaagtcaatgagtaatattcctaatgttaaaaggtaaactgaggcacaataccatttttaaagagtttgagcaaaaaatattccctgaattgtacagctccaaactagaagccattcgggagctccatcaagggaaaacaatggggagaattttataaaacagacacggaagtaaagcagatggtgtttgattggttacagttatacagttgcctcatttgatctatcccattggaaagtcctaattctataagtttgttaactgcttctgattggttgagtttacattctgtttctctgtgatataaacattgagaaatagctcaagttaagttttgcttatgtttgcaaatcaaacaaggttgaagtcacttctgaggcctaactgtgtttttcttctaagagattcttccggtctcgtctctattttaatttggttcagccttaatcaacctcttgtcctcaacgtgtttcttttttgttgtttttatttttacctttttattttaagataaaactcagatatggaaagcacacgacaaaagtgtatggttttatttccgccacgcagatataaagcaacagaatattgctacccaacctagtattccaacgcagataccttgtcccagtcaccattccctttaggccgtttaacaaaactaagacatttgtctgtgttaataggaagccactaagtggccaatgaagaaatgaagaccaaagacaaactaagaagaaatacatcatatgaatcaaagtcttgaagaaggcatgagtggaaagaatcagataaattctacatcattgacaaggtttagtcttagaaaaaaagaaatttctcttaccgcaagtcagagaaaagagaagagacgacaaattcattcaacctatcatttaacaaagatttcttaagcccctattaattggcagtactgtagaaagcactagagagagattttaaagaggaaaataaactgtactcgggctctcctgctagatggacttaatcgcttcgaaaaaggaggagatgaggttgtggttctcaataaaagctgtttaagggattgtggatttggacatttgaagagtgagaacgaaatttcaaaaagctacagtagagaaagccctatggaatcaatacattttctttgcaggactctggaaagaggcaagcctagcattttgtttgaaaagctaagcttggaatgcttttatcagacatcacagtgaatctaattgattccatttttaaaattgcacctgccattggagttatgccaaaacacacataccaaattaaagcacaaaagccaataaaacataacaggagcagaatgctgcaaactcaattgcttattaaaaacctattagctttaaaatgttagcatgtcagaaaacagtttccttctactaacatcagctttgaaggccagctaatcggaaatacatagaattaggacaggcagtaaattcaataaagtagaccttgcagtaaaataaactttgctccaggcccatgctgttgcaattagaaaggcatcatcaggcacaggcctgcagatcagaggtcttagtaagccagtggtcattctggtatttagagtccgcttgttataacttaagtcatctttttaaatatcctatttgatataatatttaattgtctctttaagagtgctgaaaaaatatcaggatgcttgaacactttagaaataaaaatatccaaatgagctagccagtgggacttcttttgtgtttttctttcttccagcaagacagccttttttttctttcaattccttccttctgttctcataaattaatctgcatttgtgattttggatttgtgcagagtggagtgtgattactgaggtcttcaccaacattcaggctgacagagaacagttgaaccagctattatcttttgtgctgagagatatgtttatggtaaatgctcttggctctctgaaaagttgggagaataggcccttgaaactgatgagggtgtcaaaatgttgctttagatccctatagctgagagaactgcaaaggtgacttggcgaagagttatttataagatcattgaatggaagataaaaaggaaattattttacttcaaatatgatatgttttgtaattattaactgaatcatagaatttgaattggaagagatttcataaggcaatcagtctagcgatttcccaatactgatttctagacagacacaagactgggataatattttcactaatccatggcagaattaaaagaaaaataagaaaacagtatagacaggttttcaatgaagctagatttgttatttgattttaatcttaatattacattctttttatttttagtcctaaaatactctttcttctttgagatgacagatgtatatggtgggatgtataaagtgctcttggttagattaaatgaaacaatcattgttcttttgggaactggagtaggggtgatgtgaagctagattagaaagtaggcagcattcggtttgaggaccaggatcttgttgttcctgagctcttttcttcctctacggtactcagtatccttatttttctatgcagtttacaattttcattttgttccgtactcccttctctcccaaatagaaaccaaccttgaaaaagaatcagctttcagccatttatccaactcaaaggcaaggtgagagtgaactgttggtgctggaaaccacaatccactgctctcaattttattttctcatgtacgttaatctctccctctctgccagctcagtatacatgtacgattgtgatctaaattcttatatcacttttacaaactagaattctccccgttgtgtatccccctgccacctaccccctcatttgttttctccactaaacacactgtagccacttccctcatttcttcccacttacttttcagttcagttcaatttggttttgttctcattccactggaactgcttttatcgaggtcagcattaccatctgcactattaaaaccactggttactttatcattttcctcttactcaaattctcggcattattctgcacattggcaactctctgttcttcaaacacagaactatgccaaaattgtcctatttttgagccttggcagctgtttttttttccctctttttcaatgcttgctctttctgatatatcaaataagacttccttggagaaagcttcacttagtacccaatatacagtagttctgtccattacactaaccatcactgctgtctgttactctcttgcagcatcccaaaatttccttcacagcatttacaactgcttgtgtcttttatttattatctgtctctccctgtacataaagctttatgaagttcagggactatgaatcccatattcattgctgtacctccagaacccagcacagtgcttgttgcatagtagtttttttaataaagactcgttgaataatttgatggatagatgaatgccaagaatcccacaatattttttactagccccaacttgaaaactcatgccaagacttttttactttatctttgcaatgattctcgcatctgtctctttcttccagtccttgcttccgctttccttgcccaggccaccatcatctattagtttaaccatttaataaaactcataactcaccttctgtcttctcttgttgatcttcaatccatcctatatattgcagttagtcttatacccttcctgaaactctgatcttattttcctatgaaaaacaaaaccaaataaaacaaactcccctttgtgtagacagtttgttctaagttttctatcctggcattcatgggccttgaagacctggctttaactgataccagctataagtgatatataatgtcagacgcatttgcctagctctttttttgtgtgaacttctctttcgaaacttttatgactcagtgttgtgttattacaccatttaatagaatgacaacatgttgagggcaggtacatggtatgttttctaatttcagcacttagcacagtttttgatacacacaagctctatacatatttactgaataaatcattgtgtgaccctcttcttgaagttgtacaatcagtgtcaaacagaatatagaatgtaaaaatgattaattgcaaaccctatctagtgtttgggtgtaactaaaaatattaagttctgtacattttgtttaatgcaacggatatgacttattagctgtgctaatgttaaatattgttgtgcaactgatgcctgcagtttcctgagccaaaataggagaaatcttgtccttagaaattctttgactgaaaggtcatccaattaattacaagacccttagcaaaaaaactgctgatgcatgcggccttttccccagaaagatctgcaagatatgaagagaacaatagcctcaggcagtacactcagaagatgaaagtgtatgtgaaaaaacccactctgaacatttctagcacaggctggctgcctgcaggtcctgatattgaccctcaagcatgctgctcagacttccattgcagaggaattaaagtggccaaatctgtgtgtgtgtatatatatatatatatatatatatatatatatatatatatatatacacactcactttgttgcccagactggactggagtgcagtggctccatctctgtgcactgcagcctcagcttcctgagctcaagtgatcctccccagcagtcctctcgccttaccttcctgagtagctgggcccacaggcacgcaccgccaggcccggctaatgtttgtagtgtttgtagagacagggtttcaccatattttcaagctggtcttgaactcctcagttcaagtgatccacccacctcggcctcccagagcgatgggattacaggcatgagccactgcgccttaccacatatatttttaaatattttaaaatacaaattttggctgggtgcggtggctcacgcctgtaatcccagcattttgagaggccaaggcgggcagatcacgaggtcaggagctcgagaccagcctggccaacacagtgaaaccccgtctctactaaaaatacaaaaattagctgggcgtggtagtgggcgcctataatcccaactacttaggaggctgaggcaggagaatgccttgaacccgggaggcggaggttgcagtgagctaagatggtgccactgcactccagtctgggcgacagagctagactccatctcagaaaaaaattaataattttgacttgtatcatgctgcatgagaacagtgtagtataattaagggcagatgagtagataggaacttactttcatggattatttttcttgacatagaagctctcaattttgaatgcgcattaaagttatctgtcaagctttccaaaattcagatgtccaggatccatcgatccccataaattctgatttaattggtctgggatagatctcccacgtggtatgctttttgtaaactccccaggtaaatctaagttgtttctatggttgagaaccgtttctactaattgaagattgccattctgctgtaagttattcaggaataaaataattgatgtagttgttgaggggctttgtgtttcattctaacgttgatttttctttcatgaagctgtaagtttgaggtttgagcactccacactcaacacctgtagtgaatgccagtgaaaccctacagtcagaatgttaattagtattccattgggtactagctgttccagctatatctgttaacagttagaagagggttgacatgacgtgtataattgtaatcaatcatggtcttgtctctgagtaaacaaagtgcatgactgacatttgagatagttcatgctttatccctggctatcttcttatcttatattttctacttttttttttttttctgagatggagttttgctcttgttgcccaggctggagtgcaatggtgcgatctcggctttccgcaacctccgccttccgggttcaagcgcttctcctgcttcagcctcccgagtagctgggattacaggcatgtgccaccaccacgcctggctaattttgtatttttagtagagacagggtttctccgtgttggtcaggctggtctcgaactcctgacctcaggtaatccgcccacctcggcctcccaaggtgctgggaatataggcgtgagccaccgcatgcgggctcttttttgtttgtttttttagacggagtttcactcttttgtccaggctggagggcaatggcgccatctcagctcaccacaacctccgcctcccgggttcaagtgattctcttgcctcagcctcctgagtagctggcattacaggcggctgccaccatgcccggctaatttttgtatttttagtagagactgagtttcaccattttggccaggctggtctcaaactcttgacctcaggtgatctacctgagggaggcccacctgagggatctacctgagggaggcctcggcctcccaaagtgtaggattataggcatgagccaccaggcccagccttctattttcatcttataccatgactggttaatcttccagtttatgctccaatcaccctgaattatgttatagtcaccttgattccaataatgcacaagcttttgtgtctccaggctcctgcacatgctgtttcctctgtgtggactccccttcccttcttgtctgcctgaaacattgctactcattctcctatacccagagttcttgatgatgcacattctgagttagtaagcaaaatatatgtgtatgtttgttatataattttttattgaaagaatcattataaatttcattacatccttaaaagggtctgtgacccttaaatgttaagattcatttgtttctgcctataatcaaatgtgacacagtgaaagcatacactgagacctccttgtttccaactgccccaaccaagttatctgtcacagatattctgtccctcttctcagtttttatagaactttacatatctctgtctctcttttttttttttgagatggagtctcgttctgtcgcccaggctggagtgcagtggcatgatctcggctcactgcaacctctgcctcccaggttcaagtgattctcctgcctcagcctcccaagtagctgggactacaggcgtgtaccaccacgcccagctaattttttgtatttttagtagaaacggggttttaccgtgttagccaggatggcctcgatgtcctgacctcacgatccacccaccttggcctcccaaagtgctgggattacagacgtgagccaccgcgcccggcctagatatctctctttttatatcatatttacttgtctccctttggactgagatatcaccgaaggcagaaacaatgtcttattcacctttgatctcagaacgtagcacaaatagattcattttagctgggagaatgttgaagcttaaatcaacttgcctggaatttaaaggttttcatatgctaaagttctggaggatacagtgcttgcatcttctaactattactcatacatttcagtgtttaaccagtcattgcccttctttaggtaacaatgtgaatgccaagaaatacaattctccttaataaaatatgaaaatcttgagctgtgatagtttgacacagatagaatcagtgtggcgctatcttcttctccaagataatttcttccaacattttaattatatgagttatagaaagaaaataaatacgtaaaagaaaggggactaaatcgttagcaaaataattcaataaaaagtctcagaacttaaggatgcttatttatagattaaaaggctagcacctcgcaaaatagatgaaaatagacttgtgtcaagatatatcagtgtacaatttcaggacactgacaacaaagagaaaattgtataagtttccagaggggtaaaaatagttaagggagaaagaacgaggaatcagatggcttaaaaatgttcaacaccagccaggcgtggtggctcgtgcctgtaatcccagcactttgggaggccgaggtgggcggatcaccggaggtcagttcgagaccagcctgaccaacatagagaaaccctgtctctgccaaaaacacaaaattagcagggtgtggtggcgtttgcctgtaatcccagctattcgggaggctgaggcaggagcatcacttgaacccgggaggcggagtttgtggtgagccaaggtcgcgccactgcactccagcctgggcaacgagagtgaaacaccgtctcaaaaaataataataataataatttgacaccatcactataaaccagaacgcaatggagttatgctttgaaaattctaaaggaaaatgatttctggcgtacgtttctattcccacatagactaaaatcaaatgtacaagtagaaaacatacacttttcagacatatgagatctctaaaattttgtctccctgtgaaccttttcttaggaagctactagagatgtttttcctaccaaaaggaagaagtaaaccaagaaagatgaagatgtggaatgcggaaaataggagacacaacacaagagaaagagaaattcttaaaagtgtagtgatggaaaatcctaggatgagaaaattgaatcaggcctagagggcaaccagtcaagactgttgcagggaagcagcttacaagagagtgttcttcaaggtgagagcatttgcacaacaattgatgtgaataaaagtcttgatatgagatttaaaaaattagtaaggaattttcaattgagttagcacaaattaaaataaaattaagttgaaattcaacaacaaaatcaataacataaatatttctcggcaattcatggattaccataatataaatttaaaagtacttagaacttaatgatattgaaaatattacagagtaaatgtgtgagtagcagtaaaagtgatattacaataggagtttatagacttgaatgtttctacaacttgaaaattaatgtactacatatttaaataaagaattagaaaagaaacaacagaattaattctgaaaaactaaagtgaggggataatgatgtagagaaaattagtaaaacatacaaagctaaaatttggttgttggagaaatataataaaaggcgcaaacctcagggaagttaagaaaaaaagagagaaagcacaaataaaagtaagaattaaaaagatacataactacagacagagtatagattaagaagctaataagaaaatatgattaacactttatgctacaaatttgaaagcctagatcaaatacacagatttttataaatgtataacttagtaaaattgaaataagaagtatgtaatctgaatagtctcataaatgttaaaggaaataaaggattgttcctacagataaaacagtaggcccagatttttttccccagacagagcatttcaatatatatgaaggattctataaaataaaaaagggaaaatcctaaacttattctatgaggcgagcagaactttgataccaacaccacagaaattgagtatagaaacagatattaaaactaaagtccattctcattcataaaacaaatggtaaaatcccaaatgtaaaaagattcatgtggattctttgagggttgggttgaaatttgtttctgccagatcctgctactctgggacaacacacacacaaatttatgttttgagattttccgtaatacccaagcaatacggagatggcttgacaatctgtgatagccagcctgtgtcatgacttctcacggacacaaatttttttctgttttcctccttgttctgctgagctccaagacaacttctgcgaaagttccttgagtttggaaatagggacgggtttccttctgtttcacccttaacatgaagatacagtcctgtggaatcccagatccatctggagagagtcggctattaaactcttttcataagtacgccctgggccttgactactgtctgtctagagataggaggctgatagttccttcctggcccatcagttttggatacaattaatgtttcttccattcagaattttcaattgtttgggaggtgatatggtttggctgtgtctccattcaaatctcaacttcaattgtatctcccagaattcctaccatgttgtgggagggggacccagggggaggtaattgaatcatgggggctggtctttctcgtgctattcttgtgatactgcataagtctcaggagatctgctgggtttatcaggggtttccgcttttgcttcttcctcattccctcttggcaccgccacgtaagaagagcctttggtcctacgccatgaatctgaggcctccccagccatgtggaactgtaagtccaattaaacctccttttcttcccagtttcgggtatgtctttatcagcagcgtgacaatgaactaatacaggttggtccaaataaccttggcttccgttatagaacgtggacattggtgaaatttttaatctttcctgtggcaaactttagcagtgggtattatttttctgacatttttttttctgttctattcacctttgtttctcatagggtgcctttttttgagacggagtctcgttctgtaccccaggctggagtgcagtggcacgatcttggctcaccgcgacctccacctcccaggttcaagcgattctcctgcctcagcctcctgagtagctgagattacaggcattcatcatcacatccagctaactttttgtatttttagtagagacggggtttcaccatgttggtcaggctggtcttgaactcttgacctcaggtgattcacccgcctcggcctcctgaagtgctgggattacaggtgtgagccacccctcccggccctcatagggtactttttatttatttgtgcctgccctgttttgagcacctttttgattgaaaaaaggcttttctgggccaaataattcccatctatctatctacggaaagtgcatgggaagagtttggggatggtaggaattttccttaatattcagaattttgcacgtgtgtgcatgtatgtgtatgtgtgttgatgtgtgtatgagtgtattttttttttcttttgaagcttcattttcccctatgtcaataaagacattggctgctctagggatatttacaacgcagagtatttgtccttttcttttcattctaagaatgagtgcaagaacgggtgcaggaagttcgagaggtggtcattagtcttccgagtatgggagcagggagagtaagacagagaagaaaagtgaatggagggtgcattactgagcttgttgttggtgtgggcgactgagactgagtctcactgggaatctttaaaggaattgtgtagggcatacctcagaattgtccctctgaaagataaggtggctggggcaattaccttcttactccctcccaccatccttggaagttgggtgctcgggacattaattctgcaacatttgtaagctgcagctgagcaccagatgaatggaagttgctgttcaatgggtataatgtttcagttaggcaaagtgagtaagttctaaacctctgcttacagcatggtgcctacagttaataatattgtactgtgcactttaatatttgttaagatggtagatctcatgttgagtgttcttaacacaataaaaaaattaatcgtattcatacaattcaattaattaatacaattaattgtattaattttgctacaacatggaggaacttcaagaacatcacgctaaatgaaaacagccccccgacacataaggccacaaattgtatgaatcgtctgattccattgatatgaaatattccgacaggcaaatccacagagccacaaaatgaattagtggttgccaggagctaaggtgaagaataacgagtgtctcctgatgagtctggagtttctttttagagtgattaaaatatttgggaattagtgttgtgagctgcgcaactctgaatacgataacaccaccaaactgtatacttcttaaaatggttcctcattttgttttaaaagaaccagaatgtctaattaggtttatgtcattaaatacattttttaaagggacttgatgcttgaaaatgggagagtaatgggcatttctaccttctccactctgaaataacccaaatatagcagaggaaacttaagatagccaagttcgatattagcaaaatctaagaaacattttaatgtaccaacccaaggtagaagaaagagctgccccaaagaagtatagatttaaatataattgagagaggaacctgagaaagtataccagtgaccatgcatttttttccttccagcagaccctggaaaccaccattctactctttgttttattattttttttattttttgaggtggagtcttgctctgttgccaggctggagtgcagtggtgcaatctcggctcactgcaacctccgcctcccgggttcaagcaattctcctgcctcagcctcccgagtagctgggactacaggcgcgcaccaccacacccagctaatttctgtatttttagtacagacggggtttcaccatgttagccaggatggtcttgatctcctgacatcttgatctgcccgcctcggcctcccaaagtgctgggattacaggcgtgagccaccgcgcccggccctctttgtttttatgggtttgattatcttagatatctcatataagtagaaacacgaagtaactgcccttctgtgactgatgtatttcacttagcataacatccttcaggattatttatgtcgtagcatatggcaggatttcatggctaaataatatattccactgaatgcatatatatttttcttattcattcatcgactgacagacatttaggtttttctattattaatttttttgaggaaccatcacactgctttccatagtggctgccctatttcacattcccaccaagagtttacaggttctcaatttctcgacatcattgccccacttgttatcttttgattttttaattacagctatcctaaaagcgtgagttaatatctccttgtggtcttgatttgcattgcttttatgattagtgatattaaggatcttttaatccattttttggccatttgtatgtcttctttgaagaaatgcctattcagctccactgtccaggttttttgtgtgtgtgtgtgtgtgttttttttttcttttgctattgagttgtaggagttcctaatatatttggacatgaatcgtttgtcaggagtatggtttggaaacattttcttccattatgtaggttgtctttcactctgttgattgtgtcctttctacatcaagcttttcagtttgatgtagtaccacttgtttaattttgcttcacctgcttgcacttttggctcatcagttagcaggtgatgaatgctgccaggactgcattctttccttcaagccagcaggttcccttctggcccagggtgcatctagaaatatcatctaggagctagtgcctggaaagggagtctcatgattctgactggtgccctatccggctatggctgagctggtttccaagatgcaaaacaaagtcctcccaactatttcctctcctcccctttagtggaaggaaggggtgtattttagaaccatgagctgtgcagcttggggttaggggagcagtgatgccagcacttccttagaaactgtagctgaaggccgtactcggtggtgtacgcctgccattccagcactttgggaggccgaggcaggcggatcacctgaggtcaggagttcacaaccagcctcacatggtgaaaccccatctctactaaatacaaaataattagctaggcgtggtgacacatgcctgtaatgcgagctacttgggaggctgagacaggagaatcgtttgtacctgggaggcggaggttgcagtgagccgaagtcgcgccattgcattccaccctgggcaacaagagtgaaactccgtctcaaaaaaaaaaaaaaagaaagaaagaaagaaagaaagaagctccagctgtttgctgggtgggtcacgtccactggttctgggcccagttcagcactaggtttcacggaaaagttgcagtccttgtggtctaaactaccattcaaatttacttagagccccagggcactttgtcccgcagtgatgaggcttgcaggaactcatgtttagaccactggtgtcagaggcgtttgaaccagagcaattctatcttgagtaggagctaggtaaaatgaggctgaaacctactgggctgcatttccagatgggtaggcattctaagtcacaggatgagctaggaggtcggcacaagacacaggtcataaaggcctcgctgataaaacaggttgcagttttaaagaagccaaccaaacccgccaataccaagatgtcgatagagtgacgtcttgtcgtcctcactgctacacttccgacagtgccatgacagtatacaaatgccatggcaacgtcaggaagttaccctatatggtgtaaaaggcgaggtatgaataagccaccccttgcttagcatatagtcatgaaataaccgtaaaaatgggcaaccagagccctccgggctgctctgtctatggagtagccattcttttattccttcactttcttcaacttgctttcactgtactctatggactcggcctgaattatttcttgcaccagatccaagaaccctctcttggagtctggatcgggacccctttctggtaacaaaagaatcagtgatttccctctggctgggctggtttaaatgctccctctgtgggcaggcatcagctgaatttggtctggttttatgttatgctattacagggcaggagctacagtgcttcacaattgctgcactatccctctctcctgcacacggaaatgctccccacaccacaccactgctgctgagggatgagggagaagtggcattggtgattccaggcactttttcttacctcttcagtgactctttcagcaatttgaaattaaaaccatgtattctgtgtaaaccccaagtatctgagacaagtctcagtcaatttagcaagtttatcttgtcaaagttaaggacgtgcgcccgtgacacagcctcaggaggtcctggcaacatgtgcccatgtgcccaaggtggtcggggcacagcttggtttttctgttgtgtgtttttttgagacggagttttgctctcgtcgcccaggctggagtgcagtggtgtgatcttggctcactgcaatctccacctcccgggttcgagcgattctcctgcctcagtctcctgactagctgggattacaggcacacgccaccaggcccagctaattattgtatatttagtggagacagggtttcaccatgttggtcaggctggtctcgaactcctgacctcgtgatccgcccacctcagccctcccacagtgctgggattacaggcgtgagccaccacgcacggctacagtttggttttatatatttttagggagacatgagacatcaactaatatatgtaagatgtccactggttttgcctggaaaggtaagacaactcgaagtggggacgcggcttccaggtcataggtatgtgagagacaaatggttgcattcttttgagtttctgataagcctttccaaagaaggaaatcagatatgcatttatctcagtgagcagagggatgactttgaatagaatgggaggtaggtttgccggaagcagtccacagcttgacttttccctttagtgtagtgatttgggggttccaagatttattttcctttcatagtgagtgcttacttgatttttggttcttctgaatgtgctttttttgtgtgtagataattgtttacctgatgtctttgtgaggtggatgactggtagaactgtctattctgccatcttgctccccaacttttcgttttccactaaaaaattctgctgtgatttcactgagatcatgacgaatgtataaattaaattagagagaacaggcatgtaaacaatattaagtaatccaattgatgaacatagcacatgtctctttttatttaggtcttctttaatttctctcaatgctgtcttacagtttttagcgtggaagttttagatacttattaaattcatttctaagcattttctgcttttgaatattatgaaagtggtattttaagtttattttgcaattttggttgctggtacataaacaatagtctttttacgtcaactttgtatgctgtaaatttgctagattaactttttaattttactagttgttttgtatattacatggaattttctgtgcaactgaccgtgtcgtctgctaataaagttttaactcttttcatactaaaatgtcgaccttttatttaatattcttgctttattgctctgtctaggactgcctgtaaaaccatttcctctttggaagtcttatgcaaactgtttacaatttcacaataagtatgatactagccataagtttttatagatgatttttattggaatgaggaaattactgtctataactagattatcaagaatgttgaattttgccaagtagttttactgcatctattcaaacaatcagatgttctttatttggattattttgttaagatggtgaaatacactggttggactttaattgttaaaacattttctttttattctcagaataaaactcagttggtcattgttcagaaaaatgttaatattgtaggcctagatattagaaaggcttgcttgcaagtttggccattggatggtgtccggtaacttggattttgggagacttctccccaaacgaactgataagagtggcttactgtgcttaaaccgtacaatgtggtttatactgaacacctactttactttcgggggactggaattttggtatgccctaggcagaaagtcaccacataatcaacctctaataaacactgagtctttaaagaaattgtctggtagaaaacatttcacacattttgttacagcttgttgctgcaagaagtaagtgcgtcctatgtgactctcccaggagaagacttggaaacttattcctggttccctccataccttttctccttgctgattttgctttatatcatttcattttattacatcttaggcatgaatacaacgtctatatcctgagtcagtcctgtaagtccttctagtgaatcaccaaggctggtttttggacttggggacacttagcacagtcatgataaattacccttttgtttacttgattttatgtacttgattttgttggctaatgttttaatgattttcgtgcctgcattcatgaggtatattgatctttagttttcttttctaataatatctttgatagattttgatatcagggatttgctagtctcatacaatgagttgaggaacatttctttctcctgtttttgaaagaatttatgtaaattaggtattatttctttaaatatgtcagaagtcactagtgaaaacattggagtctttttgtggaggggagttaaattacatatacataatataacatatataacctttaaaagttcaatttttaacagattttgggctgtttgtatatttgtatatctcaattcattcttatattagtttttgtaagttgtatttttcaagtaatttttttattgagtctgaattttcaaatttattggcataaagttgctctcatttttttttctttttcttgagacagagtttcactgtcgttgcccaggctacagtgcagtggcatgatctctgctcactgcaacctccacctccctgggtcaagtgattctcctgcctcagcctcccaagtagctgggaatacaggtgcgcgctaccacgcctggctacttttgtagttttagtagagacggggttttaccatgttggtcaggctggtctcagactcctgacctcaggtgatccgcccgccttggcctcccaaagtgctgggattacaggcgtgagccaccgtgcacgaccagcttgctctcatattccattagtattatttcactttcagtagggccggtagtgctgttatgggcgtgtctttgcgtccagagctaccaagatggcggcaagcctcttgctctctgacctggggttcttggcctcacggattccaaggaagggaaccttgggccacgcggtgatccgtacagttctgttagaagcccggggttatggaagagaagcgtggaaaccagcgaccagcgttcaggtagattaggaccaaccccggcacttagctgcacaggaacaatggcgagcccctttgggcgcctcactgatcagaagggcagaggacaccctgctggatctggaggagtggaagtcaatggcgggtctgcgagggcggcgttcagcggtggtggacggagggtgttgagcggtggtggacggacggccttcggcggtggtggacgacggccttcggcggtggtggacggacggccttcggcgttggtggacggacggccttcggcggtggtggacggacggccttcggcggtggtggacggacggccttcggcgttggtggacggacggctttcggcggtggtgaacggtgagcgaaagccggaacaaacatggacgagaagagtgtgcagttgcaaggtttaatagagtgaaaacagagttcccatacaaccggaggggacccaagggggttgcccactcctggcttgaatgcctggggtttatatcccaatcattgtccctcccccagtgctctcaggcgatagatgatttggtatttctttacctcctgtttttagcctaattggtactttagtgagctctctttactacctgattggtcgggtgtgagctgagttacaagcccggtgtttaaaggtgagtgcagtcaccttcgtcagctaggcttaggaactcttagtcggtctaggaaatccagctagtcctgtctcttagtgctgttcctctttgtttcgtgacattgggaatttgtatgttctcttattttgttttcagttttattgggagattaacaaatttattaatctcttgaaaaaacttcttccatccttttacatctaattgaaagaaaagagccacacattttatgtgtgggtttttattatttagtttaaaatattttgtaaattccagtatgatgctttttctaatatgtgagtaatatgagagcaatttgctaatttctaaaaatgtaaactcatcttttaatttctgacttctactttctttgtgtgtgtgtgtgtgtattgtgtgtgtgtgtaaatgaggcctaagatgtaaattctttaaatttatttagatttttttttttgagacagggtcttattcggttgccacagctggagtgcagtggtgtgatcacagctcactgtagcctccacctccaaggctcaagcaattctcctgcctcagccttgtgagtagctgggactacaggcacatgccaccatgcccagctaatctttaatttttgttcttttttttggcagagatgaggttttgccatggtacccaggttggtctcaactcctgagctcaagcaatccatctttcttggcctcccaaagtgttgggataacaggcgtgagccattgtgaccaagctgaaaattttttatgaggtgaaacagtcacattggcaaatttttataagtaaagagttgttggcacacagccacgctcattcgtgtgggtattatctgtggctgcttttgtactgtattggcagagttgaatatttgtaaaacagagaccttataacccacagagcctactacatatctgattttttttctttttttgcgactgagtttcgctctgtctcccaggctggagtgcagtggcgccatctcggctcactgcaacctccacctcccgggttcaagcgattctcctgcctcagcctctcgagtagctgggattacaggcatgtgccaccacacccggctaattttttgtgtttttagtagagtccggggtttcaccgtgttagccaggatggtcttgatctcctgatgtcgtgatctgtctgccttggccttccaaagtgctgggattacaggcgtgagccaccgcgcccagccacgtatctgattgtatacagaaaaaattcgcagacctctgacccagagcacagtcaatttttgtaaatgttcactgtgtgcgtgaaaaaaaaaaaaacacttttcttcttatgtctctctctattttctccttttcgtctctttttctacacacatgcacatacatgcatgaacacacacgttagatcaagcatattcatggcattgttcaaataatttttataatttgatattttaattgttgagttttgaaaagaaattcatgttaaaactaccttagtggtttctttttgtgttttcttcaagttttgtttcatgtgtttttgggtcatgctgttcagttttcacaaattcgagctaggtgggctgggtggattatcgtttctatcatgatgaagtatacttcgtcatatatttagtatttttttctttgaattcaacttattttcatattaatattgattgtcgatgtaccaacttaattatttgcctcatatatctttttctttttttttttttttgagacgaagtctcactctgtcgcccaggctggagtgcagtggcacgatctcttgcctcatatatctttttatgtcgttttaattatttcaacctttctggtgtttgttgcttttttttttttaaagtgaatttcttgtaagtagtaaatagctagatttttagattcaaatattactatctttcttgttaaataggcaaatataatcaacatttattttcattttgtatatttggaattatgtcatcttatattttctacttacaattccttctgtaccatatgggtttggacttgatcctctggggtaagaatattaggaatctccatttgtatgcaaaatgtgtccagtcaatccaaagtcatgtagatggaggtaaaagtttctggaatactattttcccctcggttcttccaacttactttgaaatgaataaccagtataagcacactttagaagcaactttaaagcctacttggtgtccccatttactaaataactctgtatttaataaaacttacttttgctaatggcaggaaatgggagaatcagactctcccagagatcacaggcttcatttcccttcacactttatagctggatcagcagttactgctgtatctgagttgtctaaggctaataacgctggagctgagaaaaaaatacctcacttactgttttacagcagtcactgtctgataatcacagaatgatctctgtgtcagttatgtgtcttccaggtaagaccaaagtgccagctcaaataatggggcaatgcagtgtcttaatacagatatttctataaaatgctcggaacaccggtcttaaaattgcaacagattttctttcatgccaattcctagttaaactaggtactctataacatgtatttatttaaaaggtataactgaattccattgatgttaatagcaaatgtaatatttgaatgtctccattaagaaaaatactgttgagcaaatggctcatgaagatgtgtaccaaaatattcatactttctacagaggctccatcttttagagttcaattaaagttcctctacccatgaagctcaggtgccagaaagggtttcagctggaaatctcttcatagaattaagggattgataagaagagaatattttttcattccttttttatcagtagtccatgttaacaattaaagttgaacgaggatttttccttaagttaatttttttttaaatgcagaggtttaaaaactttaaaagaaaggagctttccccttagagtcctcacactagttgactgtgaattttaaaagaatacctaccacagggtacaagaaactcactggtatgtatctgaggcctgtgtttttccaatctagaagctacaaggatatttgctgggaaagtccttataagaaaaagacttagccaggcacggtggctcacgctgtaatcccggcactttgggaggctgaggtgggtgcatcacgaggtcaggggatggagaccatcctggccaacatggtgaaacccgtctctactaaaaatacaaaaattagctgggcatggtggtgcgcgcctgtagtgccagctactcgggaggctgaggcaggagaatcgcttgaacccgggaggtggaggttgcagtgagccgagatcacaccaccgcagtccagcctggcgacagagtgagactctgtctcaaaaaagagagaaaacttaaccaagttatgtaataaccacgattacttacgccagttaactctatgcagatcaaatttggcctattggtgatggcaatctacttcataaatttacttccaggtcagtgagggcctatagaagtgtgattcacatggctgaaatgagagaggaatctgaagattgtttaagagaaagacaccttggataatacatacccatcaaccaagggataccttacctcacctgagattccctgttaaaaattacttacttgatttcattcatttatttgtttcaacaaatatttattgagtgccagctatgtgccaaatactgttctagacacggaggatacagcagcaaagaaaacagatagaaatccttactctcatagaacttaccttttaatagaaggatataggcaataaatgagaaacagaaaaattaaaaaaaaaaaagcacgaggagagattgtgcagcggttgggcagagtttaagtttagatagggtggccaaggaaacttcactaggaaaacgacatttgagtaaaggcctgaaggaagtgaggaagtgaactgtgcagatatctaaacgatagcattttaggcatacggaaggaacagcgattgcaacaaccgtgaagcacaagcaagcctgatgtttttaaggaatagctaggaggctagtatggctggatcataatgagtgagcaggagagtaggatgaaatgaaatgagaaatatatagaggaagatcatgtagaaccttatagactattgtaaggactggaacttctacggtgagtgagatgaaaatccactggagagtttgatgcaggagaggcaaaatggaaggagggggaggggaaaagttaggatactattggcagtgttctagatgaaagctgaggtctttgggatcaaaatggcagcagtggaggttgtggaaatgtggaggttgtggaaatgtcagatttgttgatgaaccacatgtgggttttgtgaggtggtagggagtaaatggtgactctaattgtgtgtgtgtgtgtgtgtgtgtgtatatgtctatatatatatgtgtgttgtatatacatacatatgtatgtgtgtgtatatatatatatgtgtatatatagagagagagacggagtttcgctcttgttgcccaagctggagtgcagtggtgcaatctcggctcactgcaacctctgccttccgggttcaagcgattcttctgcctcagcctcccgagtacctgggattacaggcgcacaccaccacgcccggctaatttttttgtatttttaatagaaacggggattcaccatgttagccaggctggtctcgaactcctgacctcaggtaatccacctgcctcggcctcccaaagtgctgggaatacaggtgtggcctccccggccatgtggaactgttaagttcaatgaaacctctttttcttcccagtctcgggtatgtctatcagcagtgtgaaaacgagctaatgcaacacatcataggtttttgtgagaattgaattaatatattttttaaagtgcttatgataaagtctggcaaataagaagaacctagcttaactataagaaattagcacacgctgggcagtttataaacaatagacttttatttcacatttctggaagctgaaggtccaagatcaaggtgctggcatggtcaggttctggtgagggccctctttcctgttgcagactgtcaacttctcactgaatatgcaaatggcagagagcagagagagaaaaagcaactgttttgcatctttatgtaaaggcataaatctcattgatgagtgtgtcttcatgacctaattacatctgaaaagtctcttttaataccatcacatcaggggttaggatctcaacatattaattttgagagaacaggaagactcagtcattaatggcaccacacaagcatcggttgttactattgttattattactattagatattttagttgagatgttaactaggccttttaaaaatttgtacatatttagggggtactaatgtggtattgttatcttactatattgtatagtggtgaggtctgggcttttaatgtaaccatcaccctaatagtgtacattgtacccattacgtagtttctcatctccctcaaagcctcctacatttccaagtttccaatatctattattccaccctccatatctatgtgtacacattatttagctcccacttataagtgagaacatgcaatattttatttgtttctgagttatttcacttaagataataaattttcagtttcattcatgttgctgcaagagacatgatttcattttcttttctttctttctttcaagagtttcgctcttgttgcccaggctgcagtgcagtggtgcgatctcggctcactgcaacctctgtctcccgtgttcaagcgatttatcttgcctcagcctcccgagtagctgggattacaggcacctgccaccacacccagctaatgttttgtatttttagtagagacgggtttcactatgttggccaggctggtctcgaactcctaacctcaggtgattcacctgcctcagcctccccaagtgctgggattacaggcgtgagccaccacacctggccatctcattcttttttatagctgagtagtgctccgtatacacacacacacacacacacacacacacacacacacacacacacacacatatatacacacatagatatatatacatataacgcacatatatatctctctcacatttgctttatccaatcatccattgatgggcactcgctgattccatgactttgctgttgcaaatagggctgcgataaacattcgagtgcaggaatctttttgatatcactgtttcttttcctttgggtaggtaccaagtagtgggattgctagattgaatggtagttctattattagttctttgagaaatatccatactgtttcccaaagaagctgtacaaatttgcattctcgccaacagagtacgtgttccattttctatacatccacaccaaggtctgttgttttttgactttttagtaatagccattcagactgttgtgagatggcaactcattgttattttaatttgcatttctctgatgattagtggtggtgagccttttttcatgtttgttggccatttgtatgtcttcttctgaaaaatatctgttcatgtctattgaccactttttttttttttttttttttttttaagatggagtctccctctgttgcccaggctggaaggctggagtgcagtggcacaatctcggctcactgcaacctccgccttccgggttcaagcgattctcctgctttagcttctcgagtagctgggattataggagtgtgctaccatgcccagctaattttttgtatttttagtagagacggggtttcaccgtgttagccaggatggtctcgatctcctgacctcatgatcacctgcctcggcctcccaaagtgctgagattacaggcgtgagccaccgcgcccagccaagaatatataagaatatttatatataagaatattgttatatatagaatataaaggtatacatataaagttcagagaagggatctagtttggaaacataatattttggagacagcagcatgtagatggtattttggccaggatacaaagagactatcaaatatatgaatgtagagagactctttaagggccagaaacgctctgccatttagaagcctcggaaataacaaggaaccttgaaagggaaccaagaagcagtggaaagagtgttgggaagaaatccaagtgtgtggtattctggaagctacatgaagaaagcctatcagagaagggaatatgaccaacttgttgaaatgccgttgctaactttaataacgtgaggcctcagaatagaaagagtaggttttaattcattttatttcaattcaatttatttacttgtgactttgacaagagcagttttattggaatggtgggagctcaagctttatttgggtttaaaatgaattagaaacagaatatagacaatactttctaagacttttgtttttcagagaaggacagaaatgggggtgaagctgaacaaagaagtgggatcaagtcaagtttttcttaagatgatagaaataatagcatagttgtatctgatgatattgacctagaagagtgggaaaagagcaatgctagatagaggggagaattgctggagtgatgcgattaagacatgtttctcgacattactggagagaagacattgcttttggctgtccctgaagactttagctatgtaacaggaaaaatggagtactgacattgaacttggaaagacaaattaccagtaacgttgcaaacaaatcagggaaaggggttattttggagcttgcctctctccccactagtgatgagccttataaactactagtaatgtttatggtctgaagaggggatatgttgacaaaggcacatatcatcaattcctgcaaactcaacaaccaaatttcttatggatctctatgcttttttccatctgcaccgacagtgtcttagtccaagttgccatcgtttctcatcagaattcctgtaagacgctcctaagtggtgattctactttgatggttgcatcttggaatctcttcaccacataacagcaaaagaaattatttttaaaaagaagtcatataatatcaacattctgttctgtattagtctgttttgtgttgctaaaaaggaatacccgagactgggtaattggtaaataaaagaggtttatttggctcccaattctgcagactgtacaagcatcacagcagcaccctcagcttctgatgaggcatcaggaaacttgtattcatggcagaaggtgaagtggaaataggcatgccacgtggtgagagagggagcaagagagagagaggagaaggttctgggctctttttaagcagctagctctcacgtgaattgatagaatgagaaccatgggtagggtaccaagccattcatgagggatccactcttatgacccaaacacctcccaccaggccccatgtccaacactgggggtcacatttcaatgtgaaatttggaggggacaaacatccaaactatatcgtactcccaccagtgtctttgtgaaagaaggctttatccaaaacttggaaaaatcacaaaataggaatgacctgatatgttaatatcatgttataatatgtcctaagaagcctgattgattctcatctgacattcctctgacacacattctcatctgatggcagccttgtcaaaatttggctaataagcatccacagctattaacagtgaagtcagtttggaaccctgtgaagttagaggttaaccaagaaattgataaggtgttagaattgtgtagtctgctgggaaagttaatacccaaactgctatggttttcttttcctgtagaaaagcatacaaccatatatctaacttagaagtcttacataggcatttttttttcgccttgactatataaattcttgcttgtcaaatactcttggaactctcttttctttcttccctattggttcccttattaataaattaaaatgttcacatctatttatattaaaacattgtcacattacccatactattttaaatgaacttcaaagttctttttattgccgcaaggccctgtgtgatcacacaactgcttaacgctctgggctcatcccccaccagtcttctaagctgtgctggctttcttgctgtcctaaaacacagcaggtcatgtttcatcttaaagccctttcagcttgctctaccaactgcttggaaatctttcctcccagatttcagtttggatccatccctcccatctgtcagatctctgctcaaatgtaagctcttcatagatgcttccctgaccaccccatccaaaatgtcaaaaacacatccactttataaaccccttaacctgcgtcgctttttcaaacgtttcactgtctacccaccatcgattctaccattaacatttttttttttttgagatggagtttcgctcctgttgcccaggctggagcgcagtggtgcgatatcggctcactgcaacctgcggctcccgggttcaagtgattctcctgcctcagcctccggagtagctgggatcacaggcatgcgccaccatgcccggctaattttgtattttaagtagagatggggtttctccatgtcgttcaggctggtctcgacttcctgacctcaggtgttccacccgcctcggcctcccaaagtgctgggattacaagcgtcagccattgcacctggtctactatgaacatttttaacattgcgtaacattttataaatacacctggggttgtgctcattgttttcatgtttccacaactgcaagttaaaacccagcagcgttgtggctttgcctgttttgagcactgctctatcctcagtgtttgtaacaactcttgggatgcagcagatgtggtagattaaattgtcataattattcagtcacttgtagtactggtattatacatacatttccctgccatggccttatgatagttggatgatgtaatggttaattttatatgtcaagttgattgggtcacctggtaccgagatctcaaattaaacattacttctgggtatgtctttgaaagtgtttctagaggagattatcatgatctgagaagagagttgaaatgtacctttgaagtacctttaatgctgggcttgtctcgtctactgccattgctgtgagagaaaaaaaaaaaagatgccctgtctagttgcgactgcttcaacctatataccggaatgagacacatagtgaagcacacctatattcagttttcagcctgaatttattctgccctcattgactttgaagacccatggatgagaaaaatgagtatttttgtctacctctgagatattatacttatgtgttatgtagccttactgtaccaatagctactttaggctctaagtgttcaataggttatcattaaatgaatgaaatgaattgtaaatatttggcacatgttgcttcgtacgattaaaaagcattttgttaaactactaggcattttacgctgggaatcatcatgttcctatgtagaatgtattagtagaggaaattttggatgttggagtatggtagctcttcttcctgtcttcataaatgtcgtctaatagctaaacagaagctgaatgtagcactttgaaagctctagcaaggaacgtgatattgtcagattccaagcccgtggtttgacaagatctctggctggagttcctagccagtagaatggattaaaagtaaataggctgttaatttatgtgtgctttactgcccaagaaacaaaaatcctagccaacaaccttgatccctttgtctgtatgcttataccaatacaaagcagactactaaagcagtgaagcctcttatgaggaataatctggaaaatgattatcctgcctctgactttggggaaatgctgatgagggatactcccagaacagaaccaggggaagccagcttgggtgatcaggaaactcaattcacttctaggacagaacatcctctctattgctgtctaacagattatattgtattgtaaagcattatcactttattttccctcctgtcatttcccaaaaataataacttttttttttattgagacagagtctcactcttgtcaccaggctggagtgcattggcgcgatcttggctcactgcatcctctgcctcccgggttcaagcgattctcctgcctcagcctcccgagtagctggaattatcggtgggtgccgtcatgcacagctaatttttgtgtttctagtagagacggggtttcaccatgttggccaggatggtctaaaataatcacttttattaatgttgccttgtttttcctgcatcatggatacataaatgtgtttggggttagtataatactatttagtcttggatcactgatgcatcacttagagattatggacttgagttgagtgcattacccagaagaaactttagggagcctctctttagggacacttgaaggaatttcatgtaggtgtggacacttttaaagatgtatgtattagaaggacgcagaacatggttgttgtttgcctacagattatccatttcccccttctttcttcttaagagaaccgtaattttcttaaggcatttgccttccttcatgaagctcatgtaattgaaaaaaaggtgcccttatcttcagcttcagaataaatgataaactaatcaatcataataatgcctttcctcttgccagcaattatttcaggaagccaagcttaagctaatcagtatgtggcaatgtctagggatgaagatgtgatgtaatttggctcagcgagaaagaaggtataaatagggtgatagaatttctctggtagaaaatgaacaaagacgtgcatagctttgatggctcttgcaggtatcatataaccatgaggggtactagcattattaatacgaagctgaaaatgtggacaggagggctaagaaattacatgaactaattacatcattaaagagttgatccagtccacccagaagccttcacttcactcgaaataccttttgtgtgtgataacatacgcctcattgcttgagttgtggattttggttacttgcagctgtaagcattctgactgatacaagtcattcttggtgtgtgattttgaattggtgacttaaattctccaaggttcaattttctcaacttttttttctgaaaatactatatcaatcacttttgtcttcatagtatctaaataacattgggggtaatccagagagaaatgtgagtcagggccttaccttttacttggaaactgaatgaggggcagatattcttaacttcaagttgttggcatagacccaggggacgagcatagccatgtggacgcttctgccaggagctctgacactttaggaggtatactaagatgtagagaaagtcaacacttatttgcagtgtttgtggcagaggctagagtccagtagtgtgacagtattgagaagtgacagtgcttccagtgggaccctaagaaaactgcttctctggggtgattctgggtgagctcttcctcccttgactattgccatatattcttcacctgactctctgctcttctcatggactctaagaacaatgtgttatctctctaacgaattgtttttctgcttatattaccagactcggtgtctgttgttcgcaaatgaaagcaccaactagaatagttatttgcctaataaggttgatttgaggactagatgagataacatttaagtagatgctgaataaaattaaatttaagattcacaaggttttgcttgagtaacaaatgtatcctacattttggatacatgtaattataaatatctacttttcactcatgctacaagtctactgtggattggctatttctcggtgctatgtcatttttttgagacgaagtctcgttctgtcgcccaggctggagtgcagtagtgcgatctagggtcactacaacctctgcctcccaagtagctgaggttaaagtagctgtagttaaagtgattctcctgcctcagcctcccaagtagctgggattacagacgcccaccaccatgcctggctaatttctgtatttttaatacagacagggtttcaccaagttggtcaggctggttttgaactcctgacctcaggtgatccgcccgcctcagccacccaaagtgctgggattacaggcgtgaaccaccgcgcccagctgctatgctatgtcatctttacttcagaaaacaagctgagggagtatcttctttctggaatactgtcagtcttcatggcagagagaaaggagacaaagtgaaccactctcttaaaccttctgcccggaaaagacacatatcacttccacatttcactagcccaagtgagtcccgtgggctctcctgatttcatttggagtgggatgtatccttctacagggaagaagactaaaggagcaacactggaacatttagtgaatagttacagaggctaccgcagtatatttacctgttcctgacgtctttacatagggacttggccagttataaattccttggcggagtcatgttagttcctatcaggtgctctacgtggagcagtacttagattttagcttcattttttggcctctaaggattttcctcattttttggatggatgatacatttgaaaagttttaaaaataggttatacatggtttttagttgctttgcagtgaagggaagtttagtttgtcttgatgccattaacagaatttgacatttacaacgcacaaacacatacaaatacataccacctgatatgttgctggaggttgggatctcaaaaacagacattgaggttgagtgtatggggtgtcaaatatttattaaggatcaacagctgtgagagggaggaggctgaagcaggattgggcagagaaagaggtggaacttctatgcaggcgcaacaaagcctcattcagccttactggcagctcttgagaaagcgttgtgcatcagtgataccgggcattggcctggaatggtgtaggctttatggctataaagccacctgttcagatgccagatgtaggcttctgtgggtgttaccttgagccaggtgactctgcggctgaggcagaccctgcaggagttgacagctagaggctgtgtgctgaaccacacttcctgcagatgggcagcaagtccttccttgaagtgggagctgggcagtatattttgtgtctgccacactcctagcatttgataaatattatatttgattttacccagattatttgaaacaagtagggtttggatgaagctttgatttttggtttaaagagattttccctgtaacggtggctatcgcaacagcatctggcctactgaaggctgaatctaatctatctagccagtgataatggcttagcattacacggtttctttgtcgctggccaggtcatgaggaattacacacaaagaacgaggcgcaagacttatcaacccgtaaaattacgtagcagagcaagatatctaactgtagtctgatgtgatttcatagagtccgtgaaacagcatcaaggacttggcttcaaagggttattttatagtactctgtggtacttgacttttaccaatagctaaagtccatgaccgtatgtgttccaatatttgccagagacatgttggtgcctttaaagctgtatcagtaaatgattacactagaaaaatttacattcctaataaaattaatgtttggcaatcaagaaatgttttacttaactattagaaatcatctaataatgcagtaactatcattatagtaacatttaactcttgtaataaatgcattacagtcagttacacaattaaagaaataatgtggtagtatgaatcctaagataaagaaatagagaactatattacccaaattagattatgtgtgaaacaatggtggattaaagagttcatttatgggaatgagctaaaagaaaaatcacatgcaaaagggataaaaatatacattttagctttcatggtaaaaaaaaaaaaactaaagtagatgatcatttattagttcatggaatagtcataggggtgctgtaactcgtgttgaattcactaaatgataatgtgactgagatgcagtgttagaaattctgatttaatttttaaaataattatttgagcattaattaacttggaagcattcatcttttgttctccaaaacattttaaatgaaaaaaatgttaattgtgttgctgtgacagtgatagtataggattaaccattatagtattcacctagatacaacgaggaattttaatgctatttaaatgaactggccgtatttttgtggatttcagttttagatttgctttgcagaaataataaataaacctagtgtattttgatagcattatggaaagcggtaagtagttgcagcctttagatacttctgaaaaccagtagaatgcattcctttacttgcaagtgagacctttgtataaattaacctataaaaccaaaatgtgaaatgatgatgtgcatgagtacatctggatgtgtaggaggacctttaattgcatggtgactgagaaaccctttcacatattggagagattacaaatggcaggagattataggaattctttaaaggaattcagtttctgtggagcaggaggcattcctatgggtaagcctgggtgtgctttatcattgccgggacgtttcagtgtggtcattgggtcagattggcaaagaaggtttctttatggggacaaatttgttcttaagttagatctgtgaatctctgtataaaacctggatggctttatatcaacacagattccttcatagagctgctgtgtctgtagggtgacaattgccccatttaagcaatcatcagagatcatttattccaactgtctcacgtcatacatgaagaaaatagaacctgctcagtgaataaactttgaaatagcggtgtattttagaagactgctctgtagaaacataaataaatagataatgtatgtataaagatataaatgcatagttgtattcagatgcaggatttggagataaatctgacttgtccaactcacagtgagatgtttagcagatccaggtcactgttttttcccattgtaggaactatgttgtatttcccaggaaaacaatgtaatcatggaaataatattttctttatttaaattcagagatttaatcctaaggattttaaatgagctgtcctaaattattgttaattatttgtatgtttaaaattagggttttaattttatgtatgtaaacatttatatgaattacattcctagatataaattcaatgtatcttagttttagagtccaaaattagaagttatctattacggtagcattagaaacagaaattgaatccgttcttcccctcgcccacgggctttatgattcccatcaaactcagtgggaattttccagcgtattgttgaaaaaagtgggctaattaagaactaccatatgaactattacacattaattttatggcattcattgttgtttaatttgtgaaataacatcaatttttctgattaccaaagtaatacatattaattgctctcaatgtagcaaatacataagactaaaaagaagtgaactaattataatctcagttctggagaactgtgaacaagctggtatacattttctagttattttttctatgtatgtgtccaaaggatagctctaatttaatggtgtctcattctgtaatgctatttagtgattgctttttggatatatcataataaacttttgctataagaattcaagatttgtctaacattactcttaatggatttatcatttttggtgtaattatgccttaggtgctggacaaagatcagaccagatgtgaggaatgctgaaaatgaaaggtatggatacctatgacttctcctcctaagttttgtcaagctaaaaaaggtaagagaacagatacgcacaggacatatctgaggtagggtagcttctgaatgtcccttttctgtccattggcaggaatttgttagatccgtggtgtcctgagcaaaagagtttgtaggcttttattttgacctctgcttaaagggtcacataagtgctccaaagcatcatatactagcccaaaagtgaatacttttgcgactcaagaagtaccgttcattactaaggcttagcgttacaattccgggtcctaaaatagttgttctttcacatttattcgcaagcatagcattttcattcatctgggtctgtgcatcaggttatacaatggccctttgtctgtgcctatatgggaactagcaattttttattcatgtccaagaaagggcattcctggctgttagaactgcatgtgagtgcaccagtgatttatctaatcactgctctgttgtgtgaccgtgggttactaccaatctatttctaatataaacaatgttgcaatgaacgttatgtgaaaatatatttatgtgcaagtctgattagttccctaaggtaagtgcctgaaagagaagttgctggtttaaaggatttgtgtaattttaaggcatttgatacatactgtgaaacagcctagtatagttaatgagaatattccttgtgtgcttgaaaatgagaccgggcacggtggctcaagcctgtaatcccagagctttgagaggctgagatgggtggatgacctgaggtcaggagttcaagaccatccagcctgatcaacatggtgaaaaccccatgtctactaaaaatagaaaaattagccggccgtggtggcgcgtgtctgtaattccagctacttgggaggctgaggcaggagaatcggttcaacctgggaggcggaggtttcagtgagccgagatctcaccattgcatttcagcctgggcaacaggagcgaaactccgtcttaaaaataaaaaaataaaatgaagtatgtatttcgtttgccgaatataaattttaaatgtaaacaaatctacagttgattacactcgtttaagttttatctgcttgaactaccagtgtctgagagggttgcattaaaatctcccaagtacatttatcagcttaattatttggctgcatagttcagccacatgctttatttgaaagctatattattgagtgcatacatgctcatagtcattgtgtatttccctcgatccctcttgaccatttactggtacataatgaccttttcttgaaatgaaaagtttttacgtctgctttttttttctggttcacatttgctcagtttacattttcctgtatttttatttttgaatcactgtatctttttgctctaaatgcagttgctctagataatatcttggcatatatgtgtttcttaaaataatccaatcattgaatctctttttatgattctaaaacagatgttgtaagcttcctctgtacaaggccagatagtgaaatattttcagcattgtgggccatatggtatgttttccaactactcaactctgccattataggataaaaacatttatagacaatatgtaaacaggtggggtccctatgacattttatattctgttgggccctcaggtcacagtttgtggaaactggttctagagtttaatctatttacatttattatagttagtgtcatattgggacttacatctgtcatcatagtctatgttttctatttatccttctattttcgtttatttttttccttctttcccatctttcacctggtttggaatttggattttgctcctattgttatcctcccttcaactttcctgcgataatatttttagttccaggttgtgattagatttcttttgtagtgtatcttttctctttcatgtatactacacattcacagtcacaatggcatattgcatttagatttacttatctatatttcagtatttattgtcacctctgtttctttcctttcatcattgtttcctctcttaaggctttggcagagtttattagatgtttgatcggtgtccattagtcttttcttgaaaatattactcaaagagatctatgggcactatgtatatcttgcctggatttgggggtcacactttgtttttttcacagtggtttgccccttagcctccaacttctagtttttggtattacagatgacaagtccagtattaatttaattttttaaaaagttacttccctctccagatgctatactcattttctatttttttttaagatcagtatatacctagctgtatattccttaatgagtcccttctggaaacccccatgttattttcaataggtacactctgttcaattatttccttaatgattacttcttcatctgttgatttttctctttctggaacccctattaatttcagggtctatgctcaaagttcctcagcttttctagccagatttacatatcttactttagttttattttatttttaatggacatataattgtacatatttgtgaagtacaatgtaatgtttcaatacatgtatacattgtttagaaatcaaatcgggggccgagcccggtggctcactcctgtaatcccagcattttgggaggccaaggcaggcagatcaggaggtcaagagattgagaccatcctggccaacatggtgaaaccccgtctctactgaaaatacaaaaatcagctgggcgtggtggcacgcgcctgtagtcccagttactcgagaggctgaggcaggagaatcacttgaacccgggacgcagaggttacagtcagccaagattgcaccactgcactccagcctggtgacagagcgagagactgtctcaaaaaaaaaaagaaaagacaaaaggaaataaaagaagtaaaatcagggtaattagcatatccgtaatcttaaccattttttttgtgataagaatattcaaaatcctcttttctagctattttgaaatatacaacacgttattgctaactgtattcaccatggtgcactataaagtaccagaacgtttttctcctggctaactgtgacatactcattgaccaacctcaccctatctctcctccccagtaccctcctcagcaactggtaactgctctctacttttatgagatcagcgtttttaagattccacatataagtgaggttatgcagtatttgtccatctgtgtctggcttatttcacttaaaataatgtcctctaggttcatccgtgttgttgcaaaagacaggtttttgttatttgttatggttgaatagtattccattgtgtacatgcaccacattttctttatgcattcattcactgatgaacacttaggttgattctatatcttggctactgtaaatggtactgcaataaacatgagaatgcaggtatgtcttggacataatgattctatctcctttggatatatacccagtactgggattgctggatcatacagtagttccatttgtaacattttggagaacctttatactattggccgtaatggctgtactaatttacacgctcatcagcagcatataaaaggtcgcctttcaccacatagacaccaacatttgtggggttttttggtctttttcataatagccattctaaaaggtgtgagatgatcttattgtgattctgatttgcatttccctaataattagtgtaacgttcagcattttttcatatacctgttggtcatttgtatgttttcttgtgagaaatgtctattcagatattttgcccatttttaaatcaaagtatttatttttttgttactgaattctttgaattccttataaattccagatatacattatatcccttatcagaacattgcttgcaagtatttctcccattctgtaggttgtagctttgctctgttgattgtttcttttcctgtgcagaagcttttgagtttgacttaatcccgttagtctgtttttgccgttgttgcctgtgcttttgagttcttatccaaaaaatccttgcctagaccaatgtcctgaagcgttttcactgttttcttctagtagttccacagtttcaggtcttgcatttaagcctttaatccattttgagttgatctttgtatatgatgagatgtagggacctagtcttatttttttgcatgtggaggtgaagttttcccatcatcatttatcttttgagatttttcttctacttgatcttccaaggatgtaatttgtgtttgggaagtattatcccgtctcatttcatcgtttaaatgttttaattcacaactgatatttttatttttcagaatcttttaatgccgtaattgaatttctttgttttttttttggggggggaacagagtcttgctctgctgcgcaggctggagtgcagtggtgtgatctcggctcactgcaacctctgcctcccgggttcaagcaattctcctgcctcagcctcccgagtaggtgggattacaggcacacgctaccatgccgggctaatttttgcatttcgttagtagagacgaggtttcaccatgttggccaggctggtctcgaactcctgaccttgtgatccgcccacctcggcctcccaaggtgttgggattacaggcgtgagccactgtgcctggctgaatttctttaagtgtttttttattaacgtatttttattgtcatccatctctgccagcagcttcatttcactagtaacttgttctcttgctttttcattctttacttgacaatgggtcgtcttaaaggaattcttactttcctttgcttagtcatggatatatttattatcagagctcagatcaagctatacggtaccttaagcactggtaatcgtgattgtgtcatgtggcatggtagtctttatccctgtgcaggtcactagtcctctgtggcgatactcgtataatgtatttctgccctctggtctcagttgcaaaaatttccactctgtcccattaggcgtatagaaggctcaaagcatcttataaacttccgtagcacagtgggagctagggacaccacttcccatcctgcaggaggactcacagatattctctggctaaactctttctagcagcttctcacccctgactggcagatcatgaagctctagtctcagcagatagctacacagtcatcctctaattttgtgaggaccccagcacacacggggcttagtttttatagtcttggagtttcatagatctttctgcctcagcggcaatctcgtaaatagagtagacttgtagttggattagaattgggaggtgagggttgcacagatatatgttaaaggcggcatcttcccacagcctttttcctgattccatcaacaattcctcacataacccctccaatttgtaaatgcctccaggtcatagtagtaagtatttgtagaatttgtgattgacagttttctgcccccaaacaactgcagacactcatatttggaaacttgaagataacactatttgaaagtaaacttctggggccaggcgtggtggctcatgcctgttattccagcactttgggcagccgaggcgggcggatcacctgaggtcaggagttcgagaccagcctggccaacatggtgaaacaacatagtagaaattttaatctctactaaaaatacaaaaattagttgggcatggtggcgggtgcctgtaatcccagctactcgggaggctgaggcaggaatcgcttgaacccgggaagcggaggttgtgctgagccgagattgtgccactgcactgcagcctgggatgcagatcgagactccatctaaaaataaataaattaaataaacttctgagaaaataaatttcctgacattgccttaaaacccatatgatttcagttatcataaactaaattacatataaactttaattgtttatcttcttaataattagagcaggagagttttaaattgcaggcaaaatagaggtaaagtaatattttttttacccccagagagctggaaatgaaataaaatattttacaactcttcaggaaaagaaaagtgatactttgtcaagtgtcaatgcaggaagcaacataaatgaaaacaaaaaataatgaaatatccagtgttcataccagtattagtctattctcatctttttaataaagacagacctgagacttggtaatttataaaggaaagaggttgaatggactcacagctccacatggctggggaggcctcacaatcatggtggaagatgaaggaagagcaaagggacatcttacatggtggcaggcgaagagcatatgagaatcaagcaaaagggaagaccccttataaaaccgtcagatctctatgagaacagtatgggggaaacagcccccgtgattcaattatctcccactggctccctcccacaacacgtagaaatgatggaagctggctgggtgcggtggctcaccccagcactttgggaggccaaggcgggcggatcacctgaggtcaggagttcgagaccagcctggccaacgtggcaaaattccgtctctactaaaaatacgaaagttagccaggtgtggtggcacgtgcctgtaatcccagctactcagtaggcggaggcaggagaatcgcttgaacctgggagacggatgttgcagtgagctgagattgtgccactgcactccagcctgggtgacagagcgagactccatctcaaagaaaaaaaagaaaaaaaaagtatgggagctacaattcaagatgagatttgggtggagacacagccaaaccataaaaatagctcattttccccaaagcatttattctttagagtgatagaaaaatggacccctaagaggacggtgtttaacaattttgcagaaagtaccttctggtagctactataatgttaggctgctttttcctgggatccaaaatttactgtagcatttcattgacttagagctagtgtgaccatagattttggattttctagaaagttttaatttggaggattctgtaatattgtccagccatattttgtagcactaggttcagaaatatgacctgtatgttgcctttgaattttgtggcagagtttcttgaaggttatagaggatgaacatctattaactaggtgatgaataggtaatggatttcgaacctctagcctgtttagcaattccttccatgtaaaatgatcttccttttatgaaaatctagtcttgacagtgatatagaaaaaaacccgtaatttaaatggacagatgattccctgatgtgttaccagagaagtggctccattcgtgttgttctctgttctgacttaccactgagaagataatgtttaatctcaattctaaagacttggaataagtgagaccacaaatcactaaaaatttccggggtttcatataacattttactttaatgttcttcttgcttcttttcatttaagctttccagtgacctagcatgttcaggcatgacatagaataactaaagaaagaagtacacttaattgaagttcctaagaatctatctgaaaaggaattttccacctgttgtaatttactgtgttaaatataatatgttttataaatataacatgttttggttgcattttaattgcttgttcagaaatacaccagggactaacgtaatagatgatatgaagctgtgtcgtctactatagtagcaactggccgcaaacgattgcacatttgtcacgtggccagttgcaataggaatgtgctgcaaatgtaacatgcatgctggattttgaagacttagtacaaataagataatggataatatgacgttaatacattgtatatcaaatacataggaaatgacaatatgttagatatattgggttaaatcaaacatgaattaaaataatctcaactattttatgtttttattatggctattaggaaactctaaatgaaataactagcttatgttatatttctatgaatcagcacttggatagagaaaatagatttttaaatgatttaaaggaccagttgataagaagctttttgctgttattatctctgttagagaggatttcaagaaagacttgggctactccagaaaagctagtcagctgctggtcctccgtcagaaaaatgccagtgtcagtgtgctgtaggcaggccccaggtcacatttgactatttgtgacttattgtgtttgactcatatttagtgctccataaatgtttatcgaattagtaatgacttaccgttgtaattcattggcttgagattcagaaataacgagttttatttccaactccgccccaactagctctgcgatcttgcacaaaacacatcctctttccttatgtcattttttttttttgggggggcgggggtggacagaatcttgctctctcgcccaggctggagtgcaatggtgtggtctcggctcaccgcaacctccgcctcccgggttcaagcaattctccctgcctcagcctccccagtaggtgagattacaggcggccaccaccacacctggctaatttttgtatttttagtagagatggggttttgccatgttggccaggctgatctcgaactcctgacctcaggtgatctgcccgcctcggcctcccaaagtgctgggattacaggcgtgggccaccgcactgcgctcggcctccttacctcatttttttttccatcataaaatgagaaggtttaatgtgatgactgaataattttcagctcagacatactgtggtactgttatgcgactctgtgttgctggtctactaggcagttagaatgtccatttctaaagtggcaaataagctgctgctttagtcaggattttattttgcatgtgtctaccctctgatgctgattattctttttcttgaatatgctaacgtaggtttctggaacctgcaaagaaccactcttctgtcatccttatctaataaataaaatattctcatctctcagttttctctctcccctgtctacaaaattaaactctttgattatcacccttcttggaattttaactttgattttgcattagaatatacccagcttctcacatgaagagtctcggttcagatgagaagatgagggctttgaggcatagtgatggcttactgtgatgccttaccttattttaacctgattgtctctcttagctgagagagctggacagactccatttttgtttcttcactcgcagtcccccttatccccctccctcaaggacataactagtgcaagctgactccaagcacgtccaggaatgcacttactgataagagatagaggcaaactgaaccagcagctcctggggatgcgctcggtgggtggtacccgaagcccctgcattatctctctgtgatagtttaagcccctgcacctggaactgtttatttttctgtaactgtttctgtaaccattaatctttttaactttttgcctgttctgcttctgtaaaaatcgcttcggctaaactccccctcccctatttagaccaaggtatcaaaagaaatctagctccttcttcggggccgagagaattttgagctctagctgtgtctcagtcgccggcaataaaggactcgtgaattaatcttgtagtgtggcatttctctataactcgctcggttacaatatgaccaggtgacatggagaacctgtcataacttggggccttagtttattactccatggaatccatctaataatactctatgtgtttctgctgacctatgtgagagaaagttctaatctggcacccatgctttcaaatgggagataaagaggaactaggctgggtagaaggtaccaagaaagaaaggagtcttttaaggagatcattcaacacactttatttttcctcttcattcgtgtttcaagccccattatgtttattcgcctatgcatgttccccaaagccacgttctctcatctgtttcccgtaacgatggagaggactggaaacgctgttgagtactttgagctcctcaaggagtacaaattgcttgtttctgtacattaacgaattctttgactttttcacacttagttcctttcactaagaagctaataggccgggctcggtggctcaagcctgtaatcccagaacttcgggaggccaaggtgggtggatcacgaggtcaggagtttgagaccagcctggccaacatggtgaaaccccgtctctactaaaaatacaaaaattagctgggcgtggtgtggtggtgggcgcctgtaatcccagctactcgggaggctgaggcaggagaatcacttgaatccgggaggcagaggtcgtggtgagccaagatcgcgtcattatactccagcctgggcaacaagagcaaaactggaaagaagctaatagttcaggagtagatgccacatacagatacaaataacaacttcaaaacaaagaacatataagaagtgccagtagaattcagagaagacaggctagaggcatgaaggaaagcttcaggaaatacttgaacatgggaagaaagagaagcgagtaaagcattaaaggcagaaggaagaatgtaagaaagggaataaggcaaaagtaggagccaagttagtgggacagctgatactcccatttgaattgatactcagtcaggattagtaaaatgaactttgtaaaattactttagagtttcaagggaactctaatgggaaatactgcagatgtgaaagatgcacaatgtgatggcaagagctgtcgacagggagaggtggagcaagattgcagaatagaaggctccaccattcgtcccctgcacaaggacatcaggttaaccaccactacacagataaaaacacctttataagaaccaaaaattagatgggcactcataatacctggcttaacttcatatggctgaaagaggcaatgaagagatagaaaaaaatgtccagaatcgcctacgtgacccctcttccaccctgggtagcagctgcatggtacagagagactttctgggagctgagaaggagaacacagcaactgtgaggcattgaactaagtggcatcctgttaaatcaggaaggaaaactagaccaaactcagatgacacagaaggagcatttacactagctctagccagaggggaatcgccaatcccagctctctgaactcgagtgctcggaagcctcaccactgaaagccaaactgctcttggtccctaagtaaacatgaaaggcagtctaatccataaggtctgcaactcatagccaagtcgtagtcttgaattaggcccagagactgtggactagagagacacgcagcataccaagacatcagctggggcaggcaagggggtgttggcatcgccactcccctgaccccaggctgcacagctcaacttcgaaagagaccccttccttccacttgaagagaagacaaggaagagtgagtaggactttggcttgcatctgggataccagctcagccacagcaagacagggcaatggtcggaatcaagaggcccctgttccaggctctagccccagatgacatttctaagcacacttggaccggaagggaacaagctaccttgaaacaaaggacccggtcctgacagcattcattatttgctaattgaagagcccttgggccctgaataatgaacagtgatacccaggtactatgtttagggccttggtgagcctctgagacttgctggctttaggtaagactcagcatattactagttgtggtggctatgggacaaaactccttctgcttgagaagtgcagagggaaaggcagaggggaccttgtcttgcactttaggtaccagcaccaatatagggggttagagagccaagtgggctcctagggccccccattccaggacttgaatctttgaattttttttttttttttttgaggtagagtctcactcctcactctatcacccaggctggagtgcagtgatatgatctcagcttactgcgacctctgccccgggctcaagcgatcctccaacttcagcctcccaagtagctgggaccacagatgcgcaccatctcacccagctaagtttttgtatttttggtagagagggggtttcaccatgttgcccaggctgctcttgaactcctgagctcaagcaatccacctgcctcagccttccaaagtgctgggattataggcatgagccactgtgcctggcctgggacttgactcttgaatggcatttccggacctgtcctgggcaacatggatacagtaaaaaaagtaaagaaacaacccacagactgggataaattattttcaaagtacccgtctgacaagggattaatatccagaatatgtaagatgctcaaataactctgtaggggaaaaaaatgtaataatttgatcgaagaatgggcaaaatatttgaatagacatttctcgtaagacatactatggcaaataggcatttgaaaaggtgctgaacatcattgatcatcagagaaatgcaaatcaaatctacagtgagatttctcaccccagttaaaatgacttacatcaaaaggacaggcaataacaaatgctggcgaggatatggagaaaagggaacccttccacactattggtgggaatataaattagcacaatcactatggagaacagtttggaggtttctcaaaaaactaaaatgaggtaccgtatgatccagcaatcccactgctgggtatacacacccaaaaaaagggagatcagtatattgaagagatatctgcactactgtgtttgttgcaacactatgtacaatagctaagatttggaagcaacctgtgtccatcaacagatgaatggagaaagaaaatgtggtacatagactcaggggagttctattcagccataaaaaagaatgagatccagtcatttggaacaacatcgatggaactggagatcattatgttcagcaaaataagctaggcacagaaagacagacattgcatgttctcactgatttgtgggatctaaaagtcaaatgaattaaaatcatgggcatagagagtagaaaggtggttaacagaggctggaaagggtagtgggggatgatggtggaggctgggattgttaatgggtacacaaaatagaaaaagtaaataaaacctactatttgatagcatgataggatgactacagtcaataataatttaattgcacattttgaaataagttaaggagtgtaattggattatttgtaactcaaggtctaaatgtttcagaagatcgataccctggtctccgtgatgtgccctgttctccatgatgtgcttatttcacattgcatgcctgtatcaaaacatctcatgtactctataaatatacacaactactgtgtacccaccaaaatataaaaaaaactggaaaacattttaaaaaaaaagagttgtgggcattattttataagcactggaggaaatgaatgattttgagcaaggacatggcatggtcagacatggggattgaaaatcgcacagttgcaggatcattgaaaagaatgttttgaataccaatttaaaaaatagagaaatgcagttatattaattgcatttctatggtgttccttggactgagttcctgagtttgggatttagccaaatacggatgagttcaggtcctccattatgaatatcttctgattaaaacagtattatttcatattctttgatttgttgtttatcctgaagagcagatgtatttctgttcccttaatttctttgtagtttccatgtagattcccgtcttcccatttttgcaccctccatctagagaagattcttgcccagtccctcccatctgaattatttttattcaaccgtttcctcatgagtgccataatctgaggcttccaatttaaggcagtcatcctgcattctcagcatctcctatgttcacaccaaaatacaagagagattcagagaggggatggaatccttaacataattcaaagtaaagctaacatccaaccttttgccagaagatgggaagagtttctactaacagtactgaaaaaaaaactgctattggcagcagatttgaaacactttgctgcttgagaaacccaccagcctgaagtgaaatatttatcccgccctcatttctagtcttaatttctcccaaggtcttactcagcagtcagtaaactgagaaattgattctatatgttctgaaattgcatgctgaagaggctgtggcaataaaatctcactctggcggacatcctccttcctccaatgaacggataatacccataaaattatctctttgtacatgtattgtaagagtataatccctataaagtatcattgtgcccaggttttcttgtggaataagtatcaattatctacttccacaatattgctgtgtaaccaactactgtaaaaccagtggcatgtaacaatacccaataatttctcatgtgtctgtgaggttcagttgatgtactctgggtttacctgagcttgctcacatacctgatgacgggctctgctcctcgtctcttattctttttctgagacaagcgtgttagcttgggcatgttttcaagttaacagcagagggcaacagcaagcaagaggatgcacacaacgagtcatggaaaactaggcttggaatggacacgttgaaactctattgcattctattggccaaagcaagtcataagaggaaaagcaaaatcatgtaagggtagattcaggaaggggtaaaataatatggccatcattgctatctaccataggaaggcattgcataaatgcataggaattagcaatcattgcataaaaagatataacggtggctcacgcctgtaatcctagcactttgggatgccgaggcgggtggatcacctgaggtcaagagttcgggaccaacctggccaacatgctgaagccctgtctctactgaaaatacaaaaatgagctgggcgtggtggcatgtgcctgtaatcccagctactcgggaggctgaggcaggagaattgcttgaacctgggaggcagaggttgcagtgagctgagatcgcgccactgcgctccagcctggtgacagagcgagcattcgtctcaaaaagataaaaaaaaaaggaaagaagaaaaagacacaaagttggtagaagaaaaagaaagtgaactaaaaaagaaatctttcctatatagttattagttttgatagctcttttatgcatactttaaaaattgtacattttcctagtttgcctacagtttgttgtggaaatggttaaaatagttttccatttagtgaatagtacattctctttctactagtttatttttaacagtagataaatactaatatctttttattggcgtttgtattcgtaagagtaatgctaggctgtgctgactccacgacaatcacaaaataaaatctcagtgatttaacataacaaaggtttgttttctgatgaatgaaacttctatctgggtgagcagagactcttccgtccaataccttatggagccaggcttcctccatcttgttcatttccttgtcaactcatggttgtcaaggtcactgtgacagaagaagagaatgaagaagccacatgagggcataactgcctcaaccttaaaatgatgtgtatgttttctgcacccggttcactgcccagagctagtcaattttgagaccatctcaatctgattataaaacaggctataaaatatagggaaacacatagaatctttgtgagcactccctatggcacatctttacatctacatatacttgtgtaattacctcgttaaatacatgattataaggttttaatatctggtaggatataacttcctctcattaatcttcttctaaaattatcttaggctggagatggtggcacacacctgtaatcccagcactttgggaggctgaggcaggaggatctcttgagctaagaagttccagaagaacctaggcaacatagtgagaccttgtttctacaaaaataataataataataataataataataataataataataacaaccactacacataattagctgggcatggtggcatgcacctgtagcctcagctgctcagagactgaggtggaaggatttcataagccctggaggtgaggccgcagtgagctgagatcgcaccactgcacgccagcgtgagcaacagagggagaccttgtttaaaaaaaatgatattggacattatttgatttgaaaatgtattctgggctgggcgtggtggctcacgcctgtaatcccagcactttgggaggctgaggcgggtggatcacctgaggtcaggagttgagaccagcctgaccaacatggaaaagcctcgtctctactaaaaatacaaaattagccttccatggtggcacatgcctgtaatcccagctactcggggctgaggcaggagaaacacgtgaacccgggaggcagaggttgcggtgagccaagatc

SEQ ID NO: 337 - DNA, 3325 bp, Homo sapiens
ggggtccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgggatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtatcttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtaggatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaaaaaaaaaaaaa

SEQ ID NO: 338 - DNA, 501 bp, Homo sapiens
tctgtttacatctacaataaattaaaaaaaaattcttccatagcctctctggtgatacttgcagcactgaggtattaaaaaaaatatatataaaccaaaaggttgctttcctaatttgtaaatagaaagtgaatggagaaaggttgtattaatgcaggcttatccactcctggcccatgggcccccagatgtgggagcagggtggggggcagggggagaagagaggcaaagtgtcctagggacctttggaggtgctgaaatgattggacaatagaaaatgatcaaatatttaaaaattaagactgaaaaagaatgtcccccccaccccacccccacccaagccaaacaggtgtgctttgaaactttaaatatgttaaatattaaaattgtagctttgtttttaaaaaacatcttgggaaaagcagtttttcatattttaaataaaaatctaactagacggtaacatttgaagctgtgcacagacaagaggttaataggctg

SEQ ID NO: 339 - DNA, 1385 bp, Homo sapiens
agcgctcgagtgccgttgtcggctgcgccggaagtccctagccaggcctggcggtaaccttgggggcctcactgcagccgccgctgctgttggagtgggctttgcgagtctgaacgttggcggggctaggctcgttaactgccgagagcctccgggtttgcggtggaggacgctgaggcccgtggggggcaggcacccgggcgccgggcctcccagccgacatgtctctagtggcggaagccttcgtctcccagattgcagctgcagaaccttggcctgaaaatgctacattatatcagcaattgaaaggggagcaaattttactttctgacaatgcagcttctcttgcagtgcaggcctttttgcaaatgtgtaacttgcctatcaaagtagtttgtagggcaaatgcagaatatatgtctccatctggtaaagtaccttttattcatgtgggaaatcaagtagtatcagaacttggtccaatagtccaatttgttaaagccaagggccattctcttagtgatgggctggaggaagtccaaaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttacatttactttcttttgatttttctgaaagtcattcactgaattttacacatgtggaataaacagtgtcttttctaaggcaaaaaaaaaaaaa

SEQ ID NO: 340 - DNA, 4163 bp, Homo sapiens
gagtcacgtgggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacgaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatccaagtagagaaaataatatgtgggttaagatacatccttaaacttttttttttttggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaaccataaaaaaaaaaaaaaaaaaa

SEQ ID NO: 341 - DNA, 783 bp, Homo sapiens
gcttggtctttatttctgatgcccatcttcttcagaggttaaaaagaaatgacactgatgtacaaatgactcaccaagggactctcacctgactctacccttgcaggggtggaataaatcccttctattttcaagtctatttgtcccatttctgtttagacataatttgaaagccagcttggaccttgtacttttcaattatgttaacgtaaaatactcgtaacgaatgtagtatgagtttaaagtgagcttttcagatcctataagtgcatcctaagtaatgacaggctttaagataaggaatatatgcatttggtgaaggcagaaatctcataaaatttcatgaaaaaccagtggtcaatccaatgatgcactttttaagacaagtttgtctggaaactggaagggtcaaaagacaacaaaaaagcacacaccaaaaaacctcactttaagcaaatctataccttgaaaaaaaaaaagcctaagaatattctgagaggggtacatagtttatagtacccacagtaactcccagtgacgggcaaatttcttggcatcagctggcttgtgtggtgaatggacatccccatgaacagttcttacatccttccgttccttctacaggcctcggtcttgtttcccaaggtgtctgccgtgaggctgtatggtcccatgacctctagggtataatggcatccactcgggaagaaagatggtgagcaactccagggatctctacgtttcctccccgggggaatcactgggcgggttacacaacccttg

SEQ ID NO: 342 - DNA, 1561 bp, Homo sapiens
tggcagcccccatacctcaagggttctcttgtttatcgaggtttttgggctggtggtttcggcagccagttctggtgactcagtccgcagctatagttccagtaagaactaaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatcccttaaaaaaaaaaaaaaaaaa

SEQ ID NO: 343 - DNA, 494 bp, Homo sapiens
cagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttc

SEQ ID NO: 344 - DNA, 882 bp, Homo sapiens
  misc_feature 689: n = A,T,C or G
gacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgcatctccgagagcaacatcaacctctgcggctcccactgcggcgtttccatcggggcaagacgggcctcccagatggccctagaagatctggctatgtttcggtcagtccccacatcaactgtcttttacccaagtgatggcgttgctacagagaaggcagtggaactagccgccaatacaaagggtatctgcttcatccggacagccgcccagaaaatgccatcatctataacaacaatgaggacttccaggtcggacaagccaaggtggtcctgaagagcaggttgaccaggtgaccggtatcgggctgggtgacctgcacgaggcttggcgtgcgaactggtgaagacgaaagtcacctcgggggtggccttccatcaagcctggcgaatcatctcgaggtcgtgcccaggncggtctcccgggggccttttgagtgcttgtgcgtggtccgcgagggcgccggcctgcccccgggtaccgggcccagggaccggctcagattggtcggccctcacggggcgccagcaccgaggggggggccaccgggccaggggggtgtcacacaaacccgcgtcggggcgcgcggtctctcctgctccgggga

SEQ ID NO: 345 - DNA, 1421 bp, Homo sapiens
gaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttaaaaaaaaaaaaaaaaaaaaaaaaaa

SEQ ID NO: 346 - DNA, 462 bp, Homo sapiens
  misc_feature 35, 54, 83, 320, 407, 418, 454, 459: n = A,T,C or G
tttttaagatgaagacagtaatataatattttggnacaaaaacagctgcaggangaggtggaggggggcctgtcattatgttncccccccaccccccaacgaaaggaaaactaagactcccaacataaacagggccttgaggggggggattacaggcacttgggcatggagtcttcggctgcaggaagcactccgcttattcttcaggaatgggaaaggcgtgacccaacgagagcatctgtctcagagctccactcagggtcacccctctccagaggccggtatggggtggcttcagacttccactgcacgacctgggngcaccaagaccacacaccacaataccaaatttcacccaagaagaggtttcagcattgtgtaggttggagtaaaacttgcagagattnccaggggggtnttccatggattttctggggtttcagaacagtaattntagtnttt

SEQ ID NO: 347 - DNA, 392 bp, Homo sapiens
  misc_feature 44, 238, 319: n = A,T,C or G
agcggcggcggcggaaagtggccggcgagcccggtccccgccgncaccatgcttcccttgtcactgctgaagacggctcagaatcaccccatgttggtggagctgaaaaatggggagacgtacaatggacacctggtgagctgcgacaactggatgaacattaacctgcgagaagtcatctgcacgtccagggacggggacaagttctggcggatccgaggtgctacatccgcggcanaccatcaagtacctgcgcatccccgacgagatcatcgacatggtcaaggaggaggtggtggccaaggccgccggccgcganggccttgccagcaagcagaaagccagcagaaaggccgcggcattgggcggggccttggcccagggtgttgttt

SEQ ID NO: 348 - DNA, 1808 bp, Homo sapiens
tccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacaccaaa

SEQ ID NO: 349 - DNA, 712 bp, Homo sapiens
  misc_feature 287, 433, 518: n = A,T,C or G
taaggctacttttgtagctttttgttttccctttgtatttatcatgtttttaatttcttctctgaggaggaattctctgaatctgtatcttccaattcaattcgttgccttttgaggccactgtggccatgaacagccctgctactatctgtggctggggtgtcagtggggtcctctcttgttccagcattgggggtctcacaggccatttcagacccgcaacaatctttgtgtaggagtgtccctgtcagggacgaagtatcacggtcagtgtctgagtgtcctgnggaagagtaggccaccacctccagctcccccaagttctgcccgttattgtgagggtgagggggacgagggtgtaagcgtccattgttgtggttggcacagatggtttcgaggctcctctcctcactgtcatcagactgggtcctgngacagttgccagacccgctgttgagagtggagccagatgccttggggacaggaggagaaggcggctcctcagcccgactgctcanggcctttccattgagcttcttggtttcaaaagggtgctctacagagccgctattgccagtgtcctgagagtaccctctggcacctctgcccaagcatggctgctgtgctcatggcctgggcccattgctggagttcctagagtctcttctttaaagtgtcctttgctgaaccctcaagtagcaaggtcctgttc

SEQ ID NO: 350 - DNA, 6456 bp, Homo sapiens
acggcggccgcgcgctccaggccggtcgctccacgccccggctcccgggactgtggactccacgaccctgtcctcggccctgtccgcgccgaagcagcccgggactgcgcagcgccccgcgtgccgatcttttcctaattcagcagcgatttaaccaagagcctggaatattttaaggagtaataagagacatttacaaactattctctctgaagcctgctacctggaggcatcatctagataatcagaaccttggcttccacatcctcctcccttgtcttaactacaaacatttctttctgctgacttcaactcctcagacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaagtctattactcatggaagacttttaaagaataaccttttttcctgttttataaattcccattgttatatggtagtatttcagctacacaatattttagcttttagctagacatttatagcttttcatttgttgaaatggtaatcatctgcatgtttttgtcacttatttcaggttagtgattgcctaacacttataagccaaaataatccttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacatgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttttttttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcacaattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacatttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatgtagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgatgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttatgataatagcaaacaaatagaaatgcccccaaaatgctatttttttaattcagttataactgttactcttgtagttgtgtatgacgcaataaaatttgtaaaaaaatttcagcatgaaaaataaaatttgtatcacctaaaaaaaaaaaaaaaa

SEQ ID NO: 351 - DNA, 761 bp, Homo sapiens
  misc_feature 391: n = A,T,C or G
cgcaagtcccagtcgctgcccatggaggcgtccagcgagccttcgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggcgtgaagacggattctttggttgataaattgctatcattctaaagtcatggacttcactttcggcaacaaaactaaataaggatggaacatttattgaatgaaaaatgcacttttgntttttcatttttttaaataataaaaatcagacaaacaggaaaaaaaaaaaaaaaaaaaaaaaaaaaactcgagggggggcccggtacccaattcgccctatagtgaagtcgattacaattcactggccgtcgttttacaacgtcgtgactgggaaaaccctggcgttacccaacttaatcgctttgagaacatcccctttcgccagcttgcgtaatttcaagatgcccccaccgatcggcctttcaacagttgcgcaacctgatggcgaatggcaaatgtaagccgtatattttggtaaaattgcgttaaattttggtaaataagctaatttttaaccaattggccgaaatcggaaaatcccttttaatc

SEQ ID NO: 352 - DNA, 1266 bp, Homo sapiens
cggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcgtcgagtctaga

SEQ ID NO: 353 - DNA, 585 bp, Homo sapiens
tttctcttcttctctttggcacatgctcatctcccttgtgaactcgaactattcaacaacataagaaaaggaacaagaacgatttcttccgtatactccctaaacacacagagtttactgggtcagatttaactgtgagcatttatatgcctacttccaggcatcgtcatctgatgtttcactgctactggtttcggtgtctgagtcctcaaactctgctttgcaagtgcttctccaaggggagaacagactggaactgcggctctgcaagaagccattctttccaaagccatttcttctcagctgctctgtcttcatgtggaactctttgagctcatcctctgtgaggggaaggcaattctcatcattttcaggatattcctgccaacccatagctttcaataacctgtgctctgcttctagagagtgtgagagaacctccccttcttccactacagggagggcaagaccattttgatgacagccttcctccccattttcctttggttcaggtgtgctgttgtcctccaaatcttccagcttgtcacagtctctattctctgagaagtctccattccggtcatc

SEQ ID NO: 354 - DNA, 2899 bp, Homo sapiens
cttcaggaaaaatctgtaatggggggcgggcccggagggctgtcggtgggcccgtctgcgtacgacggcccgtcccctgcgcacggacgcctggaagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacgctaaggcagccatggctggtcgtctgatgataaggaaattagttgcagagaaattgaatatcccttggaatcatattcgtttgcaaagaactgcaaaaggaaaaccagttcttgcaaaggactcatcgaatccatacccgaatttcaactttaacatctctcatcaaggagactatgcagtgcttgctgctgaacctgagctgcaagttggaattgatataatgaagactagttttccaggtcgtggttcaattccagaattctttcatattatgaaaagaaagtttaccaacaaagaatgggaaacaatcagaagctttaaggatgagtggactcagctggatatgttttataggaattgggcacttaaggaaagcttcataaaagccattggtgttggactaggatttgaattgcagcggcttgaatttgatctatctccattaaacttggatataggccaagtttataaagaaacacgtttattcctggatggagaggaagaaaaagaatgggcatttgaggaaagcaaaatagatgagcaccattttgttgcagttgctcttaggaaacccgacggatctagacatcaggatgttccatctcaggatgattccaaaccaacccagaggcaatttactattctcaactttaatgatttaatgtcatctgccgttcccatgacacctgaagatccttcattttgggactgtttttgcttcacagaagaaattccaatacgaaatggtacaaagtcatgatgattccctgagtaacaaagggaaatgaaaactgtttgtgatcttccgtattcactgaaaaataaatgcttgtttagtatcaaattttatttcacgaaagttttttaaagaacagaaacttttccaattaaaaaaaaaaagcagacttctggttcaagatagctcactggaatacatgtttacctctttctttcctaaattgcattgaattgataggaaggatggcggaatcttaaagtgatacatgctaactgtagaaaaaaatagaaaatgcacataagcaaaaggaaacatttaaatgctatctttcaaagataactactcttaaaaccttgagtatcttttcagacctttttcttggcaaatgaatccatattgacatatttgattttttttaaaaacatggaaacgtactgttttgtaaattctttttaactgcacatctactgttcataaatatacctctgtaacataactttttgtggttctaatgtactctgttgtatagctaatacaagttaggatgcttttggccagaggtaacagtgtccaaatataattggcctaagtaacctaggaaattgtttgacataacacagggttcaggggtgtcattaaagacacactttttttgccttgacctcagttggtttgttttgccttaggctattccacctctcgatcacaagagctgctgctataacttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtggagaatggaattggaagcccactgccttcccataagaaaggtttaccataatttacttacttttttctgtgttagacattttgattatctgcagtttattactacaagcagtggcagagtgaatgtccttgtacattttgagttacatgcttaattatgtccttgagaaagtttctaatagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgatccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgtttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatgaaaaaaaaaaaaaaaaaaa

SEQ ID NO: 355 - DNA, 1436 bp, Homo sapiens
ctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcaaaaaaaaaaaaaaaaaaaaaaaaaaaaaaaaaaaaaaaaa

SEQ ID NO: 356 - DNA, 523 bp, Homo sapiens
cggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaaaaaaaaaaaaaaaaaa

SEQ ID NO: 357 - DNA, 2473 bp, Homo sapiens
gcttgcgctgagcagcccgcgagggcggaagtgggagctgcgaccgcgctccctgtgaggtgggcaagcggcgaaatggcgccctccgggagtcttgcagttcccctggcagtcatggtgccgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataaatgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtgtacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaaaaaaaaaaaaaaaaagaaaaaaaaaaaaaaa

SEQ ID NO: 358 - DNA, 873 bp, Homo sapiens
ccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatgtcagttcaggaccaggacagggatggggcctgggtgggtggcggtcacagcgtggcagggtgggggctgggatccgcctacaccccacggtcaggctgctagaaacctgggaacaccccagcacagggtctcagaacagagacctggtacaccaggcccgccgccacccgagggagcccagggagatgggtgcagaggtgtcgcctttaacgtgatgttctctgcccctcacatttagccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaaaaaaaaaaaaaaa

SEQ ID NO: 359 - DNA, 521 bp, Homo sapiens
  misc_feature 35, 46, 151, 459, 477, 480, 488, 492, 504, 507: n = A,T,C or G
cccattaaacagtttattacaacactacatctatngtaatcaaagngatgctgtttacagacattatcatataaacatttttaacaagaacaaactactacaaaaacaagcatttacttgactttttttccaattgcttgcacatcataanggccaaatgtatataaccagtaataaagttgcaaaagctataactttttaaatcacacaggtttccttcaaataaaacagttaagcaacataaaaaataaaagtagagctactggttaccatttatgcagatttgctttattcagatctattcctgttcattttatccatgaatccttacaggttcagttcaatcacaagaagcaaactgctggacaagcgtcatttttcccccatgaagactgttttgtcttggaaggtgatcctcttccttcagcttctaacgatgacgatattcgcgctctcggncacgcttttcggcacggnctnggcacgancccnggggcctttttngtnctctggttctctct

SEQ ID NO: 360 - DNA, 483 bp, Homo sapiens
atgggctgcctcgggaacagtaagaccgaggaccagcgcaacgaggagaaggcgcagcgtgaggccagcagcagctacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaa

SEQ ID NO: 361 - DNA, 1593 bp, Homo sapiens
ccgccgccgccgcagcccggccgcgccccgccgccgccgccgccgccatgggctgcctcgggaacagtaagaccgaggaccagcgcaacgaggagaaggcgcagcgtgaggccaacaaaaagatcgagaagcagctgcagaaggacaagcaggtctaccgggccacgcaccgcctgctgctgctgggtgctggagaatctggtaaaagcaccattgtgaagcagatgaggatcctgcatgttaatgggtttaatggagagggcggcgaagaggacccgcaggctgcaaggagcaacagcgatggtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaag

SEQ ID NO: 362 - DNA, 846 bp, Homo sapiens
gcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgaaaaaaaaaaaaaaaaaaaaaaaaaaaaaaacatgttgttgggccgcgacgtcgaaccccggcgaaaaaggctctttcataaaccaattcgtgggtggggcgcgccgggagaccccgagtagggtaacgggtaaccacgtgggcgcaaacagctggttccccaaaggaagaaaaccgcggcgccggcgcacagagtggccgtgggatttccaacccaatataaaaaaggcgccgggggggacaccgcgtagcggttctggaaacaaacccccagcaggggagttccgagagggccaatcagcgggcgacatatccacagcggggggtccccagcgggagagcctggagaatatttaaaaaatatttaagccccccgccgccgggggagataacagcacacgacagtaacacacaaacaaggaacaacaaaaaccaagtaacgacgaagacaacaacaaaacgcagacaactgaacgaatgaagcgcaaccaatgagatcatagcagaacaagaccaacaactcgaggagacagacaaactagaacagacacgactgaaaccaacgacatacagaacaacgacagaaaaagagaaagaatgagcaactagagacaagacgacgagacacaaaaaagaaa

SEQ ID NO: 363 - DNA, 1959 bp, Homo sapiens
taggctgagccagactcgcctagagctctccggcggcggcgcacttcagggcagcagggctcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagatggcggcgcccaggccgccgcctgccaggctgtcgggcgtcatggtgccggcgcccatccaagacctggaggccctgcgcgcgctcacggcgctcttcaaagagcagcggaaccgagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggaacttggatacgattggtgttgctgttgatttgattcttctgtttcgtgaactgcgagtggaacaggaatctctgttgacagcttttcgctgtggcctgcagtttttaggcaacattgcctcacggaatgaagattcccagtctattgtttgggtgcatgctttcccagaactgtttttgtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgttcttgattattacagacctctttctgaaaagcccggaattggtacaagccatgtttcccaaactgaacaatcaagaaagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggaggcactggctacaattaggcttctcgacgtcctgtgcgaaatgactgtgaatactgagctgctcggctatctgcaggttttccctggcttgctggaaagagtgattgatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaaatgagctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaactcttatttgacaaaaaaaaaa

SEQ ID NO: 364 - DNA, 3453 bp, Homo sapiens
acttttcgcgcgaaacctggttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaaaaaaaaaaaaaaaaaaaa

SEQ ID NO: 365 - DNA, 1919 bp, Homo sapiens
  misc_feature 1015, 1824: n = A,T,C or G
gtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggtatggaatgcatcttggtgatatttttaaattaatattttaaattgcttgaatgtttgtatacatgttaagagaatgctttgaaagcttatttgatagataatgtttagagcatttcttttgaaaaatttcaaacctacacagaaatagagatgctatagtgaactcccatctattattacacaaatttaatggttagcaacgttttattttctctgttccctttcttaggaatgttataaaagcaaatcccaagcatcatatcatttcacccaagtattttaaagtatgtgtctctaaaggaagaaatacatatttttatttgactatgtttggagtttaattaattatntatttatacattattttacagtttacaggatactttcctgaatgtgttcttggtgtttgtgaaaatcctataagattaaagaaatatatatatactttttttcttttttcttttttaaagacagggtctcactctcattgcccaggctggagtgcagtgagctattacagtgccactgcaatccagcctgggcaacagagcgaggtcccgtttcttaaaaaacatatatgtgtgtggcgtgtgtatatatatgtatatatattttttcattgtattattgcggagactttcaaacatatatagaaagagcataatgaagcctgcatgtgcccagcttcaataattaccaatatcttgccagttttgtttcgtttctcctttgattctctgtattgagcaagtcttagacatcatacgtttcccgcgtaagtaccttattctacatcattaaccagtaaggactttttaattaaccacaataccactatcacacctaataatagtaattccttatggatcttttctttagacctatttttgaaggcataaaagcagttgagtttctggagaatttttggatggtgattaatgacttgactggctgctcttcccagagctgtggcagctctccccccgtagaagatggggtttgtattggcgcaccaagatctccaacagccagtgtgtgtttcccatttcctgtaggttccatcaatggtgagcaccagcctgaatgcagaagcgctccagtatctccaagggtaccttcaggcagccagtgtgacactgctttaaactgcatttttctnaatgggctaaacccagatggtttcctaggaaatcacaggcttctgagcacagctgcattaaaacaaaggaagttttccttttgaacttgtcacga

SEQ ID NO: 366 - DNA, 578 bp, Homo sapiens
ttttttttttttttttgctaataagtttggtttatcatcacatcaagataaattgcctttagcatagaacttgagataagtagacgttcactagcaagtgctaacatttggatcagggcaaaggcgtttccaggagtgtttttataccagacccctgcttagtccatggggctgaggcatgtcacataactcagagcaagagccttctatttgtgtaagacccaaccctgggaaggatgcccgagacaatagctatgcctctgccccagcctgatgccatgtgatctagagcctgggcagcaacaaccctgtggtcaaagacatggaagaaacactctgcaaatcccacagtctgttcgacggcttggaaaggaagcaagtggcattgggacaattgctctacatgcctacagcttacctgtcaactacagggggctgccaaggtgtgcaagacgacctgggggcagagccatgctcagggcacagatagatggggatgggagtcgagatggggcatgggaagtgatgagggctctgagaacacatgaagcaggtattggacatcagcagatagatga

SEQ ID NO: 367 - DNA, 4733 bp, Homo sapiens
gtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactgagaatgaaattgctttggcaagctaaaatgagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcctaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggaaaaaaaa

SEQ ID NO: 368 - DNA, 3143 bp, Homo sapiens
ctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggtaaaaaaaaaaaaaaaaaaaaaaaaaaaaaaaa

SEQ ID NO: 369 - DNA, 918 bp, Homo sapiens
tgcaggcagaacagctaccgtgattatggcggacagtcccgtctgcccccgtaggagaagacccacggctgggtggggtgtgaagatgacgtccagcactcccagatctcgggtcagcacgtgtcccttcagcaccttgacgggcaccagcaaggggttctgcagaaggtcattgtacaccatgccatggcagacgatgacactgccgtcgtccgagcctgacgcaaagagtgggtacctgcgggctgtgaaggccacagcccgcagcagccttcttgtggtgtctcagcatcctgtatggcttggtggaaagatccaggtcaaaccacaccagcttgctatcgtagctcccacagatgacgttgtcacctgcagggtgcaccgccaggctggacacccacttgcagttgggcatcagcttcttggtgagctcctggcgcagcaggtggtagaggcggacgctgcgctgggacgccaccaacaggatagggccgggcagggtggaaggccactcgctgcacctgtccgtggctgcggcggaacggactctggctgcggcgacggctcagctggtgaatcagcacctgggtgtggccttgggtggcctagcaccacgggcaggtagtccccgactgcccgtgccagtgtcacctgcgtcactggcttcccgtggcagtatgcgcagccgcaggcccacttggcgctcctcctctgaggcctccagccacgcgggccggcttgcaagggggctcctcaggcgggacgaagagcgctcaagcagctgatctgtgctgcccgacaccagccggtcccccatagctgggttcagccagcatgaccgaagttgtccaacgtcttgcaagccacaggcaaacagcggggctggggttcaaggccacactccttcacaggccctca

SEQ ID NO: 370 - DNA, 1339 bp, Homo sapiens
ttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaagcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcattcccatgccccatctcgatcccatccccatctatctgt

SEQ ID NO: 371 - DNA, 3647 bp, Homo sapiens
agtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttatattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgt

SEQ ID NO: 372 - DNA, 1536 bp, Homo sapiens
ggggggggggggaccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagcttgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttatagttgttttatatgttgctataataaagaagtgttctgc

SEQ ID NO: 373 - DNA, 3769 bp, Homo sapiens
aaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtttcagagcagcgatggagaaattaaatacttgcaattagcagaggaactgattcgtcctgagagaaacacattggttgtgagttttgtggacctggaacaatttaaccagcaactttccaccaccattcaagaggagttctatagagtttacccttacctgtgtcgggccttgaaaacattcgtcaaagaccgtaaagagatccctcttgccaaggatttttatgttgcattccaagacctgcctaccagacacaagattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaaggtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagcacgtggaggagttcagccccagagctgtctacaccagtggtaaagcgtccagtgctgctggcttaacagcagctgttgtgagagatgaagaatctcatgagtttgtcattgaggctggagctttgatgttggctgataatggtgtgtgttgtattgatgaatttgataagatggacgtgcgggatcaagttgctattcatgaagctatggaacagcagaccatatccatcactaaagcaggagtgaaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggttacagattatgccattgccaggcgcatagtagatttgcattcaagaattgaggaatcaattgatcgtgtctattccctcgatgatatcagaagatatcttctctttgcaagacagtttaaacccaagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaagaagaggacgagtcagcattaaagaggagcgagcttgttaactggtacttgaaggaaatcgaatcagagatagactctgaagaagaacttataaataaaaaaagaatcatagagaaagttattcatcgactcacacactatgatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacagatggcattcattaaatcacaaagtatgttaaaggtcacaaaagcaaaataactgtctgaggctaaggcccacgtgggacagtctaatacccatgagtactcaacttgccttgatgtctgagctttccagtgcaatgtgaatttgagcagccagaaatctattagtagaaagcaagacagattaatataggttaaaacaatgatttaaatatgtttctcccaataattatctctttccctggaatcaacttgtatgaaaccttgtcaaaatgtactccacaagtatgtacaattaagtattttaaaaataaatggcaaacattaaaaacaaaaaaaaaaaaaaaaaaaa

SEQ ID NO: 374 - DNA, 2357 bp, Homo sapiens
ccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaaaaaaaaaaaaaaaaaaaaaaaaaaaaaaaaaaaaaa

SEQ ID NO: 375 - DNA, 2112 bp, Homo sapiens
cttcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagagctcttattaaacttagatgaaagagctgcttccattgtcagggtattttct

SEQ ID NO: 376 - DNA, 469 bp, Homo sapiens
ttttttttttacctgaacacaccgtggctttattattaacggatgccaaaagcacacttcccagaaccgcgctagaggcgggcgcccagaggcagcaggacactacagctccttcctctggggcagaaaggagggtgcctgggaagttcgagggctgcagtggggaggcagaggtcccagcaacattgtcaatggcaggcagcggcaggaggggcgaggcgtgggcgagtccatgagtccagtgaggcggcgcgactcacttgaggcggtagagaaccttgcgctgcatgcgatgctggatctcgccgcgccgcagcatgagctgagcaccttgtggatggcgtgctccgggtttcaccagaatccaaccacctcctcctctcccctccccttgcgtgggacagaaaaaatacccccatccctgctcctgatgaagatgtccctagggaaggaatgatggctagaaaag

SEQ ID NO: 377 - DNA, 5825 bp, Homo sapiens
atggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaac

SEQ ID NO: 378 - DNA, 926 bp, Homo sapiens
  misc_feature 645: n = A,T,C or G
cggtttgggatatgacctttattgaacttatccaccagagtggaaataatgtctgtacaaaaccaaatgtttgttactataacttctgcatcacaattaaaatccaaacagttttttaaaaacagtcaactcaatcaaaacccactacttcagaatcaatagcttctttgaagccacagtaacacttaaatatggttaagactcgaatgcagaaatttggttggttggaaagctaattaaacttccaacttgctcaaatagaattacaaaaaggcaaaattgtgtttttcacagagatacagtccactggaatcaccaacactggacagctgttagagtatttagagtcctgagataacaaggaatccaggcatcctttagacagtcttctgttgtcctttcttcccaatcagagatttgtggatgtgtggaatgacaccaccaccagcaattgtagccttgatgagagaatcccaatcttcatctccacgaatagcaagttgcaagtgacgaggggtaatacgctttacctttaagtcttttgatgcatttcctgccagttcaagtacctttgcggtgaggtacttcaggatggctgcgctgtacacagcggcagtcgcgcccacacgttcatggactggccgncctagatttttaggtgtccatgaattacgggccacctgggaaccttgaagccgggcttctctgggaaccggaaaacccgccttttggctttgccccttctggccgttttttttgaaacccggttatatagtaagtaaggcgggccgttttttaaggattccaagctttacgttcaccgtgcattcgcagcgcaatagattttttaataggggccacttaaatttcaatctcctgggcccgccgttttacacaacgctcgaattgggaaaaaccctgggctt

SEQ ID NO: 379 - DNA, 2713 bp, Homo sapiens
caggggggggagggggtggcgcgcgcgccatttctagtcgttttcaaagcgcctcgcgctgattctcacgggcccggctgccggcccccgctctgccctgcataataaaatggctaatcaggtgaatggtaatgcggtacagttaaaagaagaggaagaaccaatggatacttccagtgtaactcacacagaacactacaagacactgatagaggcaggcctcccacagaaggtggcagaaagacttgatgaaatatttcagacaggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaaccacaggacagaggaagtatggtggtcctccaccagacagtgtgtactctggcgtgcaacctggaattggaacggaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactgtgtgacagctatgaaattcgccctggtaaacaccttggagtgtgcatttctgtggcaaacaacagactttttgttggatccattccgaagaataagactaaagaaaacattttggaagaattcagtaaagtcacaggtttaacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattaaaaaaaaaaaaaaaaaaaa

SEQ ID NO: 380 - DNA, 616 bp, Homo sapiens
  misc_feature 498: n = A,T,C or G
ccaaaatggtttattttaatttattttttatgttaaaatgtacagagttcttttgaaagtacttgctagaaaggggaaaaaaaggtattacatacaaggagaggaagggaggccggctggcccaggagcgcgtgacatggagagatacaaaggcatctaggcaccccttccccttagcttacaagtcaccatgaacaaagtacaaagaggttacaaaacaggaaaagcaaatataaacagacaggatagacgtggcttcccttgtacatgcggcttttagaggcatctggagctctattcacacacgctagagatctctttaaagagaatttatctttcttaaaatagtttttaatattctacaacaaagataaaaaattttaaagatggaatgaaatgaaaaagctcttattttaaaaggcatcaaagtcactaacagtgagtttttaaatttcttttttagaagattacccaagttatcttgctaaaaatacattntttttaaacagaagtgaaaaaatgacaggtaccaatattactgtgttggataatttcttttataatatagaaaagaacttttttttttctacaatagttctacagtcacaaagaggct

SEQ ID NO: 381 - DNA, 5164 bp, Homo sapiens
catttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctataaagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattgaacccttgtactttgccttattttacaaattgaggattaccaattaaactttaactgaactaaggctaccaaatacattccctgttatctaaattataacatacaattattttataacaaaatatatctaatttttattggataaatatgaataaatattttctctcagggaaaataatttttgaaagtagggtgattgagtactaactaggaaggtattaacaccactttgtagttgtcctttacgtaactactcctttactgccaattaactatcaccataaaagtaataaaaaatgaaattatttagaacggggcaggcaaactacatcctgcaggccaaatctgtcccaccacctgttttcatatggcctgtggcctaataatgttcttacgttttccattggttgaaaaataatcaaaagaacattttgtgacgtgaaaattttatgacatctattatgtatcagttttaaaaattagaattgtatgaaattaagagtttcagagttcataaagtttgattggaacataccatgctcgtttgtttacatatcatctgcagctgttttttgtttttaatatggaacgcttcacgaatttgcatgtcatccttgcgcagggaccattctgatcttctctgtaccattccagttttttagtatatgtgctgctgaagtgaggactgcagctgctttcttgaacaatagcagagttgagtggttgcaacacacactgaatgtgactgtcatcacttcacactgctgtttgacacatcacaaatcactgatgtggttgtaacgacagcattttgagtgccatgtatatcacatgaacccacattttattttttattaccagagcatatctattatagcaaaacaagaaaagtggactttgttgttatttttaaagtacagtagggtgtgaattattttgatgttgaattagacgacaaagcatctatatagctaagctaaaagaataaccattgacattaccagacaaaccactcatcacagtattcccaactcacaggcaagcaactgttagaaaaattagaaaatttaaaatggaaataacaaagcagaatttcttcgcaaaatgaaaatgaggctgcaacaacagtaagtctctaagtcaatcatttgttagccaagcaaagccatttattgatggtgtgaattaattatgtttggatgcagcagctgaatatatccagagaaaataaacttaagattactggcctttggcaagaacagttgcttaaagagttaaggacattgaaagcgacataaatagtcactttaaaaaggaaatgattctggatggttctttgactctatttttatttttacttagagacagggtcttgctctgttgcccaggctggagtgtagagacacagttacacctcaatgtaaccttgaactcctaggcttgagatcttcccatctcggcttcccaatgtgtgaaggttacaggtgtgagcccttatatgtggccctcgtgaatggtttagcactatccccttggtggtgtccttacgataatgagttatgagatcttgttgtttcaaagtatgtggcactcgccccccacactctcttgctcctgccttcgccatgtgaagtgccttctcctattttgccttctaccatgagtaaaagcttcctgaggcttccccagaagcagatgccagtgctatgcttcctatagcctggagaactgtgagccaattatacctcttttcttataaattacccagtatcaagtatttctttatagcaatgcaagaatggcctaaaacacaaggcaaaacaactttgatatggtacagtcattttgacaatcgatatttgaatcacaatatttgatgacaatatccttacacatttgtcatactatcaaagagaaagaaacaagatttccattcccacaaattttagtgagtatattttctgagttcagcatttttagggacctaggtgcaagtgcaaaggaaatttccctgtttcaaaatctatttaactgcaattgaggtgattcaacctaattttcagtaagaagtgattaaaataatgacatgctaaaaggcaaatttcaagggaagaaatgtaaaagaattttacaaatgctttccaagtgatgaatatgctcagttaatttcatatgctcctggattgatagcagtatttggcaatacctatctgtatgagaagacatttttaaagatgaaatgtgtaaaatcttattaccattagtattaatggttaatgatggttaatgataaccattaataggcaatcatttacaactgattttgatcacagggaacacttacttagaaccctgattagaggcaatgttattctcaccaaaaaaggcattacaaaaaattgggctatattttgaattttgtcaattaaaaaagcgtgggagcagtgtgaaggagaagaggcaagaacgacccctggaccgaccaaagcccgcgcgctgctgcgtcccacacccggtgcccacatcccgccgccgccgccgccgccgccatgcccaagagaaagactgaaggggatgctaaaggagataaagccaaggtgaaggatgaatcacagagaagatctgcgaggttgtctgctaaacctgctcctccaaagccagagcccaagcctaaaaaggcccctgcaaagaagggagagaaggtacccaaagggaaaaagagaaaagctgatgctggcaaggagcgggaaggtgctggagatcccaagtgaagtgtgtgcattttttataactgtacttctggtgactgtacagtttgaaatattctttatcaagttttataaaaatgcagaattttgttttactttttttaagctatgttgttagcacacagaacacttcattgttgtgtttgggggaaggggtatgtgtcactaatagaatatctctgaagctggattgatacggggaaaacatctttcccttctagttttgagagacttcctcttggctcccaggaggagggatttcctgactttgacacacatggccaccttggcacaaaagccttgtggtatggaaaaacaaattcgtttttatgtcttcttttccctttccatctttcagcatagacttaacccttaagcccagacatctgttgggacctgacccccggtcattggttaccagtgtgtctggcaatctggactttccagtgatgccactgagatggcacctgtcaaaagagcagtggttccatttctagattatggatcttcggataaattctgccattttcatttcacttcctgaaagtcagggttggcttgtgaaaagttgttaaacaacatgctaaatgtgaaatgttaaccctctaaactttccctgttcagagcatcagatgaggacttcattgggttttatagtggctgatttttggtagtccattgaagaagagagtttgaaagttgtatactgttaatgactgtctgcccatgtcctgcctgaaataccatgattgtttatggaaagtatctttaataaagctggatacagtttgaaag

SEQ ID NO: 382 - DNA, 12563 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagcttatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggcacgcgggaatgtgaagggcgctccgggctctgagcccgcagcttttacgacttctccctgcgtcgttccttatattcacagaagccccatagtttcactgggttgcggttattttcctggtagtttgcgtgtaagaaagggagaatatagttttagaggaagctgaactatgacgatgctgggcgaacggtttgggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggaggccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgattttttttt

SEQ ID NO: 383 - DNA, 1215 bp, Homo sapiens
cgtcagttggtcacgtggttgttcggagcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccagtaagtgggcaagaggcggcaggaagtgggtacgcaggggcgcaaggcgcacagcctctagacgactcgctttccctccggccaacctctgaagccgcgtcctactttgacagctgcagggccgcggcctggtcttctgtgcttcaccatctacataatgaatcccagtatgaagcagaaacaagaagaaatcaaagagaatataaagaatagttctgtcccaagaagaactctgaagatgattcagccttctgcatctggatctcttgttggaagagaaaatgagctgtccgcaggcttgtccaaaaggaaacatcggaatgaccacttaacatctacaacttccagccctggggttattgtcccagaatctagtgaaaataaaaatcttggaggagtcacccaggagtcatttgatcttatgattaaagaaaatccatcctctcagtattggaaggaagtggcagaaaaacggagaaaggcgctgtatgaagcacttaaggaaaatgagaaacttcataaagaaattgaacaaaaggacaatgaaattgcccgcctgaaaaaggagaataaagaactggcagaagtagcagaacatgtacagtatatggcagagctaatagagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaa

SEQ ID NO: 384 - DNA, 627 bp, Homo sapiens
  misc_feature 44: n = A,T,C or G
ttttaggacatacgggactctgttttaataagcagctggtaganttagcaaaccatatttcctatgacattgggttctcatacaggtctgcagttcaaaatccaagtttgaaatctgggacggaaggcattctggaaaacggagaatctaataaaatcaatgacgtctcatgttcgatgctggctgtcacggaagggctggccatctgttggtctgagtgtagctggtctcgtgaatcccactcggtacacaatcgctaaacactaaaacatgtcaagcaaagtacatggtgcgcagagtgtcttggtgaacctggaccgccttggccagtgcttggtggtctcgcccgttactctgcccagaggtatggcttccttcagcactgtcatgttccttatccaccaggtggtacctggcccggaaggccaccaggtgagcgtagtatgctggcgctgggatggacacggagcgtgtgcagcgcacgtaggtgtgacacagctggtaggttaggatctgcagctcatcagaggagaaacgattgtcgtcccagacgacgtgatagtgcgaaggcctgcttgtcccctggatgccagcgtgactacacaggtagaagtcgaactcggtggc

SEQ ID NO: 385 - DNA, 1093 bp, Homo sapiens
  misc_feature 600: n = A,T,C or G
gacataaacacacacaggggggggaggacgggtgagcaagcgcagacgtgggtgacacgtggccccgctctctggaccctcagtgggaaaaagtctgaggctggcgtctctcaccaaaccccacctcccctggtgggtcaatactgatctggctgagtgacagcatctcgtgacccaggctggccctgggaaggcgccacaggcgaggcctgcgagtgcagggagcaggcagacgctacagtggcccccgagcgcgccaggagccagcctcgacgtgtaaatggcccgctgcgggcgctgctgggaaggaagacaagaagggtgagggctcgtcctcaccaagtgcttcctgagtgccgtaggacgtgggtgggacatggggacagtgagggtaacacaaacagcaacgaatgcacaaagacaagttccaggaacacccataaacccataacgttcaacaaaatggcaacaaaacgacgcccctgctggcctggcgaggctggcgcttccttcgtggcagaagccacctgcagctggctggctggcaagcgttggccaagctttttggtacctgggagctcaacagcataaaaggctgtnacctctacacggaaaaatttcacatccttcccctgaaactgacttcaggggcaaagaaacgagacttcttgaagaccagcctcttctgggaaaggggcttctgagacgagtgtcgacggcagarcagatggcctggggaaggcaggggtcctgggcagaggctgggagggtggcagagacagggagggccctccatctggtgggtttggcaggtgtgtccctggtgctgccaccaggagccccgaggccggggtgttggctgcgacaccccctcactggggtccggagctggtaatctccattctgcgtgatataacgcacccagggcagggcctggtaccactcttctcaatgatctccaggtagcgcacttagatgcsgrrgtaggtgaagtaagggatctcgaacttgaaactgaacgggggcttgccctccttgtytccggcctcacactagggaagscgagtgggccgcmtaaggtactcytgccgcc

SEQ ID NO: 386 - DNA, 655 bp, Homo sapiens
gggaacaggtggctctgtatgtggacctggacgacgtagccgaggatgaccccgagttggtggactcaatttgtgagaatgccagaccatctccattgccaaggccggcattctcaccacactcaatgcccgctgctccatcctggctgccgccaaccctgcctacgggcgccacaaccctcgccgcagcctggagcagaacatacagctacctgctgcactgctctcccggtttgacctcctctggctgattcaggaccggcccgaccgagacaatgacctacggttggcccagcacattacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctattctgcgccttttcactgctctggcacgtctgagaatggtggatgtggtggaaaaagaagatgtgaatgaagccttcagcttatggagatgcaaaggacttctttttaagagacaaagggcagacaggcttggactcaca

SEQ ID NO: 387 - DNA, 3360 bp, Homo sapiens
gcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttggaaaaaaaaaaaa

SEQ ID NO: 388 - DNA, 613 bp, Homo sapiens
gcggccgccctccatcattggcccaggcgggctctagggcctgctgggaagctgtctggggccctgcgcctgatgagctgccatgaaagtggccgcctctcacactggcaggcggtggctcagatctgctgaggttctggagtggcacaggaacaggaggagcaaatgacactgggtctttgtgctgaggcaggacacagcggctttccgaaacacacacacagaaaatatgactcctgctgccatctcaaggacattttcctaaggacagtcctggtgtcctgatggagtgaaagggatcacacgtgggatgtcccagcagggcctaagccaagtccatcagatgtctcaacggcttatgaaacaaaaacagaggactgaagtctgttcacagtggcccatggttgggcagcagcctgggtgagctcctgtgttctccagcctctcgctcacccagggcttggctatcctggcctccaggtgctggttcctgaggcttcccttgcggcagtggcgcagatacagggacactcatgtcccattgctcctcagaagtcctagcagcagccagactaggggcaaagtaagttttcacagggggaaaaaccccacc

SEQ ID NO: 389 - DNA, 1332 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaa

SEQ ID NO: 390 - DNA, 4494 bp, Homo sapiens
ggcccggccggactgagttcgctgctgtcccggttcctctcgagtcggctccaactgccagcccgggttggcgccatgtacgccgtgtacaaacaggcgcatccgcccaccggtctggagttctccatgtactgcaacttcttcaacaacagcgagcgcaacctggtagtggccgggacctcgcagctctacgtgtaccgcctcaaccgcgacgccgaggctctgaccaagaatgacaggagcacagaggggaaggcccaccgggagaagctcgagcttgctgcctccttctccttctttggcaacgtcatgtccatggccagcgtgcagctggcaggagccaagcgggatgccctgctcctaagcttcaaggatgccaagctgtctgtggtggagtacgacccgggcacccatgacctgaagaccctgtcactgcactactttgaggagcctgagcttcgggacgggtttgtgcagaatgtacacacgccgcgagtgcgggtggaccccgacgggcgctgtgcagccatgcttgtctacggcacgcggctggtggtcctgcccttccgcagggagagcctggctgaggagcacgaggggctcgtgggtgaggggcagaggtccagcttcctgcccagctacatcatcgacgtgcgggccctagacgagaagctgctcaacatcatcgacctgcagttcctgcatggctactacgagcctaccctcctcatcctgtttgagcccaaccagacctggcctgggcgcgtggccgtgcggcaggacacgtgctccattgtggccatctcactgaacatcacgcagaaggtgcaccccgtcatctggtccctcaccagcctgccctttgactgcacccaggctctggctgtgcccaagcccataggtggggtggtggtgtttgccgtcaactcgctgttgtacctgaaccagagcgtccccccgtatggcgtggctctcaacagcctcaccacaggaaccacggctttcccgcttcgcacccaggagggtgtgcggatcaccctggactgcgcccaggccaccttcatctcctacgacaagatggtcatctccctcaagggcggcgagatctacgtgctgaccctcatcaccgacggcatgcgcagtgtccgagcgttccactttgacaaggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttga

SEQ ID NO: 391 - DNA, 425 bp, Homo sapiens
ggattttcagcaggaactttattccaatgctaatggcagacatcaggaaggaggagaggaaccatttgtgcagatcatctagaagaacctggaccattcttgacaagagctgaatacagtgatcacgttgtcctccaaggagcaggggtggggtggggtacttctaggagtcagttttgcaggctgtacaggaagcatggctggggagccctcaagaaactgacaatcacggcagaaggcgaaggggaagcaggcacgtttcttcttaatattcctttgaaattccttatggcgcacaggtagcgtagaaaataactgcttcacgctgactgtggtccctctggggtggggggtagggggttttctgggatgattttcccatcgtgatccaacaccagtcgagtcccaaccttcgccgatacgta

SEQ ID NO: 392 - DNA, 891 bp, Homo sapiens
gatatacggaccggattgttttcgctggcccagtgtccccggagcttgtgtgcgatacagagagcacctcggaagctgaggcagctggcacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtaattctaaagaagagcagaggttagaagtcaaagaacatattcttgaaagttatgatgcattcttttgggtggtaacagatcataaagacattttttacacatcagttaatatgggattattacaatattggctatatcaaaagagaaaacaacaaaaagcatgacgacgaacacaaacctctgttggtggccacgggctcgtgggccccatgcgaagaagcattctctattagacccactctgtttgtgggggcgccgggcggccccatggttgatgtgttaggttgtccaaaaccgctggtcatcaaataaggagggttccccaacagaggagaaacccgggtggcttcaacgaacacaggttgctcgtgggattttccccaccccgataataagaaaacgccgccgggggtggaaacaccgaagatcgtttttgagacaacaatacccacgaatagtgggtattacagagggcacacatgaagggggaatctttaatcacaaggagtagtttcaagggcaccctcgggatataccatgtaccg

SEQ ID NO: 393 - DNA, 572 bp, Homo sapiens
ttttaaatgacaacatttaatgggatgataaggaaataagacttgtgcaagaaaccatagcccactgcagactgttcacgatgtcagatggttcatgatttttttccaggtttgatacagaagaatcagtttgttaaaagaaatgcttctccatctttttcgtagtaatcgtagaccatgcctggggctggctgaatgttgaacacaaggttgctctgctcaacagaaaaagtgaaactgtctgctcgaccaaaaacattttccaagtagaaaagaacatggtcattcttgacttcagtcttcatcacttggcccttgttttcaagctcttcaatggatgacatggttggagtaaatcctgatagcatttttacatctataaccaccatactggatttattgcgaattccagtgtatttgaggttcactgtgaggtcaaaaacagtcaaagagtagttctttactatttccaaggaaagagaaaatccagatgccttcttaggtaggagaacattgtacttaagggtggccgtgataaatgtacaaccgcggtcttccacatctactgtgta

SEQ ID NO: 394 - DNA, 2328 bp, Homo sapiens
acgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggctttgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttccttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcggggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttattttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaaaaaaaaaaaaaaaaaaaaaaaaaa

SEQ ID NO: 395 - DNA, 354 bp, Homo sapiens
gccgaggcccatgcgaactttccactatggcttccagcactgtcccggtgagcgctgctggctcggctaataaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagcaagtagacaaatggaatcctgtgctgaacccgaatcttccaaaaaacagcctacaatctgtgacacacaagatgtgcctgtgcactgagttgatcagagggc

SEQ ID NO: 396 - DNA, 4450 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 397 - DNA, 1099 bp, Homo sapiens
tttcatacccgaccgaattttacgtggtgctgcatttccggtagcgcggcggaaatcggctgtgggagagaggctaggccttgaggagcgaactccggcggattcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggcctgggtcctcccccacctatgggccgaggagcaccccctccaggcatgatgggcccacctcctggtatgagacctcctatgggtccaatggggatcccccctggaagagggactccaatgggcatgccctccggaatgcggcctcctccccctggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttccttacagggccccctcccccgggaatgcgcccaccaaggccctagactcatcttggccctcctcagctccctgcctgtttcccgtaaggctgttacgataggtccttttatctccttgtggcctatgaaactggtttataataaactcttaaagagcctt

SEQ ID NO: 398 - DNA, 893 bp, Homo sapiens
cctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggatacagtcgttccatcagagctggtctgacactcacattatcttgctatcactgtaacaactaatgacaaaagaacggtttgtaataaaaatattagtgtatctaaaaacaaaaaaaaaaagggggggggttaaaatatcttgagggcaagtttagcgtacaggtttggaaaaggggccaaggggggataaaagaagaaggggggttaaagtggatggaaacgtatggatttggagactttgggggaatggaactagattagcggaaaaaggaagaagatatgggaagagaa

SEQ ID NO: 399 - DNA, 3398 bp, Homo sapiens
gttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgataatttgcttatgtcttataaaactcagcataagaaaaat

SEQ ID NO: 400 - DNA, 609 bp, Homo sapiens
tgtgggggaaggggagcctggagaaaacaaagtcactattccctttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggcgggggggctctgttttgttgggatgtgttatgttgtatgtacgcatatatggaccggagtctgctgagtttataaggttccaaaaatatggtaaaatcttggttttgttaatttatctcaataaaagcccactggaactccaaaaaaaaaaacaacacagacaacaaatacccccaaaccaaacaacaagaaaacacaaaacacagcgcagaaattaattgccgcgcgcggcaaaaaaaccgatacaacgaggcccccggcgtaacaaggctccgacggaagcagactactgacgacaaggggaggaacaacgggcgacaccactagagagagagctaaacacacgacaccccgagtctcggctataataagaaaaacaaccagag

SEQ ID NO: 401 - DNA, 2313 bp, Homo sapiens
ccgagccgcagtttccgtgttgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaag

SEQ ID NO: 402 - DNA, 766 bp, Homo sapiens
aacacccatgtcaccaccatgtttaggacatttccagcacccctgaaatttccttcatgccccttcccagtctgtacctacacctctaaatctattttcaatcttaatggccttttaaataactgggcttctcacaaccatagtgaacagaaacagctgggttgtcaacgtctaacctaatacttcaggaaaactcatgatggtttccatgttaagagagacatggagcagggcactggcatggtggatggatcacgcctgtaatcccagcactttgggaggccgaggtagggggattgcttgagcccaggagttcaagactagcctgggtaatataaggaaaacctgtctctgcaaaaaaaaaaaaacaaaagaggttcacccccatttggaaaaacttcccaggcccaggggttagaaaaaatcattatcgggaaattggcatttggcccagggtatttacaaattcggggccactccccattaaagctaccaaggcctctcttccacagcacttgggaccacacctactttaccgtcctcttgggatccaaaaaaaagcccattttgccaagttaactcttaggccaaaaaacctagctggggcgctcccactacccggacttcaaattctgccacagcgttcagtcaccaaccacgctggttctgtacccaagactttcgatctggaaagaaagactcgaaaaaagcgatattcaagactgtcttgcaccgcaaacgcagggagctcctaaccgcgcgacag

SEQ ID NO: 403 - DNA, 810 bp, Homo sapiens
gtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagataaacctaaataagttatcctgttccctaggaccttctctgtaaatagtgaattttagacgagtagtctgtcctaaatcttaaatagaaaaaaaaactaaagcgatttgcttaagccattgtacattataaagagctgttttgttttgctttgctttgctttgttttgttttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaaaaaaaaagaaaaaaaaaaaaaa

SEQ ID NO: 404 - DNA, 379 bp, Homo sapiens
  misc_feature 45, 69, 123, 124, 183, 225, 279, 285, 302, 324: n = A,T,C or G
gttagcaaaatacccatttattaagaaaaagttggtgtcctttgntaccaaaagggaagaaaaggggantaaaacaaatacgtagttactagcaacaaaataagacaaactaatcagaatgcnntttattgacaagatagggtgtcacaaatacatcatttatagggagagaggggacatgancaagtccaaaatcttatactctgcacagcagcccagcagggntgtcctctctagagatggtttatcaagggtaccccatgagagggcagctcctgntgcagntgccggaagagcatcgnacaccggttcctctcctgggtnttccccagggtatggtagagtctggcctgggagtaaacgacgtccctgatgcgct

SEQ ID NO: 405 - DNA, 12783 bp, Homo sapiens
atttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgactaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgtttccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatacttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagcta

SEQ ID NO: 406 - DNA, 456 bp, Homo sapiens
tttaaccaacagtacacttttaattaaggacctgtagctgtgcaggatgcaaacagctgggcatcagtgactttcctcctgcccccggtttgtccctgatggtggcagaagatcccagctgaccacggcccctttctctggggtcagagggagaagacaggcgcagtcagcaggggcagctgttgcaggtgggagggatattttcccacaggaacaaaggtctccatgatgataccggggtctctatagtcatgttgagagcctaatggcccttggcataattgctggtgtcggggtagaaggtgtcttggagtttgctcaagtggttgagagggagggaggtgccatagacttggaggaactggcacgaagccaaggatacaaatccaggcagggctatggggcaggatagagagcagggccttctactgaaggagtgactcaggaaggaggagg

SEQ ID NO: 407 - DNA, 1449 bp, Homo sapiens
atgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccataggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccggaaccaggggctctaccgcctgggcaacttcctcttcatcctgctcggcgtgtgctgcatttactcgctcttcaacgtcatctccatcctcatcaagcaggtgctcaactggatgctgcgcaagctgagctgccgctgctgcgcgcgctgctgcccggctcctggcgcgcccctggcccggcgcaatgccatcaccccaggctcccggctgcgccgccgcctggccgcgctcggtgccgaccccgcggcccgcgacagcgacgccgagggccgccgcctctcgggcgagctcatctccatgcgcgacctcacggcctccaacaaggtgtcgctggcgctgctgcagaagcagctgtcggagacggccaacggctacccgcgcagcgtgtgcgtcaacacgcgccagaacggcttctcgggcggcgtgggcgcgctgggcatcatgaacaaccggctggccgagaccagcgcctccaggtagaccgcccgtccgcccgcgccggggaccctctccaggccgcggggccgccgggcgtggtttgcttctctcagtcactgctggcgctttcttaatctttatccaataaaatgaaacaaaaaaaatttttttaaaaaaaaaaaaaaaaaaaaaaaaaaa

SEQ ID NO: 408 - DNA, 822 bp, Homo sapiens
  misc_feature 566: n = A,T,C or G
aaaaaaaaaagtcctgtggaaatcatatagacaaacatttgcaaagctgctactgccattgtaccagtgttaaactgtgttctaccttgcatcttttactgatttttatgacagattttatattggtaaccattcgagaactctgtaagtgctatggcttccttaaactacgatttatcatatgctcccagtgtttactttgagactgaatggcaaccagagaatgtaaacaaccaaggtgcatctggttatgttttaaaataaagattaataaaagttaaggtaaaaggtctgtgtctgaacctatgcattttttcacctctgaggaggatactaatacctaatgagaaaagctgaaatgtgtgggccgcgggtggcgggtgcgctacatggcgctaatggatactctcagacagcttgaggggagggcgcgcaggcaggtcagaaatcgagcctggaggctcggagaagaattcggagttacccaggggcgtgggaccctaagcgagtggagtggaacacccttgattctcgtgagtggagaggtgtcaccaaaaatattgagnccggggcggactattaggacagaactaccatgatcatatccacgaggtgctaaactggtgcgacaagggtctgaaggcgcagtaaatcagaggcgtggtaacaccccgctaaggagtgggccgtaagtgtcctggcgcctgggatgtccagagaagattcgggggggccaataagggcaagtaacccaggattctggcaggcaacactaacttcagttcgaaccgggttccccggtggcggttacaacacaagccc

SEQ ID NO: 409 - DNA, 1592 bp, Homo sapiens
tacggctgcgagaagacgacagaaggggattaagagggagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctcaaaaaaaaaaaaaaaaaaaaaaaaaaaaaa

SEQ ID NO: 410 - DNA, 1649 bp, Homo sapiens
ccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaaaaaaaaaaaaaaaaaaaaaa

SEQ ID NO: 411 - DNA, 7108 bp, Homo sapiens
gcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcactgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 412 - DNA, 559 bp, Homo sapiens
  misc_feature 510, 532: n = A,T,C or G
ctacattttgtttattgagacaaactaattaaaaggcacaaacatagggcatgtttacatggacattataacaaacatatacattaaaagtgtaggaatgtgttgccttcctgctaaacagaaagttcctaagcttttatatatacaaaagttgtacaatttaatgtcctaaagtacaaaagatcatttataaaattattttacactaagtactatttattttatttttttactatgtagttcaaccccctagaactgttttgtataatgacacacagatacctgtccctgatgtaggaagtctgtctcagatgcaaggtattttgatgcttgaactgacacagtagggtataaatggaaatcatccagtttgatagtcagtcctgcaaacattctgcaagattaacacaactaatttccatttctcttaactgcaatggattaaaaaatgaaaaaaaacccaaaaccatattggcaacttaaaaaaatcacagcatcttgggttaagtnaattttttttttaacgcaatgnttttaaaaccatgcgtggcatgaaggg

SEQ ID NO: 413 - DNA, 655 bp, Homo sapiens
actagtggatcccccggtctgcaggaattcggcacgagctcaaatattccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttcaaaaaaagaaacaaaacgaaagctggacatatatgctaaaaaatattaaccttggggggggccccgagcccaaatgccccttaagggagatggtataaaattcaacgggccttgttttaacaccgtctggatgggaaaaccctgtgttttaccaactttatcggcttggaagaaaatccccttttcgcaagtgggagtattaccaaaaagccccgaccgtttcgccttcccaaacatttgcccaccctgatgggaaatggttgagctttttt

SEQ ID NO: 414 - DNA, 1170 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacgctcggaaaccgccagacaccaaggctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagaactcgagtacagaacctgctaaggccatcaaacctattgatcggaagtcagtccatcagatttgctctgggccggtggtaccgagtctaaggccgaatgcggtgaaggagttagtagaaaacagtctggatgctggtgccactaatgttgatctaaagcttaaggactatggagtggatctcattgaagtttcaggcaatggatgtggggtagaagaagaaaacttcgaaggctttactctgaaacatcacacatgtaagattcaagagtttgccgacctaactcaggtggaaacttttggctttcggggggaagctctgagctcactttgtgcactgagtgatgtcaccatttctacctgccgtgtatcagcgaaggttgggactcgactggtgtttgatcactatgggaaaatcatccagaaaaccccctacccccgccccagagggatgacagtcagcgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgtagaactgactcctagaagtaccccaccccacccctgctccttggaggacaacgtgatcactgtattcagctctgtcaagaatggtccaggttcttctagatga

SEQ ID NO: 415 - DNA, 879 bp, Homo sapiens
aatgtgaaattttgcctctttaatgttaattcaaaactatatcaatgttttcttgtcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgttggtattgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtcttagctcaagttcaaccttaaaatgatgttagacaacaggtcccagtcagttccctctattttcagccaatttggctcacaagccatattggcccgattagtggtactgtctgactcacgtgtgtgatccaaataaaggtagctgctggaaaaaaacagaaaaaaagaacacacacaaccaagcgcgagcgaccaccagaaagaatcaccaagagaggcgcccaacacaaaggccatacacaagggattattgggtacaaagacgagccccacaaagagaagaccgaataataagcaaagcacatgaccacataacacacaacgccgatacgagagcaaaatgaaactgcgaaacactgcaacagaacaacat

SEQ ID NO: 416 - DNA, 890 bp, Homo sapiens
ggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 417 - DNA, 1584 bp, Homo sapiens
cgggatgcggcgcgccgcgcgttgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagccccggacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctggcacttgctgatgcg

SEQ ID NO: 418 - DNA, 1244 bp, Homo sapiens
gccgctcctgccgtgcatgttggggagccagtacatgcaggtgggctccacacggagaggggcgccgaccccgtgatagggctttacctggtacatcggggtggcgcgtgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgcagaactgactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatcc

SEQ ID NO: 419 - DNA, 951 bp, Homo sapiens
attggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaacaaaa

SEQ ID NO: 420 - DNA, 553 bp, Homo sapiens
  misc_feature 488, 549: n = A,T,C or G
tgccagcatttccctttatttctggatggaaacggggccctaaaagcagaaatcaatatttttgtttgaaagatgcagtcatgctaatttcacttttggctaaaaccgagacgataaaagaacagttgggtgtttataggatgccctcaaagtgagctggctaagtgagctgggctctaacttcactcacaaatttatagtacagctaagaaggccagtctgtccatgaaagggagccgagacaagacgagggcggcctcttccaggcctgtgccaagtgtccttggggtcccgccatggtccacacttctgcagcatccgcagaacatgtggccggggtcctgcccagcagcagggacagcccaagtggggaggcaggcatggtgcacaccctggggaggcccctgggtgcagaagcagccccacagtagcagccccatccagaggaagaccactcccgaggggccacagccttcttgcagcccctnggaattgccgcccaacccctccattttcagcgggatgtttcaagggtgagacaaggaattnaggg

SEQ ID NO: 421 - DNA, 565 bp, Homo sapiens
ataacagagatacaggtttttatttttccatcatgcatgcaaacttacaactatttatactgtttaagaacacagaaataattgcgttattaacagggtgtcaaattaccaagtagaacaaccagttactaattattttggggaggttattttcacagaacacagcaacaatttccaaattattcttccaaaaccagagttatgagaccagtacaagctgataacaatgctaatggtcacacaagtttccatgttacacagaaaaaaagattgacattctggtgaagggtctcaagtaccttaccatatcagaatttttgaaagagttttacaacagaacagtctctctcttgttttgtagatgcaagggaaaggaagcatccctctcatttctttttgagactccttgttaattcttaaaacacatttctaaggcccatctctggaacttcattagttaacattaaaagcaaaaagcagacctgatgtgattatgatagtgcaccccatcactatcaccatcaaaagagactaccaatctcccaaagtagtcacggttgcattg

SEQ ID NO: 422 - DNA, 1663 bp, Homo sapiens
gtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaaaaaaaaaaaaaaaaaa

SEQ ID NO: 423 - DNA, 2576 bp, Homo sapiens
aattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 424 - DNA, 102910 bp, Homo sapiens
tacaggcatgagctaccgcgcccggctaatttttgtatttttaatagagacgggtttcaccatggtggtcaggctcgtttctaactcccgacctcaggtgatccggccgcctcggcctcccaaagtgctggattacaggcgtgagccaccaagtccggcctctcatactgcactattttgcttattaatcttgcttcttgtcctccttccccactagaccgagggctccacggcggctgggacacagtagcagatcaataaatatttgctaagctaattaatggcacttgggaagttttgcagagaaggcggccacggtcgggccccgccttgcctccccaaataggcctcgccgccccaggtcagggatcaaagcggttcccaggcgcgcccttggcccgcgggaaaccactgcccggtcttggtccaggcggcccgtcctacggtccagggttcctatttccgagcctcagggacctcctttccccacggaccccacggccaccgggatcccattctccagttgccccatcgtcaccgcggccgccgccaccgccgccgcagtggcgtccgctctgcgcatgctccggggcgtcaagacgcgaggcgtgcagaaggcgaagcgtgcgcaggcgcggggccatcgcggcccgagtggggcggtgcatcggacgcgcgtgcttcctccgggccacgcccacccccgtccgcccagggacgggcgcgcacgcgcgccgggagcggaagggcgggctggcgcgcgcacgaggccgggcaggcggcggaagctggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctggtaaggaacgcgggccgcgggggcagcgcggcgcggggccggggagggcggtttgaatggagccggggcgccgaggggggagggggctgccggcgcgccctgtgcggggccggggtacggcggcgcccgagggtcaagaagcccagccggcagccgcgcgcgtggggaaggccacagtgtcgcgaggccgtggcagcggcggcccccgcggagcggcggggtgggtggggggcccgggccgcgtggaggccgcgcgatcctctccgcgcgcgctctcgccggggtcgccggacaaagctcgcccccctcgcccggcacccctacagtcgccctcccaattacagcggctgcaacaataggcaggcgttggggcttttctggctgcgtggtaacgggtccgacccgaatgttgcgtttttggcgaagctgcgatcggggctcagccaaacctccagatatgtccggcgtcggccggacacgggcattagcggtccccttgggctagccgacctcaaattgtcttaaaaacgtgtcattccagattttcaaggaaaggtaaaggactcccccgatgccttgcagttagtgacttcaaaatgtttgcccgaattggggttggggatggggtcggcggcaagtaggggagcacggaggaaatcctttgctgtgtaaaagcattgcttttcttttgcatccttttttctccttcccaattggtttttcagattaaggcttttattttcaacgtggaccttttgggcgagtgttttgtcccgatcttgaagataccagtcttgattttttttttttttttttttggtcagtgactccttggggaaagtagcaagggaataagcggaaaagccgcttcgcaggaatttgaagcaagttttcagtttggattgataggctgcattcaagcttgattcctggtgctgtcagtcacttagcacactgtcactttagggaagtggcttaacctctctgaacctcttagttttcctcctttgtgaaagctcctttgtgaaagggggtaatctcccaaatggaattggtgaaagcctgtaaaatggttcctcgcaagcgggaagcactattgtaattgtctggtccaatctccctcattgttcagcagataacttcttgaggccctactaagtgttggatggtcgggggttggatcctggagcctctgcagtcttggaggggagcgggtggtaaatgtgggaacaaactctcttggcctatcgtttattgctctgaacctgcactgtgagagggacacagcggacaggcaggggatcggtggtagccagagatcacgggggctgcttggaagagggggcctcaaaatcagggagggtgtgtaggattgtattttgtttttgaggcagagtcttgcctgtcgcccaggctggagttcagagtcccaatctccgctcactgtaacctccgcctcctgggttcaagcgattctcctgcctcagcctcctgagtagctgggactacaggcgcccgccaccacgcctggctaatttttgtatttttagtagatatggggttttaccatgttggccaggctggtctcaaactcctgacttaaggtgatccacccacctcggcctcccaaagtgctaggactacatgtgtgagccactgcgccaggattgtattttgactttccctggccacctcggactagccattgttcccctcagctacattcatacatcaacttggtcctttccggtgtagctgtcacccccagcaccgtgagagctggggttgtgtctgcctggctggccccacagtaccctgggcctgacacatagtaggtctttagcgaacttatgtggattgaatgagggggtcctgtggaagatcgcgtgaccatctgtgtaaaaggcttggtgcagggccaggtgcagtggctcatacctgaaatcccagcacttggggaggctgaggcgggaaaattgcttgaacccgggagtttgagactaacctgggcaacatagtgagacctcatctctacaaaaaatacaaaaattagccgagtgtggtggcatgcaccggtggtcccaactactcaggaggctgaggtaggaggactgcttgagccagagaggtggaggctgcagtgagccattcttgtgcccctgcattccagcctgtgcaccagagtaagactgtctcaaaaaaaaaaaaaaaaaaaaagaaaaagaaagcttggtgcaggactgggggtggattgtaagggatacaggttagttgtttgaacagtttttgcactttccaagccattgtttcctgaacctcagttgtcctcatctcccctacaaagtgtggggtggtggttagcgtggggtggtggtaaggagtactcattctggaatcagacctcctgaattcacacccagctctctaaatcgtagcttaacctcaagcgaggcgcttagcagtagggccccccacttgtgaaacaggtaggacgaggatgcccgaaacttcacaggcttcttgtgagggttgaatgaggtcacatgggaagccgctaacacactgctgcacctgatgcgtagtgaacacttgattttttttttttttttgagacggagtctcgctctgtcatccgggctggagtgcaatgcccctgtagtcccaagctccttgagaggctggggcaggaggtacaggctgcagtggaccatgattgagccactgcactccagcctgggtgacgaagcgagaccctgtctaaaaaaaggaataaaaattaattcatgcatagttaggaaagtaataaatggttttgcatgggccacctaaaatcattttgtgtccagccctttaggagacgtaaatgttgatcgtgcaggcttttgagcaggggaggtgatgtcatcagaattgtgatatagggcagtgcagtggtctctaaacttcttgtcagtgaggagcattccaacatatgtgtatttatttacaatttatttgtgtacctttgcttctccttgggaaccctcaaaacaccaggagataaccttagaccattccatgttttggctgtttgtgggaggtgggagcatgggagggactagggttttgggcagatgtctggtggaactttctttctttctttcttttttttttgagacggaatcttactcttgttgcccaggctggagtgcaatggcacgatctcgtctcactgcaacctctgcctcccgggttcaagcgattcttctgactcagcctcctgagtagctgggatcacaggtgtgcaccaccacacctggctaagttttgtatttttagtagagatgggatttcatcatgttggccaagctggtcttgaactcctgacctcaactgatccacccaccttggcccttggcctcccaaagtactgggattacaagtatgagccaccgcgcccggcctctttttttttttttcttatgagacagagtcattctgtcgcccaggctggagtgcagtggtgcgatcttgactcactgcaacctccgcctcctggtctcaagcgattctcatgcctcagcctctggagtggatgggactaaggacgtgcaccaccatgcccagctaatttttgtattttagtagagaccgggtttcaccatgttggccagaactcctggtctcgaactcctggcctcctgtaatctgcccacctcggcctcccaaagtgttgggattataggcgtgagccaccgtgcccagccagtctggtggaactttctatcagtaaggaaactgaggcctagggttattttctttccacaagggttgtcaagtcaaccacctgggtttgactcctggttttgtctttccatccctcggtcatcaaggctgccatggcacagaaggacccattcatggtgcctgtagacagaacacaatgtgaatagtgccccctggagttgtgcaagaaatgacccagccactcttccccatttatgtggcgaacaagcatgcattgagcgcctgccatgtgccaggcactgctggggagctggggattccatggggaacaggcagacaagggtcctgttcttagtagctcacaccccactcttgacttgcaaagggggacagtactagtacccagcttgtaggattgctgcaagagctgaacaaccagtgacaaatgcgaagtgcttagaatggtgcctggcacatagtgctaaacagttgttagtgctcatcatttattaggattcctgcaacagcctggtgggatgacacagataatatactttttcctctagtcataagttctgtatgtttcaaagtggtagcaaaggagtcagctcctccattttgtccttaatggctgcacattgtttaacagcagggatgcattctgaggaatgcgttgtgagatgattttgtggttgcgtgaagatgatagagtgtgcttacacacgtctagatggtggagcctagtccacatgtaggctctgtggtatagcctattgttcccaggctatacacctgtacagcatgtcactgtaccgattattgtaggcagttgtgacccgatagtatttgtgtatctaaatatatctaaacagaaaacgtatgggaaaaatacagtattatgatctttaaaaaatttttctaattagacaattcaaggaggaaggtataatcttatgggactattgtatatttggtccatcattgaccaaaatgttatgtggtgaagaaaaccatgctttgaaatttcaccataaggcattggaaaagggagagtgtgtttagtggcatggtttttttttttttttttttttttttttttgaggtgaagtttcgctcttgttgcccaggctggagcacaatgatgcggtcctggctcactgcaacatccgactgcagagttcaagcaattctcctgcctcagcctcccgagtagctgggattacaggtgcccgccaccatgcctggctaattttttgtatatttagtagaaacggggtttcaccatgttgaccaggctggtcttgaacttctgacctcaggtgacccacctgcctcagcctcccaaagtgctgggattacagacgtgagctaccgcgcccggccaggtttttaaaaatatcaaatgttcagccgagtgtggtggctcatgcctgtaattcccacactttgggaggcccagcagggcaaatcacttgatcccaggaatccaagaccagcctgggcagcatggcgaaaccccgtctctacagaaaagttaaaaaattagccaagcatggtgttgcacacctgtagtcccagctacttgggaggttgacgtgggaggatcaagccgaggaggtggaggctgcagtaagctgtgatcgcaccactgcactccaacctgggtgacacaacaagaccctatcttaaaaaagccgggggttgggctgggcgcggtggctcatgcctgtattcctagcactttgggagccgaggcggcggatcgcctgagctcaggagttcaagaccagcctgggcaacattgtgaaaccccgtctctacgaaaatacaaaagaaattagctgggcatggtggtgtgcgcctgtagtcctagctacttgtgagactgaggcaggagaattgcttgaacccgggaggccaaggttgcagggagccgagatcgtgccgctgcactccagcctgggcgacagagcaagactacgtctctacaaaagaaaaaaaaaaagccgggggttgggaaggataacagctgctggaatactgggggaaggtatgagagggaacaggtcagaatgaagcctgaggctgaatggagcttcaggtgctgccaccctcataggtgtcaaccctaaggagacatagcggactcattagtatgcccagtgatttcttgattgaagttttctgttaactgcatcctaaggacattaatcattaatttttcagggtgtgggattgatgggcatgtgatttgtggcctcaactcttcttcatatatgggaaagggcctggatggaagtgccaggtgtagctgggtttgttgttacagggcagagagaagggacacattgatttccctccaattccctcagggaagggggctttcttgtttttattttattttattttattttattttttgaaatggagtcttgctctctctctgtcgcccaggctggagtgcagtggcacgatctcagctcactgcaagctcccccttccgggttcacgccattctcctgcctcagcctcctgagtagctgggactacaggcgcccgccaccacgcccggctaattttttgtatttttagtagagacggggtttcaccatgttagccaggatggtcttgatctcctgacctcgttatccgtctgcctcagcctcccaaactgctgggattacaggcgtgagccactgcgcccgactggaagggggctttctttagaaaataggtaaatgttagtagggtggaaaccaaccctggcccctttcaaatgtgtggtttttttttttttttttggagacagttgtactcttttctcccaggctggagtgcagcggtgtgatctcggctcactgcaacctctgccttccaggttcaagcaattctcctacctcagcctcctgagtagctgggattacaggcgtgcgccaccatgcccggctaattttgtatttttttttaatttttatttatttatttatttttttgagacggagtcttgcttagttgcccaggctggagtgcaatggcacgatcttggctcactgcaatctccgcctcccgggttcatgccattctcctgcctcagcctcccgagtagctgagactacaggcgcccaccaccatgccctgcgggggtttcaccatgttagccaggatggtcttgatctcctgacctcatgatccgcccgcctcagcctcccaaagtgctgggattacaggcgtgagccactgcgcccggccagtaattttgtatttttagtagagacggggtttctccgtgttggtcaggctggtctcaaacttctgacctcaggtgatccgcctgccttggccttccaaactgctgagattacaggcatgagccaccactcctggcctcaaatgtttttttaagtcccagactggtttccagagctttgcttttggggactctgttacctccctaaaggggcatagcttcatttatgtatgtggacacttgtcactgtgaaccgttttgctctgtgtgcagccagctgtgagtgtgatagagtagcacgggccccgtttttaatagtgatcgactttaaaatggttctttgaggaggtgttttttttttctttccactttttatttttttagagacggagactcgctgtgttacttaggctggtctttaactcctggactcaagtgatcctccagcctccacttcctgactagctgtgattacaggcgtgatccactgtgctagctcttgggagttttttaagttttctctttgccactggcaagtcacgccccagtggctcaggaagcaggtggctgatgtgacagttgctgctcacctgttccagtgggagacttgagggggagggtctgctgtgtgcgacccatcttgctccgaaagtcccagtaaaggggcatagtggatgtctcattgtgcccagggagctgaaactgcccctgtgatgatcaaatgtgattctggcacagcctggactggctgggcacctgaaggccttgcctgcctcctggaggcatctcctgggtgcctgtgggagtggctctttacttgcccttcctcttgactctgcccttcctcgaccttcaaggttctcatcctattccttttgatcctcggcctgaatcagttactcaggccctggagtcaaagagacttgaggcgggattctgttctgcatggcttaacctctttgaactcagaattccgttttcctctcagaatctccctggcctccaccctctacctcaagaaccaggggctgaaccccggccctgcctgtctttgccaagccttgctctagggcttggtcagcctcgaggaaggggggccttgttatgtttatttaaaaatttatgttttaggttttactttcttagaagtggaggtcttgatgttatctcccaggctggtcttgaaccccttggctcaaaggatctgcctacttcagcctcccaaagtgctgggattatgggcgtgagccaccacgcctggcgcctttttatatttctttcttttttttttctttttttgagacagagtttgtctcttgttgcccaggctggagtgcaatggcggggtctcggctcactgaaacctccgcctcctgggttcaagcgattctcctgcctcagcctcccgagtagctgggattacaggcatgcaccaccacacctggctaattttgtatttttagtagagacggggtttctccgtgttggtcaggctggtctcaaactcctgacctcaggtgatccacctgcctcagcctcccgaagtgctgggattacaggcatgagccactgcacctggccccctttttatgtttctaacagcacgtcccagccgagaccctggtgttcacccttgcctcatctcttgccctcacttgcacatccattccatcagcatgtccagagaaattaaagtcattatcagaccgtgccactcccgtgcctggaacattctagcagctccccactgcactggatgctcctggaacccctttactgtggccctcaaggcctgtgacttctcccctatgccccacctgtggccgcacccacttgccctctgaggtatgatatggaatatatttggtctttgcgccacatgtcataggagtgataggtgtgtcttttaaaattcataatgagccccttttgatcacagctgagtttatgcttatgaggtgatttaggatggggctcctagatagcccaggatggggctggttaccagaaagaccaagtgcttagagggtggcatgtacggaggggccattgaagctgtctgtattgcttccatctggttgaccccgagtcgtatccgttataataaaccattaatgggaagtgaagtgcctgccttagttctgggcgctgctttagcaaatcaatcaaatcgaggagggggttgtgggaattcccaatttataggtggctgggcagaagtactggaccctgggatgtgcaaatggcatttgtagtgggagcagtcttatgggacagctctttttcttttagagacagagtgtcactctcacccaggctggagtgcagtgatacagtcatagctcactgcagtgtccagctcctgggctcatgtcatgctcccgagtagctgggactacaggtgtgcaccactgccaggcttagctaatttttaaattttttgtagagacagggtgctatacttcctaggctggtttcaaactcttggcctcaagcagtcctcccactttggcctcccaaagcactgtgcttaggtgagcccactgcatctggccgataaagtccttaacttgtgggagatagagtctgaattgagttaaattgtaggacacccagctggtgtttggagacttggagaattacttggaaaagacccacgcatctggtcacagaattgttctcggttatgagagtatagtagaagaaaactggttttctctgagttggtgtcaaaagtgctgtgtgagagtgtagagaaacggagtgtgggccaggcacggtggctcacgcctgtaatcccagcattttgggaggctgaggcgggtggatcacctgaggtcgggagtttgagaccatcctgaccaacatggagaaacctagtctactaaaaatacaaaattagctgggcgtggtggcgcgtgcctgtaatcccagctacttgagaggctgaggcaggagaatcacttgaacccaggaggcagaggttgcagtgagctgagatcgcaccattgcactctagcctgggcaacaagagtgaaacttcatctcaaagaaaaaaaaaagaaacagagtgtgttttcccaccttccctgctccagccacactggctgacttgctgtgccttggaatatgccaagcacagtccagggcctttgcacttgctgttcctctgtggtagataaataaccacatggtgcccatgtcactacagatctctgctcagacatcttcatcactgaggtgtcccaggctaccatagaaggagtgcttctcatctgttaaccctgcgaaccctgcttgattagatttatagcacttccaccctctatgtgacattgtgtcttttttttttttttttctctttgagacaaggtcttggtctgtcacccagcggggagtacagtggtgcaatcatagctcatggcagtctggaccctcccaccttggcttcccaagtagctgggactacagccgcatgccagctaatttttgtatttttcgtagagacgaggtttcaccgtgttgcccaggctggcctcaaattcctggcctcaagtgatcgacctgcctcaacctcccaaagtgctggaattacaggcgtgagccaccatgcccaccctgaatactttttttttttttttttggaggggggagatggagttttgttcttgtcgcccaggctggagtgcaatggtgcgatcttggctcactccaacctccgcctcccgggttcaagcgatttcaattttcctgcctcagcctcctgagtagctgggattacaggcgtgcaccaccacgcttggctaattttttttttttttttttgagacggagtctcgctctgtcacccaggcttgagtgcagtggcacagtctcagctcactgcaacctccgcctcctgggttcaagcgattctcctgtcccagcccccacaccgagtagctgggattacgggcgcctgccaccatgccggctaatttttgtatttttagtagagatgagttttaaccatgttggccaggctggtctcaaactcctgacctcaagttatccactcgtcttggcctcccaaagtgttggaattacaggcatgagccaccaagcctggtcctaatttttttattattagtagagatggggtttcaccatgttggtcaggctggtctcgaacccctgacctcaggtgatccacctgcctcggcctcccaaagtgttgggattacaggcatgagccaccacgtccggccctgaatacttttttttttttttaatataacacttccactttctatgtgacattgtgtcatgtttggctatttctgtcactctgctgtccactcctccaggtaggaattgtgttgttctctgccagatgcctggtgtttggaaccagcttggtgcattcagcgctgttcgtatttgggggtagtcatcagtaagtcctctgctgtggcggtggggaaggcctgtcacgagtgacactgggcaggtatggattctgcatctccctgcccactcttggcctttgcatgcctctgttgtggggactcctcttgccgtctccacacagtgtcactcctcacgctcagtgttgcgtatatagctgataacacagcagacccggtggtggcgcaggacatccatccagtgggcctcggccagccgaaaagaaagaataggggccgggcacagtggctcacgcctgtaatcccagcactttgggaggccaaagtggacggatcatcggctcaggagtttgagactagcctggccaacatagtgaaaccccatctctacaaaaaatacgaaaattagctgggcatggcggtgtgcgcctgtagttccagctacttgggaggccggggcaggagaattgcttgaacccgggaggccgaggttgcggtgagctgagattgtgccactgcactccagcctgggtgacagagccagagtccatctacaaaaaaaaaaaaaaagaatggggttattgatgttccacagggagcgtgggtcaggatggatttgtgacacttgatgcggttactctgcgtgttatgtttctgctgggtcacattgtcacatggagacatgatcagaagagcttgaaaaacatccatctaattgatagctaggatagcatttgcaggcttgcagtgtagacaccacacgtccctgtggggttagaggacactcccctaaggcagagaaccgtcctggatgcttttaggtcccttgggtaggtgctcttaagcggttttctttttttttttttgagacggagtctcgctgtcacccaggctagagtgcagtgatgcaatcttggctcactgcaagctccgcctaccaggtttacaccattctcctgccttagcctcccgagtagctgggactacaggcccccgccaccacgcccagctaattttttttttttttttttttgagacagagtcttgctctgtcacccaggctggagtgcagtggcatgatcttggctcactgcaagctccgcctcccgggttcacaccattctcctgcctcagcctcccgagtagctgggactacaggcgcctgccaccacgcccggctaattttttgtatttttagtagagacggggtttcaccgtgttagccaggatggtctcgatctcctgaccctcgtgatccacccgccttggcctcccaaagtgctgggattacaggcgtgagccaccgcgcccggcctggaggttttcttatagaccaccgaggggaacattttgttttgtagttcacgcatagtaaacggggctggctctgcggaagccatcctgcccattgctgttgttccgcccaagcctctgccataacctgactcccacgttggtctgctgctgaaatgtgtccgtgaacaaatttccccaagccccaaaaaacacaatagcagatatcctgggaccaaacttaaatataatgctagtttctcatgcaaggtgaaaacaaccaccataattccaacaaacagatttccaagggatccgattgctggttagcaacctgccctgcctggggctggtcaccgcagtgctttaagacaaaagctaggggtggcgtgaaagaagagaccagacctcttctcttcctcaagcagtctccttccacatttgaacgtcaacagatgtttctattttagatgataattttgatgaagttgaaaataatgagaacatggtagttctcacatcctttgatctttctcttttatttccacaaagacacttcctgggcatttcttgtgggtatttatttcatgggtattctgatttaggctttttttttttttcttggaagtttttctttaaaaatctgaatataaaaagtaatagatggctattgtaaaaaataaataaaaagcgccagacatctgtgatatggaaagggtaagttcctcatcacatgccatcagagagagctactggctgtgctgacagcggtttgtgcatgttttctttggggtaatttctatgcatggattaacatgcatatatatatatatatatatatatttttttttttttttttttttttttttttttttttgagacagagtcttgctctattgcctgggctagagagctgtggtgcgatcttggctcaccgcaacctctggctgctgggttcaagtgattctcctgcctctgcctcccaagtagctgtgattacaggtgcccaccaccacgcctagctaacttttgtgtttttgtagagatggggtttcaccacgtttgccaggctggtctcgatctcaggtgatccgctcgcctcagcttccgacagtgctgggattacagctgtgagacaccatgcccagccatatgcatatatagttattcttttttttttttttttttttttgagacagggtctctgtcgctcaggatggagtgcagtggcgtgatcttggctcactgcaacctccgtttcctggttcaagtgattatcgtgcctcagcctcctgagtagctgggactacaggcatgcaccattacccctggctgacttttgtatttttactagagatgggattctgctatgttggccaggctggtcccgaactcttggcctcaggtgatctgccttccttggcctccaaagtgctgggattataggcattaacaccatatccaaccttacttttttttttttttttttgagtgtttctctgttgccaggctggagtgcagtggcgcgatcttggctcactgcaacctccacctcccgggttcaagcgattctcttgcctcagcttcccgaatagctgggactacaggccagctccaccacgcccagctaatttttgtattttagtagagatagggtttcaccatgttggccagggtggtctcaaactcctgaccttgtgatccgcccaccttggcctcgcaaagtgctggaattgtaggcgtgagccaccacgcccagcctctcaattcttttttgatgtgccaagacttctgcagcgtgggttgtgtgggggttctgattgctgggcaattgaggagcttctcaagaaattgaggcaatatggccacaccacttctagaccctttggcccagggaaagggttaacctcctggacttttaactgagtgttttacatcttagcttttagattcttgtgccagagtagtttcacttccggtcattccttctggctgctggcctggattcccaggctctgttttctccttgtggaggccccggcagcacccgatccaagggccgcacacatctggatttggcttccacacgctgtactaactattcttgcccttttggcccctgaatcccctcatcctttgctttttccacctgagtaggtgtggcctcctggtctgcaatggatttcattgctgcgtgaatttcccctgctagtgacttatcattgagggccccattgcaggactctaagcggcaccgtgtaagacaccttagggacgacctttggccaccccaggactttgctgaaaatgccaaatccttcgtttcctgtatagaagggcagggatgattggcgatggggtaagaaggggtagagagagaggtgttccttgtccttagacacctttcctggccgtgctcgtttggccttcccgtgtagacatctcgccggagcaaggtgcacccagccccacaccccatccagcttctacagggctggcctcaccccagcccttcagggagggtgagctggccaggaggaggttgagggctgagaacaacaccatgcttatggctgtgggagcaaggagggataagagatgtttgtgggtcaggcactgtggcttgggctaggtgcggtggctcatgcctgtagtcctagcactttcggaggttgaggtgggcggatcacttgagcccaggtgtttgagaccagcctgggcaacacggcgagacctcatttctataaagaaatacaaaaattagctgggcatagtggcatgagcctgtagtcccagctactcgggaagttgagatgggaggatcacttgagcccagaagttcaaggctgtgagctgtgatggcgccactgcattccagcctgggagacagagcgagaccctgtctcaaaaaaaaaaaaaaaattgggccgggcgtggtgcctctcatctgtaatcctagcactttgggaggccgaggcaggcggattgcctgagctcaggagtttgagaccagcctgggcaacatggcaaaaaccctgtctctactaaaatacaaaaaaattagccaggttcggcagtgtgcgcctgtagtcccagctactcgggaggctgaggcaggagaatcgcttgaacctaggaggcggaggttgcagtgagccaaggtcgcaccactgcgctaagcctgggtgacagagcgagactctgtctccaaaacaaataaataaacaaataacaagaacaaaattcttggcagccggccaaatctgtgtgcattgcttgccagggtgggcgtgtcatggctgacagcaggtcctggatcgcacctaggggtttgctgctctccagccagctgcttctacctgatgcgcgcccaagaggggaagccagtctgttgttcctgagcattgcggggcaggagtgttacctgcggtttgtgctggggggaggctgcgttacggactcgagtttttttttgttttgtttttgttttttttgagatgaactcttgctctgttgcccaggctggagtgcagtggtgtgatctcggctcactgcagcctctgcctctcgggttcaatcaattctcctgccccagcctcccgagtagctggcattacaggcatgcaccaccatacccagctactttttgttttttaagtagatacggggtttcaccaagtcggccaggctggtgttgaacttctcacctcaagtgacccgcccgcctcggcctcccaaagtgctgggattacaggcatgggccaccatgcccagcccatgactcagttttctcatttctgttcagggaaaggagcctctgcttcacattttgatgggagcatctgaggacctcatctgtgtgatgctcctagtgcgatacctttcacgtgctaagcagctgctcagtaaacctggggagagatggggcaccttggtttcaccagctgagcggctggcacttcctgcctgtgagtgatggttcgatgttccagcctgtggaggaggaggtggagccacagggaggttacccgtgaggcaggtggcaccgtggcttcacagtccatgttcagagtgtgggatgcatggcagtgagttccactgtggccttggccttgtgacctgaactcttccacttccctgtcatctgtcagctggccagcaggaccactgtagtccctgtgtggtggtgagggcccagtgcggggagtctcagttgttaccatcaagtaggctgaggcccctacctcctggctagatcttccttccttgccatttctttgtgactgagacatcctcagcagttgtaaatcacagggaggtgaaggcaagccacagtccccgctggatttgcaaatatcccttcccttcctctgtcagcatgaccttacggtagacgaggatttcttaaataggaccccagaaatgttaaacctcaaagaccaaacttgatgaactggccttcattagaattaagagcttctctctctttttttctgtttgttgagatggaggtttactcttattgaccaggctggagtgcagtggtgccatctcggcttcactgcaacctccacctaccgggttcaagtgattctcctgcctcagcctcctaagtagctgggagtacaggcgcttgccaccactcccagctagttttttgtaattttagtagagacgggttttcgccatgttggccaggctggtctgaaactcctgacctctgcttgcctcggcctcccaaagtgctgggattacaggtatgagccatcaagcccggccgatactttctactttttaaaagtgattcccggccacatatgtggtggctcgtgcctgtaatcccagcacttctggaggctgatgcaggtggatcaggagttcaagaccagcctggccaacatggcgaaaccccgtctctactaaaaatacaaaaaatatatatatatatatattttagccaggtatagtggtgcgtgcctgtaatcccagctactcgggaagctgaggcacgataatcgcttgaacctaggaggcggaggttgcagtgagccgagatcacgccactgcactccagcttgggtgatggagcaagactctgtctctaaataaataaataaatagatagatagatatctcaatagccagtaagcatacagaaaggtgctccgtgccattagttgtgagggacatgcaaatgaagaccataagaagatgcgattggacattggcaacattgttaaaagttgtaaggactgacagcagcaagtgttggggttgatgaagagcacctggaatgctgtccctgtgtgggaggtgggaccgtgtgtgtagatgatacaactattttggaaaactagcaaagctaagtttatgcctccctttataaccaccagtttcattcttggacacccaagaagaaccaatgcatgtgttcaccaaatgactctcatagcagcttgatttgtgctggccagaacctggtagagtacaatgtctatgaaaatgagaatgctcacataaaaagaacggatgactctcccagacatggtgaccctgtgtgattgtcttttttttttttttttgagacagggtctttctctgttgcccacgatcatggctcactgcagccttgacctcctgggctcaaacagttctccctactcagcctcctgagtataagctaatttaaaaaaaaaaacttgtagagacagggtcttgctatgttgcctaggctggtcttgaattcctggactcaagcgatccttctgccttggcctcccaaagtgctgggattataggtatgacccactgcccccaacattatattatttatatgttacatatattatatgttataagtatatattgtatattatataatatatgtattatagacgtgacccaccacacccgtcattttattggaagttcaataacaggtgaaaggaagccacagtgatagtcaaaatagtggtttccctgggagagtggtattgactgggggggcccaagaatgccttctggaacgtcaggagggatgtctgacgcagtgttcttcaagctgttcacctatgatcctgcgatcagggcatgtacaagtcagtgagagtaagcagaatcacacgctgctcccctcagtactgagctgaggacgtggagtcgctccacggctctccactttgtgctgcaagtcggccagtgcttgttcaagtgcaggcaccagcaacctcatcacaggctttggcactgggcgatactgctggggatggctttgcatcactcccgggctgttgggatcccctttactgtcactctgcacgtgtctgagctttcaatccggaaatgaatttgcggatgctggtggcacccgcgttcctgtttcactgcagcctgactctagaggcagcattttcaggaggagaggccattctaacaagcctctgtgaaaccccgtgcttctaaaaagcagacttgccttattcgggcacaaaatggttttttggggcagcatcttcagtgtactctgtttttccgttgacaaagttagcgctgctttgagttggagccgttcctggaggctgtgacggcatcgcatgatttgatggaagggagaggggagaagttctaatgctcagtgtaaagtacgattaggtggcatacgcctgtagtcccagctactcgggaggctgaggcatgagaatcgcttgaaccccggggacggaggttgcagtgagcagagatcatgtcactgcactccagcctgggcgacagagtgagactctgtctcaaaaaaaaaaaaatgtacaatgaggagagctataatttcagtcacttcccagtgtatgctcgttggcttgtccaccttcagagagggaaaagatggtttgccctcaatgacctggatctttttctctttttcctctgagacagcgtctcgcccttttgcccaggctagagtgcagtggtgcggtcatggttcactgcagcctcaacctcctggactcaggtaaccctcccacctcagcctcccaagtagctggggctacaggcatgtgtcaccaagcatggctaatttttgtattttttgtagagatgaggttttgccatgttgcccaggctgatcttgaatttctgggttcaggccatccccctgccttggcctcccaaagtgctgggattacaggcgtgctggattgtattttgctgtcagtttcagtttatttgacttagaataaagaccttcaagtgaggaagaagctataggtccctgaatatcacaggatctatgaagtatgtggcagtcctgctgtcccttttcctacctcattgcaacactctgtggacctgagaagactgtggggacagaaggcccagaggggagcgccaaggagccagtgcctccccctgccctggccgtgcccacgttgctgggcttcccacctatggaggtagctgcaggcgcatcctccctgcagacatacccatggaccagaggcttcaggctccaaaatcagcatcttagtaacataaacgcaaggttcagactgttgtcacatggcagaggccagggcggcatctcataatcagacagatcctgtttctgtagcagaatgtgcgaatatccacacggagcagaatcaggtcagattttgcctccagatgaatttccttgcagtaacacatttaggtttgtttatgtcaggggccatcttttcaggattggctggagtgccagccactggttcctcccctgctgagtttcctggtcctctctcctgctgttagccatgaaagtggaatgaggtcattttgagcctttcatctcttgtctaagaatatatccctatggctgggtgcagtgtctcacacctgtaattccagcactttgggaagtccaggctggaggatcccttgagccaggatcaacaagtgtttgagaccagcctgggcaacatagagagacccctgtctctacaaaaaaattaagaaaaattagccaggcatggtgatgcactcctatggtcccagctactcgggaggctgaggcaggaggacggcttgagcccccgaggtcaaggctgcagtgggctatgatggctccactgcactccagcttgggtgatagagtaagactctgtatacaaaacaaaaacccctacctttcaaattaaaactttttccgctagatcacctaatacaatgtaatttttggccaggaacggtggctcacacctgtaatcccagcacttcgggaggccaaggcgggtggatcacctgaaggtcagacgttcgagaccagcctggccaatgtggtgaaaccccgtctctactaaaaataaaaaaattggcctggcgtggtggttcacacctgtaatcccagcactttgggaggtcgaggcggttgggatcacgaggtcaggagttcaagaccagcctgaataacatggtgaaagcctgtctctattaaaaatacaaaaattagctgggcatggtggtgtgtgcttgtaatcccaactactcaggaggctgaggcaggagaattgcttgaacctgggaggcggaggttgccgtaagccaagatcacgccattgcactccagcctgggcaacaagagtgaaacttcgtctcaaaaacataaataaaacaaaaatagaactttttttttttttttgagacggagtcttgctctgtcgcccaggctggagtgcggtggcacgatctcggctcactgcaagcgccgcctcctgggttcacaccattctcctggctcagcctccccagtagctgggactacaggtgcctgccaccatgcccggctaagctttttttttgtatttttagtagagacagggtttcaccatgttacccaggatggtctcgatctcctgacctcgtgatctgcccgccttggcctcccaaagtgctgggattacaggcgtgagccaccgcgcctggccaaaaaatggaactttttaaatcaagagaattaaaaatgtttctacacttcttacagaatttatccttagaaccagaaatatgccggagagttcaggggcaaagagattcattccaaaaggcagcagaaacaagacagatttgcgacatgcttaaccagagaggggctatcaaaaaacccagggtgtcagagccaggaaatgcagtgtagcttttagaatttgtgttttaaagactattaaatgataagaattgccatgggtaagattatatgaaagcctagaatgtattgagaaatttcactgagtgtgggtgcgtcttcagccagcgagggccttcagccagcgaggcggagaagcctctttacagacacaagtatctttcctttcccatttgtctctgggtggttggaggacatccccttatgcatattagcatctaaaggaaaaggtgacgtttccaagtgtcagggaccaaaaagtgccattatttgtgtaatactttatcctttttaaacttaagttcatttattttaagggaaacttggtcttactactttcaatggaaaaccagcagtatttgccataaatatctgttttggctgaattgatggaatttcggttagaggcttgtttttttttttttttttctgagacagagtgtcgctctattgcccaggcaggagtgcagtggtgcgatccgggctcaccgcgatctccgtctcccaagttcaagcgattctcctgcctcagcctccggagtagctgggaccacaggcgtgtgccaccatgtccagctgattttcgtatttttagtagagatggggttcgccttgttggccagactggtctcgaactcctgacctcaaatgatctgcccgcattggcctcccaaagttctgggattacaggtgtgagccactgcacccggccagtcagaggctatttgagctatagtcctgttctttctgttaggaagataagcaagtggagagcagtgtgaagggtagaccagcaccccctgagacaccctctgccgtgatcaggaatatggcaggagcccctgaaggcccctgtggggcagtgcttgtctgtgagcgtggcccaccccttcctgggtagactgactgatcttgtgtgcctgagatgtaggacttcctctgagagtgatcatggagaaacggtttgggtggctggtggggaaggtactggcttcctgtgggatgtagattctgatgtgaccgtatgattgtcccttgctatccctgtcctgcctcgcccttggtcatgaaccccagactgaccaggactgtcttccagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaaggtagggatccctgtgcccgcctcgcacctgcggcctctgcccactagggctgcaggcagcctctggaccgagggccttacttggaggatggggggaagccttcttgttggaggtgtcctgccttggctcagccccctaccccagggcccacggccatgaacagaaggttcagctcgtcagaccccagcctgtgctggcgcatgatctgggccccgcgggcacctgccccaccgtttcccgctcccttgctttctgcatgtgaaatttgggaatatcactacaaagttttcttttggtaatgaagaaaaacatccaaattcctaaaaaggcttttagccacgtggtttcccccgttctggctgtcaggctcacctgtgcagctcgcagagccgagcagcgggttccctttcctccaaggcgtgcccctcagccactgtctttacctcacctgcgctgagcagggccttcagtcagcaaggtggagaaggctctttatggtcacaagtctcttttgcatgtccctggatgtggttagaggacatattcccttatacatacagcatctgaaaggaaaggtcatattagcatccatgagaaaaggtgacatttctaagtgtcacgggccacaggaggtcccgggtggtagaagatgaggattgcttgaccacagtctcccatatgctcgtgctccactgggcgacatttattttgtgtacctgtctcgaggcctaagtaggtgtcagaaccttgccttggagtcatgctggggactggggagatgcgcgtcatcttcgggtggctgttctcggtgccctcgagcttctctcgggcagcgcatagctgcgctgccacctcacgttccacatgctgaccctgccttgccatggtccctctcgcagcccatggagtccatgcatgagaagggcatgtcggacgacccgcgctacaaccagatgaaaggaatggggatgcggtcagggggccatgctgggatggggcccccgcccagccccatggaccagcactcccaaggtacagaactgcgttccttcctgccttgtgtttgtcatactccagagtcctcagatcattttcctcccctgggttcccacaggatggattcagggagtacctaggatgatgtagccgggtgggtggcccgccacagagagctgtctggcatggcgtggctggtgctctgttctggccacctcgtctcggagcagccctggaaggggaaatgctggttggggggcagaccatgttcagcatgggtgatagaggagggctgtgcagggcagcagccccgtgccacccaggaacttactggaaatacagattcctggggcctgggactctgctttaatgagcccagcaggtgccttttctgtacgaggacaattgagaagtgatatggtgggtgactttccaaggccttgctgtcatcaggggtgggaagctcaggggctgcactgggaatggaagtgttgggggtgggcctggcgagcccgaggatgtggaccccgcctgtggacaggcaggcggaagccgggagagagccgtgatttcatgcacaggttctcagcattaaccagaagcaccttactgagacgtgggccaaaccaaatccaccaggtcggctgctgggctgaggtgccttcagcatgtgccctccaggtgcccctggttgactcaagagaaggatgccatttggctgtgccctgtctcagagtaggagctggtgtagggggaagaggctgtaaaaatcacagacatatgctgccgagtgaccagtgggctgacctttctctgcaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtaagactggctgccctggccctcaggtgtctcagagcgaatggctggggcgtgggtggcggggtggacagaccgtgctctgttgccgactgggttccccggtttgggattgcacgggcccatactgcacttctgggtgctcgggtggtgggggcagctaaatgctgcttccccagctccccgcttcccctggggccgctggttaataggtgtatctgctgtgtcccctggagccagggctgcccacggggctgggcgcaggcataaacctgggacgcactgttttctcttttgtttctccctacatgtaggtatgggagggcccaacatgcctcccccaggaccctcgggcgtgccccccgggatgccaggccagcctcctggagggcctcccaagccctggcctgaaggtgagctccctcttctatggtggtgcacccgtgcccttactccccatctcaagcttgggtccttgagatgagctttgtcagggagaaagggccgagggtggtcaggctgaactgcagcctgtacttttcttgtggtggtccccgggtctcccctgtagccagtcagttcccaaaggctgtcgttcatccctcctctgacagcttgtggccttcacccagtccctgagccctgtatatgtaattgctcagtaagtgctgcaggctcccatctgttgggctcaaagaggcagtgggactcattacccatcctcttggagcctgaggtttagcgatgggcattgaggggcaaattgcttccactggatttagttggcactaggaggagatgacaggaaatgctgccatagagccacagacagaacaaaaaggccttgggagcctggggctggccccagtggagggtgtgaaggacgagggtgaggctgagatctggaggaggttggagcccaaggcaggtgtgaaggacacccctgggtgaaaggtgggagatgggcggggtctgcctgtccccagtgcctcaagcagctcagcagctttccatttccagcccgggatgggccccagagctcaacatgacgccctggccccttgccttctcccaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggtgagggcggggcccagttgccaaggtcactgccctgtgtcccccatgtccccctggggaagccactcaactttctcccccactctagcaaacagtgccctgtgcccaccactgccacttggcctacacctccttcctcacctccctgctcccaccctggctgcggtctgtttcccacacagcagtttgagttctctctctttttttttttttgagacggagtttcactcttgttgcccacgctggagtgcaatggcacaatctcggttcactgcaacctgcatctcctggcttcaagcgattcttctgcctcagcctcctgagtagctgggattataggcatgcgccaccacacctggctaattttgtatttattttagtagaggcagggtttctccatgttggtcaggctggtctcgagctcctgacctcagatgctcccaaagtgctgggattacaggcatgagccaccgcacctggcatgaattctctttttatgattgatatcagatctactccgtggattaaaacctgcctgtagcttcaattatctgcccaataagctttgccttatgtccactcctgcccagcatccttcctcacccatcccagtctctctgttcctcttttcatttatttaacaagttagacttgttcctgccccaggacctttgcacaggctgtgcatggctccttctactcattcaggcctgattgctggggttccctcctcatggaggcccttcctgtcacttccagccactctctggaattgcagtggatattttattttttttaaatctcctttatggcctgtgttttctaatgagactgagagttccttgctttgttgttcttgtttagtgctaaggccctgcacttaaaatggtccctggcatacagttggtgctcaatgagtatgtgcagaaagactgattaagagaattagcccacataaccttcgcatgtaaccttcgtaaccttcagaccaagcctctagggtcactccgaggggttgcctcagttttgaggtgagaatgctgaggtgtgcagttgaaatagattcccaccgccctgcgcctcatccatgccagagctgcatgaaaaccttggcccgcctgacgccagaacctggctcacaccactgaaaaggcatgacctgggcgcgtctatcaggaatcttgtttgctgtcccctgaggcccggtcctgaggagtgccccgggctatctccctctctgctgtgccctgcggccagcatcctcttctgaggcatctcttgcctcatgactagtgcctgcctctctcgagggatgggtcccctgcagctccagctgtaactgggtgccctggcaaccctctcaccgcctttgctccttgtctctgctcccaggctgcaggctcgcatcgcacaccgaattcaggaacttgaaaaccttcccgggtccctggccggggatttgcgaaccaaagcgaccattgagctcaaggccctcaggctgctgaacttccagaggcaggtgggtgctggcatggccgcagctttccgaaaagggcctttgtcaccaacactgctgctaaggctccaaatacggcttgcctggctagtattacacctgcctgggctgtgaaaagcagccgtggccatccatgggcactcaatcactgcagagccttcctcttacggcctgcgcagtgctggggacgtggacctcactaccctaaagcacttgccgcctcaaagcagacttgtatgggcttctttcttcctttccctttccctttttttttttttttggaaacagtcttgctctatcacctaggctggagtgcagtggcataaactctgctcactgcaaccaacgcctcctgggatcaagcaattcttctgcttcagcctcccaagtagctgggattacaagcgtgtgccaccatgcctaatttttatatttttagtagagacagggtttcaccatattggccaggctggtctcaaactcttgacctcaaatgatcggcctgccttggcctcccaaagtgctgggattacaggcatgagccaccacgtgctgtcctgcatgggtctatttctgagggtactgtgcttagaccctggagtgcagtggagagatcacagctcactgcaaacttgacctcccaggctcatgtcctcctcccgcttcagcctcctgagtagctgggactataggcgtgcaccattacacctggctatatttttcttttttttgaaacagagtctcactctgtcacccaggctggagtgcagtggtgccatctcaccccactgtggcctctgcctctgtggttcaagtgattttcctgtctcagccactgagtagctgggattacaggtgtgcaccaccatgccgggctgatttttttgaagtgcagtggcacaatcttggctcactgcaacctctgccttccaggttcaagtgattctcccacctcagcctcctgagtagctgggattacaggcatgtgccccacgcctggctaatttttgtatttttagtagagacagtgtttcaccatgttggccaggctggtcttaaactcctgacctcaggtgatcctcctgcctcagcctcccaaagtgctgggattacaggcatgagccaccacgcaggcctggtttttgtatttttaatagacacagggtttcgccatgtcgcccaggctagtctcgaactcctgagctcaagccatccacctgtctcagcctcccaaagtgctgggattacaggcatgagccactgctcctggccgcctagttaatttttcttctagtttttgtagaagtgaggtctctccatgttgcccaggttggtctcaaactcctgggcttgagcaatcctcccaccttggcctcccaaagtgttgggattactggcgttaagccaccacacccagccaagagtgttatacttctgaatgactcctaagacgtgtgtgtggtagaggggaggcaagctggaggtccgagaggaccccctggatagatgtccagaagtgatcaccttctgtcctgtgctcgccctgcccgggggcacctgctagacgtcccctgcacacacggactgggtgtgtaaggcacttacaatgctcctttagcggtgaagcatgtgacatcaccatacgtgtttgtcattgtggatgccacagagctgtgcagtgcgcgggcttgtcctcttccctcctacagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggtacgctccggtggccccaaggccctgcagcccgcccacctggctgcctggcttgtccagcggttgccacggggctgtgtttgctttgttcctaaacatgctgcttgtctctctcttttgctcattgtaacagtattctaggtactgagagtgtattggtgtaaaaacccaatggtagggagaagatagtgatgaaatccacgcgtagcacgtctggaaggtgatagggcacaaagaaaaatcaagccaggatagagaggaaggaacgggctgttgtagaactgatgttgggggagttctttcttttggaggtgacatctgggcagacccccaaggaagggaggcacacagatctgtgggaaagagctttctgggaaaaggagaaggtgcaagggccctggggctggaatgtgcctgtgttttctctggaaagcaaggacctgcatgagccagagtagagtgagtggcggggagagctggaggaagggagcgcagggaggtgacgagcaggtgatgcagggccttgcgagctgcatggaggatttgggcttttgctctgagtaaagtgggagccatagagggttctgggcagtgcagggactgatctgactcagggtttcccaagatgaatcagtaagacggaaatcttcaaatctaaaatcaagtaaggatttggggatgattgtgctgatttggtcatttatagattttctagagattttctataattaatatcttattggtgtagtgtaaaataatctagacagtcaacacagcaatctctgttaacttttttttttttttttgagatggagtctcgctgtgtcactgaggctggagtgcagtggtgcaatctcggctcactgcaacctccatctcctgggttcaagcagttttcctgcctcagcctacctagtagctgggattacaggcacctgccaccatgcctggctaactttttttttgtatttttagtagagatggggtttcaccatgttggtcaggctggtttcaaattcctgacctcaagtgatctgtccgtcttggcctctcaaagtgctaagatggcaggcgtaatcccccgtgcctggccaacatttttttttttttttttttttgagatggagtttcactcttgtcacccggactggagtgcaatggcacgatcttggctcactgcaacctctgcctcctgggttcaagggattctcctgcctcagcctcccaagtagttgggattacagatgtgcgccgccacacctgtttgtttttttctttttttgagacagagtttcactcttgttgcccaggccggagtgcagtggtgcgatcttggttcgacacaacctctgcctcctgggttcaagcgattttcctgcctcagcctcccaagtagctgggactacaggcacctgccaccatgcctggctaattttttatatttttagtagagatgaggtttcactatgttggccaggctgctggtctcagactgttgacctcgtgatccgcctgcctcggcttcccaaagtgctgggattacagacgtgagccactgctcctgaccaccaacatttttttatatatattatttcagccttttttcttgtatattaatacaaggttaaatagccctttttaaattttttctaaaactttgctttttttttttttttttttgagtcagaatctcactctgttgcccaggctggagtgcagtggcacgatctccactcactgcagcctctgtcttctgggttcaagcgattctcctgccttagccacctgagcagctggaattacaggtgtgcaccaccacacctggctactttttgtacttttagtagagatggggattcaccctgttggccaggctggtcttgaactcctgacctcaagtgatccgcctgccttggccttccaaagtgctggaattacaggcgtgagccgctgctcctggccacatcgctttgtttttaagtatcatggaaacatgacttttgatgtctacactgtattccatttctatgtgtccaggatctaatcatttatgtcacctttttcctgtttgaggacatgcagcatgtttcagcttttgaaaattaaaaattatgctaggaccggaattcttggcttgaacattttggagctggtctctgatatttccttaaaataaatttgtagtaatggaataagttgggtgaagggttggaagcatttttgagacatttcacatccgtgccatgctgccctgccagtcgactgcactgtgtgcctacctgctgtgtttgagggcctttcccacccacagttgccggtgcttagtttgtttttttttttgagacggagtctcgctctgtcgcccacgctggagtgcagtggcgcgatctcggctcactgcaagctctgcctgctgggttcatgccattcttctgcctcggcctcctgagtagctgggactacaggtgccagccaccacgcccggctaattttttgtatttttagtagagacggggtttcaccatgttagccaggatggtatcgatctgaccttgtgatctgcccacttcggcctcccaaagtgctgggattacaggcgtgagccaccgcgccctgccgccagtgctgagttttatcatcagagagagaaacccaaccgcggcaggcaaagggtgtccctttattgttttcataatagtctcgtttttattttatgtattatatttatttttttgagatggagtctcactctgtcacccaggctggagtacagtggtgcgatctcagctcactgcaacctctgtctcctggattcaagcgattcccctgctttggcctcctgagtagctgggattacaggcatgtgccaccacacctggctaatattttttgtatttgtagtagagatggggtttcactatgttggctgggctggtctcgaactcctgacctcaggcattttgtcctcctcagcctcccaaagcgatattctaggtttttttttttttttttttttttgagacagcgtctcactctgttgcccaggctggagcacagtggcacgatctcggctcactgcaagctccgcctcccgggttcacgccattctcctgcctcagcctcccgagtagctgggactacaggcggcccctcaccacgcccggctgattttttgaattttttttgttagtagagatggggttttaccatggtctcgatctcctgacctcatgatccgcccgcctcagcctcccaaagtgctgggattacaggcatgagccactgtgcccagccctaatttttttatttttatttttagtagagacggggtttcaccgtgttagccaggatgatctcgatctcctgacctcgtgatccacccacctcagcctcccaaagtgctgggattacaggccaatattctaggttttaaacaagccttgcggggagatgtgtccaccatgctgctgaagggtcagccttctcttttgtgctttcctgcaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggtatggtcctgccttcttgacgtgcgctcttctacatgtgtagctggtactgcgggctccaggggtcactccccagggttacgccaaggcatttcacagctcggagttagaggtgggacagagggaaaagagcaggcgcgggcttgggagtcagtcctgggctcggatatttgctgatctctctgatcatcagaatgactgtgtgacctcaggccacttagccggctcctctgccttctctggaaaatggaggtggtgcccccttccctcgttctgtgagagccaggtggtgtgatccagacccccgacccctagcataaacatctctgaccatttatttgtgactgagtcgctggttgggcagatattggcagcgtgttctgggccaggtgctgctctgtgtacggggacatggcccctgcctttgtgggggctcctggttgtgcttgaggggcagatacgcgaatgaagcaaacagagtagtggatggtgaccgctacagtgaggagggggaagtggagtggaaggggagggacagggtagtaagtaaaagccttgaaacagaggcccaaagggtggccctgatgcacaaacgcagagacccagggaaggagccccaggcagtgcggacaaaggttgaggtggcaggcagccatgtgccagggcagccggtagccctgggctcccagaacagcgttgtgtggggcaggaggtgaggtcagagcttacaggggcaggtgggaggtgggacctttcagaccattgggaggactctgggttgagttctgatcatgaaggggagcctcacccgggagggttttggctgtggggtgatgtgatctgatgtattcttagaaaggtggggggctgctgtaggaggtggtgggagggatgcaccttggacttggtggagagaaggcttcgggtttggggtgtatttcgtggacagagtgggtaggactggctcatggcctctgtaaatggctgctggcgggactgtctgcctagcgggtgcccttggaacctagcccttggtgggttttgaggaaatgattcctgaatgaggagtcgattgccgtgtgaagggctggtggcacggcacccgcgtgagctacgcgtgccctcagtgcgcttctggattgactggccatgggtgctcacagacatgcacattgtgccaccacattgcagtaacccccatgcttttgtaggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaaggtgtgctgggcctggcatggtgcccgccgcgggtgggatgggagcagccgtcttcacgtgtgtggcctcagccttgtgggtcagggcctgaccgtgtctctctctatttccagaaggcagaaaatgcagaaggacagacgcctgccattgggccggatggcgaggtgaggaagcagggtttcttgtggaagtatcaagctagccctaaggcgttggtctgtttcagactttaaaacctgtgttcttttaaaattacgaacaatgatatgtgatgatggtgagaatcccagggtgtcctctgacgcccatcccacccgaccccacatcccacatgttgtgttttcttccagacctttttctatgcatgtgccacaggattcatctttcaggttttactttgttgtaacgtccgacttacaggagaggtgcaagaaccgtccagagatgtcctgtgtgttcttcacccagagtctccattttcacgttttgtgttttgttttgtttctttgagacagggtctctctgtcacccaggctggattgcagtggcggatggctcactgcagccttgacctcctgggctcaagtgatcctacccttcgagtagctgggattacggttatgccccaccacacccagctaagttgtttttttttttgagatggagttttgctcttttgcccaggctagagtaaagtggtgcaatcttggctcattgcagcctccgccccgcgagttcaatcaattgtcctgcctcagcctcctgagtagctgggattataggcatccaccaccacgcccatttaattttatttttatttatttatttatttattttagacggagtctcgttctgtcacacaggctggagtgcaatggcacaatctctgctcactgcaagctccgcctcctgggttcacgccattctcctgcctcagcctcccgagtagctgggactacaggcacctgctaccacgcccggctaattttttgtgtttttagtagagatgggatttcaccgtgttagccaggatggtttcaatctcctgacctcgtgaacatcggcctcccaaaatgctgggattacaggcttgatccaccatggccagccagtttttgtatttttagtagagacggggtttcaccatgttggccaggctggtcttgaactcctgatctcaagtgatccacccgccttggcctcccaaagtgccaggattacaggcataagccaccacgcctggcctaattttttaaaatttattttctatagagacgggggttccatatgtttttcaggctagtctccaattcctgggctcaggcatcctcctgcctcagcctcccaaagtgttaggattataggcatgagcccccgcacctggccttcacctgtgttttttcctaaactctttgagagtcaaatgcagacgtgacagcgccttacctccatgtaattcattatctacttcataaagacaaggttgtttctgcacactgtaccgaggtgacggacacaggaggtgaacattggtacagcactgttatccaatctataggccttcgtatgaggtttggccagtttttccagttatcttcacagcagcagagaatcctgggtcacatttagtggaggtccctttagtcagctttagtcttaaagagctccttgtgtgtgtgtttgtttttttgcagagatggggtctcatgttgcccaggctggtcttgaactcctgggctcaagtgatcctcccacctcggccttccaaaggctgtgattataggcgtgagccaccacgcttggcttcaggccagctatgtcatccagtggccccggactttggtttgtctgatgttccttgtggttggagttgggttatgtgtctctggcaggcagacccaacatggccctgagtccctctcagggtgtcatatcgagagtgcatggcggaggttagcaaataaggtcactggtgatgctgactttgaacccctgccaagggatctccactgtccagttactgtttttttcttttgtaatcagtaagtaccctgtagggagatacttgagactctgtaactatgttgtaactcctcagaattccagctactccttttagtatctttttttttttttttgcctgtatcagtttttgctctgatggctacaggatggtgacttttatttccatcgttctttctgcattgatttgtttgtttttctatagtaggaaaagctttctctttggtcctgttagtcctgtggccatggtctgccaacccctggtgtagacttacggattcttgtttagttgaatgaatggattccgatcctttaaaatgatttcttttggtcatttagctttagccagcaggagccccttgccattggctcctgtttgcttttggtacatgcccaccattcctggagcacttccttcctcatcagacttttcttctgctttccctgcctgagctctctggagccaactctttctccagggagtcctggttccttttttttttttttttgtctgtcaagacggggtctccctgtgtcacccaggccggagtgtgtggtggtgcgatcatggctccctgtagtctcaacctcctggactgaagcgatcctcccacctcagcctcctgagtacctggggctacaggcgcacgccaccatgcttggttaagtgttctgtatttttttgtagagacagggtttcaccatgttgcccaggctggtctcgaactcctgagctcaagcaatctacctgccttggcctcccaaagtgctaggattacagacatgagccactatgcctggctatatttcgtattattacagaagaatatttacatgccaagatctgactttgggggtgcttcctgctagtgggccatcactgcttctaggccctctgagcagccggatctgggaaatagatgtatgtacacatactcatctgcattgctgtttgtatatattaaaacttgtggctgggcatggtggctcatgcctgtattcccagtactttgggaggccaatatgggaggactacttgagcccaggagttcgagaccagtgtgggcaatatggcaaaaccttgtctttataaaaaattttaaaaattagttgggtgtagtggcatgcacctgtggtcccagctacttgagaggctgaggtgggaggatcacttgagtccaagagtttgaggctatagtgagctgtaatctcaccattgcactccagcctggtcaagacagtgagaccctatctcacacgcaaaaagaatcttgaggttatactgacacctccaattctaatccaacagcacagggttaatttttatcctttccgcctttccataattctaaaatcagcaacctgatttcccttagcaataataggcttacttacctgctccattttagaatacacagaaagtacgttccaaagtgctaatggacacctctatgcagaagtctcctagttagagttcagtatttatagagttcctctacctcaggatatgtgttccaaatactgtgtccagaagttactggggccgggtgcggtggctcatgcctgtaatcccagcactttgggaggccaaggtgggcggatcacctaaggtcaagagttcaagaccagcctgaccaacatagtgaaacctcgtctctgctaaaaatacaaaaaattagccaggtgtgggggcacacgcctgtggtcccagctacttgggaggctgaggcaggagaattggttgaacctgagaggtggaggttgcagtgagccaggttcatggccattgcactccagcctgggtgacagagtgagattctgtctcaaaaaaaaaaaaaaagaagttactttggaccaggtgtggtggctcatgcctataaccccagcagtttgggttgctaaggtgggtggatcgcttgagcccaggagttcgaaaccagcctgagcaacatggtgaaacctcatctctacaaaaaattaaccaggcttggtgcgcacgcctgtagtcccacctactcgagaggctgaggtagggggataacttagcccaggaggtccaggctgcagtgcactgtgtttgtaccactgcattccagcctggggagctttttattacttgagacagggtctctctctgtcagccagttctgtctcacagttctgaagccatctggaggactcaagaaaaaagtaatgggccaggtgcggtggctcacatctgtaatcccagcactttgggaggccgaggcaggcagatcatgaggtcaggagttcgagaccagtctggccagtatggtgaaacccagtctctactaaaaatacaaacattagccaggcgtggtggcaggcttctgtagtcccagctactgggaggctgaggcaggagaatcacttaaacccgggaggcggatcacaccactgcactccagcctgggcgacagagtgagactctgtctcaaaaaaaaaaaaaaaaagtcatgaagtgggaaagtgcatgaagtgggagcttgtgctcagtcctgctgtggctgcctgtcctgtggagtgttgagaacaggcaccggcacttgctgctgcttgtgggttttcttgttctcggacagtggtactcagcctctgttgtgtgttctagtcacctggggagctctctattattattactactattatttgagacagggtctctctgttgtccaggctggagtccagtgatgaggtcatggctcaccgcagccttgacgtcctgggctcaagtgatcctccgaggacctttttctaagtagtagctgagcatgaaggcatgtgcctgttgttgcagctgctcaggaggctgaggtgggaggattgctttagtccaggagttcaagaccaacctgggcaacatagggagactctgtctctccaaaaaataaaataattacctgggcatggtggtgtgcacttgcggtcccagctgattgggagccagaggtaggcggatcacttgagcccagggctttgaggctgtgatcacacctgtgaataaccatggtactgagcccgtctccaaaaaataaaaagtaaattaaaaatcttaaaaagcgaggatgcccaagcctcactccagaggagttcaatcagaattttgggtgtaggggaggcatgcagcaatcggcatctttgactgctcctcccagtgatcccagagaggatgtggagttgaaagtccctgactgaggcagcctgcagagcccattgttggggtaagaggttgctcttatggtggccgctctgtgggtgagcttttagcgcgtagagactgatatccctccgctgtgtggacggtattgacactgtgagcgcagcagttttgcaggtagttataaattcctggaagatgaaaaccaaaatttaaaccaataactttttctccatcctggaagttttttctaggaaatatacaagaattgatgagggagaaaatgtttatccattgaatctcaacaggaggagtttcatatttgttgctaagaggaattatttttgaaatatttcaattagctttttaacaaaaaagaatgaggacccttgatgagatctacaaatagagtataagtgggggaaaaaatcaaggtccaaagaatgtaaattatataaccgttagtgtaaaaaagagggagaaagtggaaacgtctaagtccttgtttcttatccatggaattgatctggaaggatggacaggaaactgataccagtggaaaactgtgaagagaaaaacttaggctggagcacagaagaatggggagagcccacatgatgctcttcagttttcgttaaaaaaataaaaatgggccttgggaggccgaggcgggcagatcacgaggtcaggagatcgagactgtcttggctaacacagtgaaaccccgtctccactaaaaatactaaaaattagctgggcatggtgatgggcacctgtagtcccagctactctggaggctgaggcaggagaatggcatgaacctgggaggtggagcttgcagtgagccgataccgcaccactgcactccagcctgggcaacagagtgagactccatctcaaaaaaataaataaataaaaataaaaaataaaaatgggccgagcatagtggctcacgcctggaatcccagcactttgggaggccaaggcgggtggatcacatgaggccagaagtttgagaccagcccggcctgaattttcagctatgagtgtctggactatttgaaaattacaatgtatatgccagttaccttaaagaaacaggtgttgggagactgaggcagagaattgcttgaacccaggaggcagaggttgtagtgagccgagagccgagatcacgccactgcactctagcctgggtgacagagcgagactccgtctcaaaaaaaaaaaaaaaaaaaaaagaagaaacaagtgtcagccaaggttgatgggttatatatttttactggattactgagtatacagtttacgcattttcccaccactggccatgtttgcctgccattttctgtgcaaacagttgagtgggtgcttcccaccttggcctctgtaagtgtttggtctggaggccctgcaacctcagtgtcacacgaatgactctttttcagcctctggacgagaccagccagatgagcgacctcccggtgaaggtgatccacgtggagagtgggaagatcctcacaggcacagatgcccccaaagccgggcagctggaggcctggctcgagatgaacccggggtgagttgggccttgcattccagatgcagtggggatccaagtcctcggtgggccttgttccagggaggtggcagccaggagcaattttacttctgtttgaattcccggcaggtttggtagggaaagtgaattctgctggctctgagcagatttgtatgaaagcccttacattttttctaggtatgaagtagctccgaggtctgatagtgaagaaagtggctcagaagaagaggaagaggtaagagtgcatttcctggctttcaaggctctcagtgcccactggcagtgacttccaccctgtgtgttgtgaccgtctcctgccctggctgggcatcttgtggggcagggaacagcagggcccaggcctgcccgaagtcggtgctttagagctgtcctatccaatagggcagcttctggcgacatgtgaccatttccattttaaattaaatcagtcacattacataaaatttaagactcattttctctttcacactggctgcatttcaggtgcttggcatcccttatctgggaatggtctgcctcatttgcccattttttttttttttttttgaaacggagtctcactctgtcacccaggctggagtgcactggtgcaatctcagctcattgcaacctccacctcccgggttcaagcaattctcctgcctcagcctcccaagtagctgggactacaggcgcctgccaccacgtccagctagtttttttatgtttagtagagatggagtttcatcatattggccaggctggtctcaaactcccgacctgaagtgatccacctgcctcagcctcccaaagtgctgggattacagacatgaacctccacgtccgacttatgatttttttgttgttgttttgaaatggagacttgctgtgttgcccaggctggagtgcagtggcgcgatgttggctcactgcagcctccacctcccgtgttcaagcgattctcctgcctcagcctccctagtagctgggacttcaggcacctgccaccatgcctggctaatttttgtatttttagtagagacagggttacaccatgttggccagtctggtcttgaactcttgactggtgattttttttttttttgagacagagtctcactctatagcccaggatggagtgcagtggcgcgatctcgctcactgcaacctccgcctcccgggttcaagtgattctcctgcctcagtctcctgagtagctgggattacaggcgcccgccaccatgccagctaatttttaaaatatttttagtagagatggggttccaccatgttggccaggctggtctcgaactgctgaccttaagcgatccacccacctgggcctcccaaagtattgggattacaggcacgaaccagtgcgtcaaagtctgttctgtgttagtcactctaaccctcttatgattattgttcacatggtacatctttttcccttcttttactttcaacctgaatctacaacagcatatgggttttgcattttcagctagtatgacagtgactgctttttgactgagtttttaagaccatttatatttactgtaatttctgatatgattgggcttacatttgctatttcttttctatgcctcctgtttttgttcctcctttactgccttttgtgttcaatgttttttttccctagatttttatttttatagtgccttttttttttttgagacggagtctcgctctgtcacccaggctggagtgcagtggagcaatctcggctcactgcaatctctgcctcccgggttcaagtgattctcctgcctcagcctcccgggactacaggtgcatgccaccaaacccggctaatttttttttgtatttttagtagagacagggtttcaccatgttggtcaggctggtctcgaactcctgacctcaggtgatctgcctgccttggcctcccaaagtgttgggattacaggcgtgagccaccacgcctggcctctcctatttttttgcttacctcttcatgtttagttgaagcgtactttagctaccctggagtctgacttttaaaactctgggaggttgtggtggcgtctagtctgtttagtaatttcctggggctcagtctgtgaaatctggttcctgcatagtgtgtatagcctctgctgtatttcctcaattcttttaaacattttttggttttatcttattcgtgatttttttcctggttcattaggggcaggcagtgtttctttgtcacttagtggtcatccaaagattggccacagtttgtgctcagacacgcgccttctttctcctgctgatggttcagttgtatgaggaggtgcattccacatttgggccattgtcgggttctccctggcacttatgctttgctgagtcctttggcgtctctttgcatatgcacagactcagcctcagccagtgatacgcttttccctaccgtggctgatctcacctccattagcagtgccactggctgtgggcattgcttccttctacaagtgactgagccccttccacctccctgccaagcctcatggcctgcagctctccagctgtaagaggttcatgtgtccagagctgaggcagaagaagtgaaagtggcccacagtaaaagtgctacaaactcccactcttcccacctgaagttcagttttttaaggttcaatgattctagtagacctttggtcaactcgctgagctctgaaatgctcactctgtcaatttgtccggctttatagttgcttttggggaggaaatttgcccacctcctcatttgggtttagccagaagtctcactcctattttaattccagcatgtctgtaccagctctgattttcttgcctaaaatgtcggtgttattaccacctgtttattccaagtgatctgtaaaatcattttttgtgacctaagggaaatcctactggcttttcactggaattatttaacagattaattgcagatcatatttttaaagctttgtagcagttccattatagatgagggaacaatcaactgtgttgtatttgtaggatttaaatggcaatacaagaatagtttaagataaggaaatgcattcttgtctatgttatcaatatgtgttatgcaaaatcgcagtaaaggctggaaagccattaaatgatgcaacatgaatgattaaacaagttcgtagataacttgcagtaaactgagatgcctcttgtcgccagtgttatcagacatattgtagatggttgagacttgtcagtaaagctggaagtaaattacaagcaataaatattgaaagttggttctaagatatttaaagccaggcgcggtgtctcacgcctgtaatcccagcattttgggagggcaagttgggtggatgatccaaggtcaggagttcgagaccagcctggccaacatgatgaaaccccgtctctactaaaaaatacaaaaattagccggggtgatggtgggctctaagatatttaatacctaggaaatccaagagaatcaactgataaactgctttagtaggtcagcagagaatagacgtgtaatgttcattgtataacaggggtaggagagatatggagtctacttctaattagtaatgaaagtccacaataccctgagatagccttaaaagaagcgtcggggccgggtgcagtggctcatacctgtaatcccagcactttgggaggctgaggcaggcagattcttgagctcaggagtttgagaccagcctgggcaacatagtgagtccctgtctctaccaaaaatgcaaaacaattagccaagtgtcatagtgcacgcctgtggtcccagctactcgagaggctgaggtgggaggatcgcttaagtccagtgggtggaggtagcagcgagctgagatagcaccactgccctccagccagagtgacagagcaagaccccatctcaacaataacaaaaaaaaggaagtgtcaggaatctgtggtggggaaaccaaaaacggtttactgggctgggtgcggtggctcacgcctgtaatcccagcactttgggaagccaaggcaggcggatcacgaggtcaggagttcaagaccagcctggccaacatagtgaaaccccgtctctactaaaaatacaaaaattagccaggcatggtggcgcatgcctgtaatcccagctacttgggaggttgaggcaggagaatcgcttgaacctgggagctggaggttgcactgcgccgagatcacgccactgcactccagcttgggcaacagagtgacacttcgtctcaaaaaaaaaagaaaaaaaaaattgatgtagccagtgtggtgcatttgcctgtagtcccagctacttgagaggctgaggcgagaggattgcttgagcccaggagtttgagaccagcccggggaatgtcacgagactacatatctacaaaaattcaaaacatttgagctgggtgtggtggtgcatagctgtagttctagctgctggggaggctgaggcaggatgattgcttgagctgaggagttcaaagccatctgggcaacatcctgagactcccatatattaaaaaaaataataataaatacataattttaaaacaaagatgtaaataataaacagcacacattccaggataggtagagggggtgagggctgtaagaagatcacttgcttctgagactgttctccccatgggagtcccgtcccccctctctgggggatgaactgaggtgacatgggcttgtctcttggtaggaggaggaggaagagcagccgcaggcagcacagcctcccaccctgcccgtggaggagaagaagaagattccagatccagacagcgatgacgtctctgaggtggacgcgcggcacatcattgagtaaggggtcccgacacaggttgttctgtgccagcttcctgtgaggtggcgctggtgggagtggctagaatcccagccatccctagctgacattcagcactgtccagccagctgctactgtggaactacagagaccaaatttatttacttcacatttcatgtattttatagggatttaatagagcaattgcattcgcatggttcaccatatgcttacgaggtacagtcaggtgtgcgggagaagccctcctcaccccgttctctgctccccggctccctccctttccactaccctccctggggaaactttccagccttgtgtgtcatcttccagagatgctgtctgcattagcaagcaaaatgtgcatatttttgtcttcatttgcatacatatctccagtgtacattggtgtgcaccttgttattttcactgaaccttccctcttggaggtcatcctgtgtccgtgcagagtgcttccagtctggtcctcagcgtgcagtgtcatactgcgtcacgttatattctcattttcgtagcctgtcctttggtgacaagcgtttaggttatatttgtcatcttttgctcctgtaacacatcacagttaacacagtaatctcttcattgcttatggtaaggaattaatagatcctgttaaaaagcaagtgagggctgggcgtggtggctcaggcctgtaatcccagcactttgggaggccaaggcaggtggatcacttgaggtcaggagttcaagaccagcctggccaacttggtgaaaccgcatctctactaaaaatacaaaaattagctgggcgtggtggcgtgcacctggagtcccagctacttgggaggctgagacaggagaatcgcttgaaatggggaggaggaggctgcagtgagctgagatagcgccactgcactctagcctgggcaacagagggagactccatctcaaaaaaaaaaaaaatgtaggtggataaaagtcacttttttttttttttttttttttttttttttttttgagatagagtcttgctcttcaccaggctggagtacagtggtgcgatcttggctcactgcaacctccacctcctgggttcgagtgattctcttgcctcggcctcctgagtagctggcacaacaggcgcgggccaccacgtccagctaatttttgtgtttttagtagagatggggtttcaccatgttggccaggatggtcttgatctcttgacctcatgatctacccactttgagctcccaaagtgctgggattacaggcgtgagccaccgcacctggccagagttactttttaaaagaaaaacattcagattagattacaaattgcctaagttttaacagctctggttttgtatgaacctgttcagtctgtgtttcttttcacctttaggctcatgaattgttcttagaaagggtgggttctatgatgatcagcatctggctaggtgcagagtgtctttctgtgctgtggcaagtgacagcattctatttgttgttttgagacagtcttgctcagtcgcccaggctggagtgcagtggctcgatctcttgactcactgcagcctctgcctccgggcttaagtgtttcttttacctcagcctcctgagtagctggggttacaggcatgcaccaccacgcccggctaactttttttttttttttttttgagacagagtcttgctctgtcgcccaggctagagtgcagtggcacgatctcggctctctgcaagctccgcctcccaggttcatgccattctcctgcctcagcctcccaagtagctgggactacaggcgcctgccaccacgcccggctaatttttgtatttttagtagagacggggtttcaccatgttggccaggctggtctagaattcctgacctcaggtgatccacatgccttggcctcccaaagtgctgggattacaggtgtaagccactgtgcccagcctaatttttgttttttgtagtagagatggggtttcaccatgttggccaggctggtcttgatctcctggcctcaagtgatccacctgcttcagcctcccaaagtgttgaaattacaggcgtgagccaccacgcccatcagagtgacagaattcttgtactgtggtggtgcaatcaggacccagagctcccaggagtccagtctggacccctcaggcttagtgcgggctgccctgcctggcctcacactgtccggctgcacctctatgtgtcttacagtgctggccacaggtcattcagcagaaagggccactccgcagagcttgtgtcaggagccagcacattgtcacagataggaatgtgtgtccttacccggcacctccatctcactcccaggaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccaggtgaggtagggggtggggaggccaccgccacgtagctgcctcggtgcaggtgttcccaggtggtgcgggcttcagacctcaggcagacctgagttcaccttttgctctttgtgggcaatgcactcttcccctctgagcctcggtttccccatgtgtaaagcagagatgtggtctggtaggttagctgccaggaggacgtgcaacagcagaaagtcagtgtctactgggtgcccgatgtgccaggcagagtgggagcgatttgcactccagtggcctcacagaggagacggggccacctgaggagcagagaggtgcagcacctcctcagcatcgcaccgtgtgtaggactgaaccagggccggagctcagatctgggcatctgcatgctcaggacaggttacctgagctctgtgtggtgtgaaacggcgagcgtcaggagcttagatctaggagccggcagccctggactccgctctttcttctggggatgaggtagcaggtcctgtgtgagggtgaaaagttggtggctctgaagctcttcacctgggcctgacttgggacagtcacgaaacagagctgctcatgctcttaatgcggcctgccatccagagctcattacaaggccccacaagacaaccagtacaactccaaccaaagaacagctctctctggttttcaatttggttgtttcttttcttttcttttttttttttgaaacggagcctctctgttgcccaggctggagtgcaatggcgcgatctcagctcactgcaacctctgcctcccgggttcaagtgattctcctgcctcagactcctgagtagctgggactacaagtgcgtgccatcacgcccggctagtttttgtatttttagtagagacagagtttcaccatgtcggccaagctggtctcaaactcctgacctcaggtgatccgcccaccttggcctcccaaagtgctgggattacagatgtaagccagtgcacccagccccaactttctttaagacaactcttaaaccttttgtgctagtatcaacattcaaagctgcacatgcacctatagtcccagctacttaagaggctgagatgggaggatcgcatgagcccaggagttgaaagtgggcctgggcaacatagtgagacactgcctctacaaaaatattttaaaaattagctgggggtggtagcacacatctgtagtcccagatagttgggcggcttaggtgggaggagagcccgagcccaggacttctgagctgtagcgccctatgtcgatcaggtgtctgtactaagttcagcatgaatatgatgaccttccaggagtggggcaccaccaggtggcctaaggaggagcgaatctgcccaggtcagaaatggagcaggtcaaaactgatgtgctgatccgtagtgagatagtccctgtgaagagccactgcactccagcctgggtggcatagcgagaccccatctctataaaacaataatgaaacaaaggcaaagctcatggttagtggaattttccaagagtcccatgcaattaaaataattagaacttggctaggcgcagtggctcatggctgtgatgccagcactttgggagaccaaggcgggtggatcacctgaggtcaggagtttgagaccaggctggccaacatgatgagaccctgtctctaccgaaaatacaaaaaattagctgggcatggtggtgcatgcctgtaatcccagctacttgggaggctgaggcagaattgcttgaacctgggaggcagaggttgcagtgagccaagatcgggccactgcactccagcttgggtgagagtgagactcggtctcaaaaaaaaaaaaatgaattagaacttggccagaacttacttcctcaatccattacgaacatttccaaattttccttcataacgttatcttcagtttgcaaatagtcttctgtttaaggcctgtatttcagaaagctcccaggctttggaaatccctctcttaatcttgaaatgatgttcaggcagtgaattcctcacgaagtcgccctgaagccctcttggtttcctgagtgcaagtgtcccgtggtgtgggcaggtttttcctgtgtgctgtgtggggcatggacaggcagacaatgtaacaggtgggagtgagctgttgagatgtgtattagaaatgtcacacgtgtccatcgttcgcacagtcatcctgcagcttcacagacgttattgctaaggatgaggctaagcgataaagaatcagtttggttcagaggaaaaatccgtggtaaaggcagtagagggtgggatgtggcttaggcagaactcgtggctggcggtgtcttgactctctgaagtgggaggaccctctggtgtccgacccggccttcagtcctggcgtggccgcatctgtccttgcagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcgtgagtacccgctgccagcaacatcccacacgccgctcacacgctcctgtgtttgtttcctaagtttgccgcagtagaataccacaaacgaggtggcttaattacagaaatttgttttcctggaggccagaagtccagggtcaaggtgtagcaggttgcttcctcctgaggcctctcttcctgcttgcagggatacgtgcttacatgtatctcactgtgtcttcacatggtccttcctctgtgcgtgtctgtgtcctcatctcttcttcttagaaggacatgggtcaggttggatgagggtgcatcctaatggcctgctttaacttcattgcctctgtattggccctgtctccaggtacagtcgcatcctgagctgctgggggtcaggactgctccaccagcctcggggctgtgcacagctccacccgtcacagcctctgcctctgggtcccggatcaagtgggggcatgactgtgcatcccctccacccctggggaggcctggggtccctctcccgggatgtccttggtgtccttttcaagtcccacaaccagcaaagtccatgcaggggagtcgcaggagacaagaacctcccactagaaaagtagggtgaggccattgaggctccattgaacagtctctacttcctcactgtgcagtgccctgcaagggccaccagagccctcgggcacatcccagcatggcccaggtccttgggcatggtgggatccggacaccctgagaggctctcacttgccactgcctggctccaccggcctttttctccctgcaaacagagtccgcccccctgcccacctctctcgacatctctctacccagctcagcccctgcactaaagggggacctgcctagggttttcccagaaagccccagggccggctcttactggtccagttcaagtcacatgtccagcaagcagacagtcaccggcctgggggttagtctggtctgattgggcaaacttcagcatagcatttggtctggccctagagcacagcccctaactccaaccaggcactcattgggaccactacagccacgagtcagcagcggacccccaactcctggcaggctggggagcggcatgcccatgctccaaccccatgggaaaatgcccttctgcctataagacagccaggccccatgggtcacacacccatagggtaggcctgacgtcctgactgttgcagggaggactggaggaaaggtgaggaccccagaaccctcccaggtttactgtggaactgtttctttcttctatctccctgcttcctacgtggcgggtagaacagactgctctgaaggagcagggcgtccttgtgcacagcgctgcaggtagctgcacctcccctcgtggtcagacccagattgctacagcgttcctgctgcacctgcctgagctctgtcccctgtctgtgtctggaggctgttccttccggctctgcccacctcctggctcccctctgcccttcttcccctggaggctgatgggtgcagtggcagtcgccctctgcagttcccgattttccctcctttcacttacagacttctcagatcaccatctctgctggaacgccgctctccagggtgctgttgttttgcagccttggttcttagttgttaattttttgctttaaaaaatttttttaaacttttcattttgaaatgatctcatttatttttatttttttttattttttgaggagtctcgcactgttgaccagcctggagtgcagtggtgccatcttggttcactgcaacctctgcctcctgggttcaagcgattctcctgcctcagcctcccgagtagctgggattagaggcacgcgccaccatgtccggctaacttttttgcatttttagtagagacagggtttctccatgttggctaggctggtcttgaactcctgaccccatgatctgcccgccttggcctcccaaagtgctgggattacaggagtgagccactgtgcctggcgacctcattcttagaaaacattgtagagttagtgtaaagaattgctatgcacccttcacccatcttccccattctttcataaccccaagacaattatgaaaaccaggaagataacatggacgtaggactaatagcaaaccagaggccttatttaccaatcttgtcagttttctcacaagtggccttgctctggtccaggatcccacactgtcacgtctgtgtggcatgcctgtggcagttcctcatttcgtctttgtcctggtcgagcttgacgctgttgaatcctgatcggacctttggtagactctccttcaatttgggtttgtccgatgtgatcgcgtggagcaacaccacgccctgcttgatgtgccttagcggggaaggcatgagatgttgaggccttggtgtctcgggcaaggtgcctgctgggtttcccactgtaaacctaggagttacactttccgttaataactgtctcgtgggaacgtacttcgacacttgtgaatatctcatttctcttcctactttcctcaataatttcagcatctcttctactccatttcatgttgccataaaggaatacctgagactaggtgataaagaaaagaggtttagctgggcgcggtggctcactcctgtaatcccagcactttgggaggccgaggcaggcggatcacctgaggtcaggagtttgagaccagcctgaccaacatggtgaaaccctgtccctaccaaaaatacaaaaaaaaattagccaggcatggtggcgcatgcctgtaatcccagccactcaggaggctgagacaggagaatcacttgaacctgggagacgggggttgcagtgagccaatatcgtgccattgcattccagcctgggcaacaagaatgaaacgccttctcaaaaaaaaaaagaggtttatttggctcatgattctgctggctggaagactgggcacctggtgagggcttcaggcggattccactcctggtggaaggcaaaggggagccagtgtgtagagatcccatggggagggaggaggcgagggaggcgggggtgccgggctccttttaaccatagctcccacgagagttcagagagcaggaactcattcatcccccatccccagtacagtacaggccgttcacgagggttcacgaggccgttcacgagggaggcccccatgacacagatgcctcccaccaggccccacctccaacattggaaatcagacttcagcatgaggtttggaggtgccagatacccaaactatagcagcaaacgtcagataagtcttgcctgaaaaaataattacatgagagttgccaaatacatggttacctgtttctgtccgctcttctctacaaattaattggaattccaccgttaggaagagctttcccgtctcccccatgtgcttgtttgggtaattattatatcagtgtgggcgtgaacaaatattatttattttgttgcttcagtttttttcagatttggcctgggagaattctccctggaagaattgtgtcttctctatgtattcagtcatttgttaatatgagtatggacccacggatatttatttagtactccaggctacgcaccagtggctgggttttttttgttttgtggctcaaatccatccagctttggccactgggagtgctttcagttggctcttctgtcctttgacacgcccccagcatcgggtgaattttgaggactttcttgctttttggcaccaagagatgctgcaggctcatgtagtctatttcccgcccactccctcaaatcagccatttctccaaggagccctggtttcccttcttacagaatggttttgggaaccaagacctgggtcctggatgggcctgttgcttctggggtgtcattgctcctggggccctctcagtggtcagtgctaggagattcatgtgcgcgtgctgatgctttgtgcacgtatcgtctaaaaggccttctctgcctcggcatctgtttctgtgttaagctgaacgtgagttcataccactgtctgcggctctgagtgaggaccacaggttccttctcacacttccaccctgtgtgtgcgcccattctcagcttccgtggacaacagtttcagagtagtgagccggtacctccgggaagcatcttgagccactagagcgcaggccttggggccagttccttgtgtgttcagacctccagattgcagtcagattccatttccagggtgatagaggtcaccttcttcccctacttcagtgaggttgtgaggtgggtgctcctgcagtctttcccactgcgccccacctgggcaagcgtccatgctgtggaacgccagctcctgcaggccagaagagggcccgcgcgctaggaaatgtttacggcgtatgggcatccggctgtgccggccctctcactgggaattgctgcctcctgccatgagctgcttgtcctgcctccgtttggacctctgtctctgggacctgtcccctcagtcccctcctgacccttgctcctggctcttctccctcccagtgcagatgctccgcacacctccggcttctcccttggtgcgctgactgtccccatcactccagggaggtttcactgttcctgagtcagcggaagcacagggtcaggccctacgggccaggtccggtggctccaagatgccatcagggacccagcctcccccaggtttctgcccagtcattcttgggtgactccaaccctcaggctccttacctcatggttgcaggacggctgcactgcctccctcgcctcatgcaggagagtgggcaggaaagagttctaggagagtgggcagggcaaaaggcagcagaagcgcaaggctgctgagcctctgctccccacgcttcttcaggaactctccccagccttcaccacagccatgcgtccttctgtctattggctgtgccgcctggttggctgtggcttccagcggggctggagatgggttcatggtggacacagcacctccctcgtggagctgcttgggggcaaaccacgagtagtccctgggactccagcttcgagccctgtctttacggaccaccccgtctagactttctgagtggcttccctcccccactgaaaactccctgccccagagttcctcccagagcccgtcccctttgggactcagctttattaccgcctccaccctctcctcagtctctaggctgtcggtctcaggtgactcacccctccccactgcattctgcctgcccccatgtcctccctcattccagccctggtcatcccacaggggaacagccacgagttgccgctccctcccatccctgtcctcccgcctgccacctgagccaggccccgcctcgcccctcactgtcctcgttctctctcacagtcaggaaccttccgtggctggagggtggcagaaagactgtttggtgtctcctatatcctcaggtctccacagcactgttgctagcctggctctgggcgtgaagcctgtgctctgaagctgcattttcccggcagcaggtccaggcttccccagccctggcagcattgtttctgtcccccatcacatctctgtgtccctacttctcactctaaagggccttgccctcttttcccagtggcctcccttctgtcctctgaggcagagcccttcacgtcctcgccagtctctcttcctccctccctccctcagctgccctaaacacagtttctctgcccactcggagggctgtggccatgttggcctcgcccctgacagccagtggctatgggtttgcacagtgagccattgatgagagaccggcacttgactctcatttccttgttccatcagaacgctgtccaactgggcgtacgagtttgacaagtgggccccctccgtggtgaaggtgtcttacaaggtaggtcacagccactgaggtttcctctcttgctacggaggtgcaggcggtggtgggcaggacgtccacacatacctctggacagtgaacctgagaatgctgggtctccagtcgcatggagtctccaggacagcctggaactccagtcacatggatccgggagtttggactgggcagggacagggcagattagctcactggggaggagacaggagtgagcatggtggccagcactcagaggccagctcaggcgcctgagatggggacccaggaagaggggagcctgtcagccaccaggaatgtgcagatggcggtgcaggctgcgtggttccctcaggccccggccgccgctggcctgcactgcttcctcttccccctgcagcgcgtgttctgcgtggtgaggtctggggacgcgccagcggccctgccagcccctttccccactacccctgtgaggacgagccctcccgccgtgtcactgggcagttgcagggggtgcctgtgcccctcttgccacctggccacccggctccaaaagccgagctgtgcatcctgcttcccttgcagggatccccagcagcaagacgggcctttgtcccccagctccggagtgggaagttcaacgtcttgctgacgacgtacgagtacatcatcaaagacaagcacatcctcgccaaggtaacgtgtccctgtgggaaatgccaggccatgggccgagtgctcacacgtgggtcacgctgcccgtctcctccaaagcccctacaagtttcttcccggagtcccacctgcatgtgcgtgaagacagctgccctgtgtaggggaaaggcctaggtgggggcgacctcaggtttacctccctaactgtctccaggcaggccctgagtcaggcccagaagctggggccatctacacagcatgcgctctgcctcctctcgggccttctgcccagagagcctcagcaccaaggcgtctcctgacccgcctacagagtccccatggggccttggccagaccagtcttgtcctcctgtctcattgccttggccgtccctccctggggccctggcttctcaccacaggccatgggctgagattcagcatgtgggggagagctcgagggccaaataccatgactgcctgctggccttgggcagctggttcgggctgttctgtgagggtcctactgtcctggaagcctcttctgggacgaaactgtgaagggagtcccagcgtggccatgactgagaatacggcccagatagaaaacagacatagccctctgcctccaaaaactcatgttcctcatttgaggaggggtaaagatgtacctggtctcacccctaaacatccagctgagtgagtgttgaacagtagagagttttttgcgttttggtttttttttttttgagaccgagtctcgctctgttgcccatgctggagtgcagtgatgtgatcacagctcactgcaggcctgacctcctggcctcaagcgatcctcccacctcaccctcctgagtagctgggactacaggtgtgcgccaccactcccagctaacttttttaaatttattttttatggagatggggtcttgctgtactgcccaggctggtctcaaactcctggcctcaaggaatcctctcgccttggcctcacaaagcactgggcaactgtgtctggcctaacagtagagttcttgacccaggtatggggggatggaggagctgtttatgggtggctccgcctctcagtgcatggctggagtgacagtactggaatactggggctgtgaactgggtgttttcttttctttttctcttcttttttttttttattgagacagagtctcacagctgtcacccaggctggagtgcagtggagcgatctcagctcactgcaacaacctctgcctcctgggttcaagtgattctcctgcctcagccttccgaggactgggtgctttatcccggagccaacaagggaggaaactgaggcccagggagctgggtatcccacgtgcaggctcttacctcaggtccatgcttcaggtgcctcctttgtggctcacccctgctgactccttacaaagccaggccgttggcaggcacaggaaccaggctctgaaaccccgtgctcccctgccagtggctcagttgatgtaatcaccctgcagtgggagtgctctttgagtgcggccactgcgccccctcccgacccgcatggccctgtatgtagtggcgctggcccctaccccatggggcccacattctgaaccacaggctgctcattagaaatgtaccgtcaccaacccagttcccctgagaccctccacaccagcaggacaagtcccccagtcagcaagatgtgtcttctgccagaacgtgctcggcatttttctgtgctgtagattcatatgtgtgattttgcagggaagccagattgcttttttgcaatttgcattgttcacctgccaatagtcatggggtcacgggcctgtctctgcccaaggcttgcaagaggctacgttgtgtggctccaactcggtgagtcagccccggggcaggacgtcaggcctgtgctctccacccagctgcgctcttccacctggagccttcctggctgctgggcgcagagtgggagattctccccatgtgccgggccacctgctgccccctgccctgattgcccactctggggcccgcagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtgggtttgcccagctgtgcccatgctgacggttccaggtgcggctggctttgctggttggaacgtgttgagcaccagctacagctggctgggcctgtgctgggtgcctggtgagagtctgcatctgcatggagcaggggagccctggaacccaaggctggggcagccacaagggccccaggggagcagggcagaggtcatggtggtgaatctcggaatgctcggggcgtctctgaccctatgctccaggtgcagagtggatggtgaggaagatggccctgaggcagctgtgggaccgcaagcgtgtggagagcacagctagaggctgtagcgtgctgtaggcccctttaggtgccctcagaactcaccctcagggcagtgggaaggaaacttggaagattccagttagcggggccacatggtcaggttctgtcttacgttgttttcaaaaagctcagtggccagtgtgtctcaatgtctgggtggcaccatcagccagactgtggcatggcagcatcatcattgatgagtggtcccacaccagcactgatccctgagcctagagctccttgctgttggaggttgaaactgtgggacagactgtgtttcctgctgaggggtttaagtaaccagatgctgaagtgtgggcagaactacagaggttacctcgaagtgccctgcccagcacggctgggcccacccccttcttcccaccttagacaggtccagggcagctggggccttcctggcctcatgcgtgagttccctgccctctcggctgctggtcaaggcagagactcttctgatggcgaaaccgaggcattccccaaagcctcgtgataaaggagtccccaatttttagactcccgggacccccacactaagggccaggatctgatgctatagttttgtcactttctgagccgagcaaaagctctgccaaaggattgccagggaagcaatagaagaaaagttttggcgtcgtctcattttcctttaacttttttaattaaaacattttaaaagttaattattagtagaggagtaggcgccgtgggaggtcagggtttctttcacctggttccacccaggctgaatgagagtcccttggggctcccggtggcagagccctccctgagaatcacccgctataagccccatgtggtcagcctggcccctgcagcgctcctggcatgagcttggcgtggggtgggtctgtggacactccagtttgtgttactcgtggagaagcagcatgcccgctgccgggggtctttctggtgaggcacagggagcagagtgctctgggtactgcggttccatgtcccaggaattacatggagggaaccagatcctcacagtttcctaaggaagagggtgccctgcctggctcccagaaagcataaagcaggctgaaaagccacgtgccaagggcaagatcaccccaggggaccccgtccaccctgtccccacatccgcaccttctagtgagacctctgtcgccctcctttggaggtaacgcttgcttctcctgtcttgggggcttccaggtggacctgaatgaggaggaaaccattctcatcatccggcgtctccacaaagtgctgcggcccttcttgctccgacgactcaagaaggaagtcgaggcccagttgcccgaaaaggtgatggagttttgaggggagccaccagtgaagcagcctcacgtgggggctttctccagggctgggcgtgctcagggcctctccccacagtcccaggcctgccctggtcaatccagcttgggggtggcgatgacgccactgggtctgtaaagccctgtgctgctgttgtagggattgaaaagcactcataggctcacatagctcacaataggttagagcacaaaatcccacttcctgtcagggggccaggtgcctgtgcgggctctcctggccacatcaggaggggccgtgggcttggggttgccccccggccccccatcatggctctgggttttcaaggcctgctgcagccacacccctgggcccagttcccacagcaagacccatggactcggggtccccggctgcagttgtccctcttggctctttgtttcctggctggctgtagagaggcccccagaagatggctggggggccctttctggcccagtaaccctctggtatctctgcctggtgcttcctctcattgcccaggtctcccctcttctccccagctgtgagggtctcctcacccacaccccagtgtgctctggtcagagctcatatgacagggccgagggggtcagagctgggttcggatggggggagtcaggcctcaagccaccttgggccctcgtgagcattatgtgtcccctgcaggtggagtacgtcatcaagtgcgacatgtctgcgctgcagcgagtgctctaccgccacatgcaggccaagggcgtgctgctgactgatggctccgagaaggacaagaaggtgggccccagagtcccccaactgcattccccactgggtgtccaaggccggcagcgtggcaggcagagcagagcgtgctctgaccatcgggtcatgatctggtcatgatccccagggcatctggccagccctggttatgatggctggtggcttgtgtcaggacacactgactcagctgccagtggcttctcctttgcctatgaaacactggctccttctgcaattggcagcctgggcccagcactaaccccagcagggttagagtgttctagaatgccccccttctctgttattaagtgaaaggaagggagcgggctgtctcctgcaggggctgctctgagaatcccaggccccaggccccacctgcctggctctcctcaccagcagtgaaattatcctcccaggaaatgcaccagaccccttgattctgcccccaaggccttgacctcggcctggcttccccgagacgttgtgtctgtgccccttctcccctgagctgagcagcagtgtgttccctagtccattcccagcccagagcatgcaccccccgccccgcccccacctccttcctcatcctggagcccagggagccctgagtcatggctcacccggctgaggccctcttgcccagctgagaccctctagggacccccacagtaacagtgcccagaacaaagctggcatcacaaagcatcggggactctgcctcagccctttgccagtcttgtttccgtcccgtcctgctggccctgtccctgccatctgccctctgctgtgccaggcagtcatttgtttcccagggcttgttgggggcctccgggcctccagcctgccatctcctcactcccaattgctgtgccaaaagccactcttccccactagagcgtccccatggcccttctcccaacacccacccatccaccaagcccaccccaccccaggagggcaagaccccatttgggtccctctcatctgccttccagggcaaaggcggcaccaagaccctgatgaacaccatcatgcagctgcggaagatctgcaaccacccctacatgttccagcacatcgaggtgagcccgccgcggctgggacggctcaggccctgctgtctgctgagctcctaggcagagctggcttctcctcgacagctctttaaaaacagactcgaatattttcattaggtaatgcctgtacatctgtctctcatttggtcttcgcttcaccagtgcttacgggaagaatcccagcagttagggcgcaacgtgcgataggaatatagggccctgaaagcttgccctcagagagcaggagcgtttggagacttctctggggatgtgtccccccacagtggggtcctgctgcgtctctttggctcactggcttttctcacgttgcggggcgtcaagagtcaccaccgtcttcagtgaagtgtgggggagtcagaaccctttttggtcatggtggctttgagaatctgggttcttagaagcatgcatatgttcgtgtttcttggtgtaaagtgtcagggtcgttggagaccgcctgctgccccgagagcccctggggctgtctcagcaccctgagcgtggctgtggccccatgacgtcctcgtgcattcagggtgtgaagagtgctgtatgggatgtcctttccttcgttggaggagtgtgagggaaaggatgtcagtggactaagaaagatggttttggcatctgtgtctggtctcagagccgccgtgggcccgtgccgagcacacagtgtgggggctttgtcctctgagcacgagcggtgtgtgcggaccgcagcggggcccggtggcctgctcctgcctgtcactgacccctctctccttgccttgcaggagtccttttccgagcacttggggttcactggcggcattgtccaagggtgagaagcttcccaactggatggggtgggcaggtggtccacccagaggttttctgtcgttttgttggctttattgctgctgttatgttgtccaatttcaaaggcagaaaattagaaaatacagaagaatccaaagcaaataatacaaatctttttttttttttttttttgaggtggagttttgctcttgttgcccaggctggagtgcagtgacacaatctcggctcactgcaacctctgcctcctgggttcaaatgattctcctgcctcagcctcccgagtagctgggattaccggcacctgccaccacccagctaattttttgtatttttagtagagatggggtttcaccatgttgaccaggctgatcttgaactcctgacctcaagtgatccacccgccttggcctcccaaagtgctggaattacaggtgtgagccaccgcgcccggccccattatacaaatctttagtgcttggagagctgaccactattaaccccaagagacaggattcctgaggcagacctggcttacagatcccactctgccgcctccaagctctgtgactctagacagctttcttaacctctctgagcctaaactctgctcactagtacagaggcactctttacatcatgtgggtgttttctatagcaccctttgtaaggggcagcccagactcctttaagcccctaatggatgtggatgctgtgtctagattttcaccattgcaaagaaccttgctaaaagcattcttccagctaaagcctccattcaattcccctggggtagtaagccatttgcaagaagagaggcgcctaatgaaaacatcacaaattctttttgatgtgtttttttatactgagttgtggaacagggtcctgtacacctggcttcaaggctgggaggcctggcttggacatgtggtcagccatatcacgtcgtccccctgccagcctcagtgtccacatctacaacacttggggtttggctggagagaacatgagaagccgaggtggcccttccttctgggtctagcagagcatgggtgtctccagtgtggcatttgctcctggggcttctttatcgggcaaggggacaaggtctggcttcccggagcatccctgttccagccccgtgttgtgccggccatgtgactcacagctcctctcattttcatgagtgtctgggtttgacgagaaatacatgtgccaccctggtgatacgcctccccagcgagggtggccgggcttatttcagttgggggaaatggctttgctgaagctttgggtgggtgacgtctgcttaggatgcatgtctgtgcccttgaacccggcgcctggcctggaggcgggcgatgcacctcctgccttacctgcctgcagggttccaggtttaacatcctgcgccttctctcctgcctcctccacactccaggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggtgagtatgagccagtgaggcgtttcttacagggttttgttgttgtggctgccacagaagctcctcactggcattccctcctgtgaggcagggtgaggcccaggcgctctgggtccagtggccagagtgggcctagccacaggctgagcatcttgggcactcggcactgggacaggccgtggattggacgccgggtgtcctgactcctaggctgacagtctttccacgacaatgctgggcgcactggggaaggggtgccctgtgcacttttagctggaagtgacagaattccataccatgtggacacaggaaagaaagcaccaataggcttacatagctctaaccccaggaggttaaacatccttcaggcacagctggatccaggcatgcaggtgatattggagagacttttctccagctctttgctctgccttcttccatcttggcttcctttccacctgctcagtgtccccaacaaaggcaggtcccaggctggctctcatttagctgctgtgagccgcatgcccatccctgggccattcgtagcagcccagtgactgccaccttgccacaggtcaggcctggacctggaatcagactctgtggtgagcacggagggagggaagcaagcactgccaggcaggagcagcagctgccgtagagaggctctcagcccaaccccctgccctgcggtccctgatgggaaaggtcaccgcctgtgtttctgcgcctgcctgccccagcacacgggagctcagggaggagaggctgtgagatgccgacagggcacgtgagacatgtctgtcagtcccagtgggtcagggagccctggagtgagttcttcgtgggagttactagaactgggcttacgagaaacacgagcatgagctgctgagacagacacggctcagccagtttgttgttccctacacgacctcccagagcctttgttgaagctcctgtgcaaggtctgtctcacagcaggacaccccagacctccataccccttgtcccgttgatcacttggacctgtgtttgctgggccaacctgcccaggtgccacccggagtgtgccctgtgtgtccctccaaactgcaggtcctccccggggttctgtccaggaccactctacagacacgagtctgttgcaggggtctccccggcttgccttcttccttgggggcttcccactttcagctttgaggctgaaaaccaaaatccttcagggtcctcatggccgggccaccccccaccctttcctctcctacggtctctccagcggcttctcccgtcctcgagagggccaaggcttcctgagggccatcccgtctgtgtcgtgtccctgactcccccaggagagagcctggttcccacccatcccagtgcccttctgcctactccataaggacaaggactttggtcagttgaactacagatgtgtcctctgcatgtgatgtggtcatggccacagggccagagaatccattgcgagtagaggaagggtaggagctcagtgaagtctcctgagactgcatctcccatgggtgggctggcatctgggagccgggtggcccctcacctcagcccctcctccgagctggagtagcaggggcacatctggtgcctgagagagggtgggacggcaggtggatggccaggctactgtgggcttctgcaccgtgcctgggcatgtgtaggctggtggcaggaaatggccagtttttatttcttcttttttttgagacggagtttcactcttgttgcccaggctggagtgcagtggcatgatctcagctcactgcaacctccgccgcctggattcaagcgattctcctgcctcatcctccctggtatctgggattacaggcgcccgccactacgcccagctaattttcttgtatttttagtagagacggggtttcaccatgttggccaggctggtctcgaactcctgtcctcaggcgatccacccacctcagcctcccaaagtgttgggattacaggcatgagtcaccgcgcccggcctgccagtttttatttcatcaccaaaatgacttcagtgttcaggggcacctctgtccgaactcccagcagcgcagggagtgttgacattgccttaatgcccacaacgctgagggcatcgtgggttgtcacccaggagacctgctctggctccttgacttgggttttctggggcatggggacactgatcctgccagaaaggacacgagccccctttataaggtctccatgcttttaccgtagaagattctctttgtgaaccacaaaactttttgagacagggctgaaggcaggtgcacccacagtcactgtccacccacccccaggtcccttgtgttgcgagcggcggtgttgccggcattggccgctgtgtcttccgctccccatggaatggcacagggtagagtagaggagagaatccagggctgtggtggtggtggctgtgctgacgctggacgctgtggcctagctgtgggctgggtgctggactctgtgctccaggcccacctcctctagttctcccagcggggcctgttttcatttctgggatgtgtggagagacgttttgtggtgaaacactggaaatccagttattcgccagtggcccacaggcccgtgtggagagtgcggagccagggatctggggatgctggcaggtgctgatcctgctcctgctctcagaagcaggtgttccttggtgtccccactctacccctgaggtcaccccgctgaccctgttctcctctgtgcccgtcaggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggtaaaagcgggccgggccccaggtcgaggagaaggaagggggtgcctgcaaaacctcgaggagacggccctggcttgagggtcctccagcctcctccacattgtcttggaccccaggagccgggaggagctgcacccatatctccataggtcatcagggagaaaagaggcggggtcctcctgtttcccaaaatacaaacagcctttccctctgattgggaaagcagtgtataagccatccgtcggtttggtttttcttaaatcttggaatggcacccatgaggaggtggaaagtatcctgatcaatctgcgccgtcactgtggggcggcccctgcagtgtgccctgtgagcacacacactggcgcttgttcagacacaattgggggtaaactccatgccacttcgtttacttcctcctcttgttccataaccatgtacccctcatgggcctcggcatcggtggataccaggtcatgctgttacatagctacaagaatttgaaaatgagttaaacttttctctgtgtttcattataagactgataagttcttattgtttttaacatgtaaacaccagtgacagtcaggagtcccttttcccttcctctccaaccgtgctctcttctgagcctctgccagcccatctgccttcgcacatgtatgtactgagattaacacagatgcggcgtggcctagcatgtgcctcttccaccaagcagtgggtgtcaaccgccgagtgcacatcggaagctacccagccatctaatcggccaccaggcgtcccggcagatggccacccctggacgtctgctctcaaactctggttggcaggcatccgtcttttctgttgatcagcctggtcaccaacccagcagggtccctctttctctcagagtgcttgtgcaaacaccctaggtctgcgcagccctcagacatggggtcgctccaccccagacattgtcctcttcgtgttctggttgctactgccaaagtggtttcactcctacgctggggtgtgaatgtaccctgcccttccctgcagcgtgagggcagcagcgttctcagtgtgtaaattgtcgcttgtctgatgggtgaatgccgtggtggtcactggtggccccttttacgatcaggctggggtgtagcttctgcccagaccctggtgaccagccagtttcttaggaggtggttgagttgtgtgtccccgttggcaggccggcagcaggcggaagctgcacctcagggctgggggcgcgttggggagggctggccctgccaggaagtgtgctgacagggcaggagggctgagcggcagacacaaggcactcctggtccccaccagctgtggcctctgccaccccatgggtgccagtcttaagtttcagagcatcactggtactcaccctggtcctgcagctcctgggcccagagacaggatttcgtgttagcctcctcgtactgtgctggggtgatgataaaactaacaacccaggctggacgcagtggctcacacccgaaatcccaacattttgggaggccgaggtgggtggatcaactgaggtcaggagttcgagaccagcctggccaacatggcgaaaccctgtctctactaaaaatacaaaaattagccaggcatggtggtgcatgcctgtagccccagctactcaggaagctgaggcagaaaaatcgcttgaacttcgggaggcagaggttgcagtgagctgagatcgcaccactgcactccagcctgggcgacagagcgagactttgtctcaaaaaaaaaaaaaaagaaaaaaagcccatccacggcacctgcattgttgggagctaactgcaccagtcactgggccacactcctggtgcttattcactcattcgaggtatgcagtagccacgggttgggccccatgtaggctgagggagttttgaggctcacagaggtgagacctggttccggttctgtgtgcactgtgagagtggcagggcccacagccaaaccaagcactgccacaacacggccgagcttcggccccctgttgtaaatggtgctcgactgtgtaggtccacgctgtggggagctgtgccgctgccacgggagctgcttgagaatataatcccctggggggttggtgctttcttcccgaatatctgtggggtcccaataaggtagaaggtggcacttctggaggaacgtgatgagagtccccttcccccgagggacacatggcggcccaggctccaccagctctgttttcatgcggcggcaggtcaggctgggcagaattgtcaggccgagggtggcacgcacagcacacctctccagctagtgtcagaggccaccttcccttttatgacctcctgggctcctttgggactgactggcacctcttcccccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggtgagcccagcaccggccccgacccctccccagcgtgaatggtggacgcgtgagcggctttcatttttgtttttttaccttttttgcactcttattttttttgcatccctttggagtaaagggagtgtgggctgaacggaaagaggatgagtacttgctttttctttgaagtggtttttttttctaaactgctggtgaaagacgccggattgacagccctggagactgaagtcctctatttatccacagagcagacactgcagcacgggcagcggcagtgccagcttcgcccacactgcccctccgccagcgggcgtcaaccccgacttggaggagccacctctaaaggtgagaggggtagttcagtctccatgcccattcaatcctcggcttctcggctgagacggccagcaagggccctggtcccacggagcgtgcgtgtgcgtgtgcgtgtgtgtgcctttcgctgccgtgtgggtccccatccaccgcagccgtgccgggaccaccagctcattcccacggacgccgccgctcgcctctgagctcggccgccgcccaccccggcccctcctcagcggcactgacagtttgcaatcttataggaggaagacgaggtgcccgacgacgagaccgtcaaccagatgatcgcccggcacgaggaggagtttgatctgttcatggtaagcgctgcaggctggatggggcagttcaggcatcccactctgctgccaccaggagcaaagcagacgtcctagtgcccatggtggtatccctagcaggtcagggagccagggacagctcacagtgcagcccactcccacctccagactgacccgtcttccacccccagtctcctgaggatggcatcggagggcgagatgcacacccagccttctgcatgtgacccgagacctgccccaccagctctgttttctaacgggctctccagggcttcatgcactccctttcagagggagttcgccctatccaaggccaagggactgaccaggccttcagtcgcagagcccccttgcccctgggtgggaaacaggaaataagccacccaagcaggggccccttggcccgcaggcctcatgcctccaccaacgctgggccacgcagctgctgcccccctgctggggtctgcagccctcttgtgcaaccttccatcttttcgagtttcctctgcctcctgaggcagagcctctagtcagggtctgacggagccaggccaggtcagccactgaaaaatcgagagctactgtttaactctcgcagcagcgtggagccccacgggcagagaaaggcccttctgaactctcggtgttctggctctagcgtgcccctggtgcctgcatgctgatgcctctcccgttgcctccctgcccaccagcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggtacatgctggagaggcccagcagctgccgcaggccagcgccaggcagggctggggagacaaagggcccaccgccaggactcaggcctgggtccaaaatgctttccttgggccactcctggccaggctccgcaggcagccgagagccttccgatgtgggccagggatggtcaggtccttttggctctgccttggaatgcaagaaggacccacggttcctgagcagctcaaaacctgctgctggttatggttggtctttcaagtaaaagggtttacctcttcccgaggttaaaaatcatgttgctgatctcagtggactgctggctttcccagtacctgccaggagggaggcacaagggtgaatcatggactattgaggcgccctgcaaagcgttgcactgctggctgcaggcagcctcactttgggcaagtccccccccatgagctggggagactcagtcatggggagggaggagagggcaagcccccaagggcctctgaacctggcaggtgctgcacggggctggcagttgcttgtggagctgacgtgagggcccgttctcagcagatggcagctggccctgcaacagcagctgcagatgtctttgagtcagtcgtgcggtgctcctggggcttcacccgacccaactttcccagcccaaggcacactgtgacagatgcctggcactgatgtcctcactggggttacggtgacagatcagaccccttcccagctcaggggctctgagttatagagacgatgattcagaatccatccctgaagttgtgtcataaaaatgtcctgaagcaataattccgagaaggcaggtggcagcttttggctatgccatgcaaagtgccacacccaggaaagagccatgtggcctagcccatgtggccaaacagccccggttccctcctgggacctcagcagcccagactcatgagcttgcctgccaagctgtgcaccagagggcgctgttgaaacacaccaggagcccaggtgacagacaggccatcctgttccccagccagcctcccaagcacagcgctccaggacccagaagagaaaccctgaaaagacagtgtgagccctgccacagacctgtgtgacagcagagctgtttggctgctgtatgagtgtcaccggccctgcatttttttcttttttaataaagacaaagtcttgctgtgttacccaggctggcctccagttcctgggggctcaagtgatcctcacacctcagcctcctgagtagttcagactacaggtacacaccaacacgcctggctaattttaaattttttgtaaagtgggggtctcactgtgtcactcaggctggtctcaaactcctgggctcaaacaatccacccgcctcggcctgcagagtagctgggattacgagcatgagccacggtgcccagctcagccctgcatatttgaggcagtgagtaccttttaaatttaagatcagttcatacgtggctgctctatgtacatttttttctaggtgtaatttacataccatacagttcacccttttggggtatatgatacaatcatcttcagtgtatccaagagttgtgcatctctcaccacagtccattttagaacattctcatcgcccccaaaagaagccctgccccgatttgccattcctggtaattcatggattctccccagccccaggcaaccactgatgtactttctgtccatatagttttacctgttctgggcgtttcctgtcagtggagtcctacagcgtgggatgctttggtgtcaggcttttttcacgcaatgtaacatgctgacccatgatgcagcaggtgtgttgcattctttgatggtgaaataatcctgcctcgtacagatttgtcacattcggtttttctgtccattcttgatggacacttgggttgtatccactttcgggctattacaaacaatactaccgtgaacattcacgtacacgtttttgcgtgcacgcgtttctctttaatatgtgatttctctttaatatctgatttctctttaatatgtgcctaggcgtagagttgccggaacaatgttagttctctatttaaccttttgagggaccccagcctggtttccttggtggctacgccagttcacagttccaccagctgtgtatgagaattcctctttctctacatcctcagcaacccttgctgttccctcgcccgctgattctagccatcccagcacgtatgaagtgccatctgagtgtggttggatttgcatttccctgatggctaatggtgtggagtatctgttcatatgcttcttggccctttgtgtatcctctagaaagagatgtctagtcacatcatcctttacccaaatttaaaatatatttatcttaatattgaattgtaagttatttacaagtgccttatcagatatcatttgtaaatattttgttccattctgcacattctcttttcgcttccgtgatatccgttgaagcacagaagtgtttcattgtacttacagtcgatttttctttttcacctgtgccttggtgttgtatctgagaaaccatcgcctatccaaggtcacgaagacttgcccctgtcttttctcctaggagggttataatttgatctcttccatgtagatccatgtaagatccattttgagttaaattttatacatgatgtgaggtaggggtccatcttcatccatccaactggaaatccagttgtcccagcagcatttgttgaagagactattttttcccattgagcccatcttattacacagtatattcaaattcacagttgtgaaaaatattatacaaaacactgtctccccactactgttggctgtggaattggcaccacttttctggcagccatctgttgccaagtgaactcaaagccttcaaaatgctcctatggccgccatcggacatggccatgactgtggcagcctaaagcaacagaactattttctctgcattctgggccagaagtctgaacccacggtgtgggcagggctgtgttcctttcgaggccctaggagaggacccttccttggcttttccagcttctgatggttccagaagcctcctggcttggggcagcgtcaccccatctctgcctctgtcttcatggggacttctcctctgtgtccccttctgtgtcttttaagaacaatttttaaaacttaatcccaaaagtaaagacctcatttgcaaagaaggtcccattccgaggttccaggtagacatgagtctggggggcacccgccgctccgccctgggtctgcagggggccttctcctggtgcctcctgcctgctgtgccctccatgctgcttctttgacccggttgccttccatcctcctgggcccctcaggctctcagcttcccatcttctctaagacatgtctgctccatcattctggtgtctctctcttccctccttcctggcacctgacacgtttgttaccccacttgtggggtgttgctgtctgatcaccatcttccttccaagggtaggggaaagggccctggctggttcaagtcacagctctgtcctcagcgccaggcacagtgcccagctcactggcacagcctcagattccctggacacctggctccccggctgcattttttaccattgggataagttattagtaccattgaaaattaatacctggggattctcttaatattgttcatattcatgttcttctcagcagttttaccatgaggaatctgtcttaaacaatgtcagttgtcaatagcgttatttaaaatagcaacaacaataaaaaaaggtggtcagacctggcagcttgtgcctgtaatcccagcacttggagaagccaaagcggggggatcatttcagctcaggagtttgagaccagtctggccaaaatagcaagacctttgtctctattaaaaaaaaaaatgccaggcacagtgacacatgcctgtaatcccaagcactttgggaggccgaggtgggcagatcacctgaggtcaggagctcaagaccagcctggccaacatggcaaaaacccgtttctactaaaaatacaaaaattagccaggcatggtggtgggcacctgtcatcccagctacttgggaggctgagtcaggagaatcactggaacctaggagttggagtttgtagtgagccaagatcgcaccactgcactccagcctgggcgacagaatgagaccctgtctctgaaaaaaagggaaatgacctaaatgcccaagaacaaggggaggctaaattagggcacgttgtgcactgaaacactaaacagacattaaaaaattttgttgtagaaaattacaggaaaagatatccatgacacagccagcagtgtggcacgtgggctacaattccagcgtggccttcagttctgcacacgtgcgtcaaaggtggggagagttctggtggtgggtggcgctgagggctgcacaacactggggacgtgcctaatgcccctgaactgtgtactaaaacatggctgctttggtaaattttatgttatatatgatttataatatatttttttaaatgcccagctactcaggaggctaagatgggaagatcacttgagcccaggagttaaagtccaaccagggcaatgtagcaagaccacatgtctaagaaaatttaaaaatcggctgggcgcggtggctcacgcctgtaatcccagcactttgagaggccgacatgggtggatcacgaggttaagagattaagaccatcctggccaacatggtaaaaccctgtctctactaaaaataccaaaattagctggacgtggtggtgggcgcctgtagtcccagctactcaggagggtgagggaggagaatcgcttgaaccaggaaggtggaggttgcagtgagctgagattgcaccactgcactccagcctggtgacagagcgagactgcgtctcaacaacaacaaaaaagaaaatttaaaaataatttttcatacaaaaattagccaggtgtggtggcacgtacctgtaatcccaggtacttgggaggctgaagcaggagaattgcttgaacccaggaggcggaggttgcagtgagccgagattgcaccactgcactccaacctcggtgacaagagcgaaactccgtctcaaaaatataaaaataatttttaaaatgtcttaaaaaggccgggtgtggtggctcacacctgtaatcccagcactttgggaggccgaggcgggcagatcacaaggtcaagagtttgagaccatcctgaccaacatggtgaaaccctgtctctactaaaaatacaaaaattagctaggcgtggtggtttgcgcctgtaatcccagctactcaggaggctgaggcaggagagttgcttgaacccaggaggcggaggttgcagtgagccaagatcatgccactgcactccagcctggtgacagagtgagactccgtctccaaaaaaaaaaaaaaaaaaatcttaaaaagaagaaatagatggaggccaggcccagtggcttatatctgtaatcctagcactttgggaggctaagatgggagcactgcttgagaccaggagttcaagaccagcctgggcaatattatgagaccccgtatctacaaaaaatttttttaattagctgagtgtggtgacacgtgcctgtagtcccagctacttaggaggctgaggtgggaggatctcttgagccctgggagttcaagactgcagtgagctatgatggtgccactgcactccagcctgggcaacaggtcgagaccctgtctctaaaaataaataagtaaataaaagaaatagatggggagagtgtggaacagaggtgtcaacatcacctccgggtgaagggatttcaggagcacgttcttttctgtacagagaagatagttctttttttttggtcaagaaattcaaccattagttttttaaagacaagcttgggtggggtgcctgctgggggcagtgctggtctttcactgcagcccaggcaccccttgagagtcccagtgtgtgttatgccccgagccagtcaagctgaagggagagcgggtgcgggggccctcctccgtgtcccagcccggcccctgggattgcgtcgcggcctctgcttgtcgacctgggtgctggctgtcctattttactactattgaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacaggtaagcgaggaggcggggagggcgggggctgtaggggtccccgtgggagcaggcctggcatctgcactctgactctgcacactcaggcttgggccgctcactctttcactcatccacaaacactgactgaatctctgtgtctttgagcctggccctgaggaacatgctttctggaacagggaagcacacatgtatctgcggtgatgagagggaatgtcacatgtggtcgagaggagaggcaggggtgcgggtctcggagaaggggacattgcagcagagccttgagagaggggaggttggggagagtgcaccagcagaggccacagcaggcggagaggctctgccaaagttgtggcctggtggcctcaagggatgaggtgggatgaggggttatatggcagtaatgggtgctgcccgtgtggccaggaggttggggacaagaggctggcatgtctggagcagagaaagtggcagccctctcctgtccttgcaccctcccaggctacctgtgccatctctgtgttggtgagatggtggccacactcctgctctctgccaggccctgctccaagcctggagatcgctgtcctcacagacatgtcctatatacgaggcagcatgcggttccagctgtggccacggcccagcggcggatcataacgtgttggtggatcatgagtgccatttatatgtttttcatttactaatatccttttccgtgagcgactctatatgggtaccatttaaataagaagaaaggaatgttctcagcaactccccagggaggcatgtgcaccttctgccagcccagggcaggtcacagagctgggcaggagccagcaaaggtgtaaggcccatgcctggcccaggactcacccagtcttccactctccaaggtcttatttcacttcctggtacacactggccagtacggctgtccccgtaatgggagggttgtactgtttgattttaaataacagtttgctgttagtcatgaagcagagcgtgggggaattgtatctgttggaggggaaagtgaagggagcccacatgcatggtttggagagaatcttaccaagtgtgaagttttagaggatggtaacaattggagtgcctaaattaatgagtcaaaattaccgcgcaaggccagctgtggtggtccacacctgtcagcccagcactttgagaggctgaggtgggaggatcacttgaggtcaggagtttgagaccagcatggacaacatggtgaaaacccatctttactgaaaataggaaaacaattacctgggcgtggtggcacgctttttgggaggctgagacaggagaatcacttgaacccaggaagtggaggttgctgtggaccaagattgcaccactgcactccagccttgggtgacagagcaagacgcccactccaaaaacaaaatactgcttaaaaaggttcttttagccagatgcggtggctcatgcctgtaatcccagcactttaggaggccaaggcgggcggatcacttgaggtcaggagtttgaaaccagcatggccaatatggcgaaaccccctctctactaaaactacaaaaattcgccgagcgtagtggtgcatgcctgtaatcccagctactcgggaggctgaggtaggagaatcttgaagctgggaggcggaggttgcagtgacccaagatcacatcagtgcactccagcctgggggacagagtgagactccgtctcaaaaagagaaaaaaagaaaggttcttttattattggaagagaaacagatgatgaaggaaaggagacatattcaagttcaatgccagatctgaaaatgtcatgtgttgtcagtattgagaaaaaaatatatagactctaattcacaaacctaactccaaggctaagtcctcaaagaggaaagcaagtggaggacttaagttacttaaagtgcgggatacagctgcgggcagtagcacatgcctggggtccccactacttgggaggctgaggtgggaggatcacttgagcacagcaggtccaggctacagtgagccatgatcacacagctgcactccatcctgggtgatggaatgagaccctgtatcttaaaaaaatgaaataaatacagaatacttatttaaaacatgggccaggtatagtggctcgtgtaatcccagcactttgggaggctgaggtgggcggatcacttgaagttaggagtttgagaccagtctggccaacatggcaaaaccccatctctacaaaaaatacaaaaatagaaattaaactggcatggtgatgcgtgcttgagctcccagctcgggaggctgggcacgagaatcgcttgaacccagaaggcagagggtgcagtgagccaagattgcaccactgcactccagcctgggtgacagagtgagacaatacctgaaaaacaaaaaacaaaaacaaaaaaagggaattcgcagaaatctaatgacaatgacagaccctccccatgttttatttctaatgataatcttgtgagggaaacttaacattaccaacctaaagaagacccttgaagcgcagtggggaaagcacgggtgtctccatcacactggtctcctgggtatccacgtagagaggatgagcctcgaccacccccacacacgcacacaccatgcacttggatccacgtgacatggactgtggatgtaagaacgtgaaaggtaaaacaaaattctagaagaaagcacgggagaaaatcttcatgagtaggcatcgatttcttccacgggagccaaaagccactaatcacaaacaattgagaaattagacctcactgaaattaataacatctgtttattaatggacacgctgatggagacagtgaaaactcctcatagatgaggaaaagacaacacaatttaaagctggacaagagccgggaacagacgcctccttacacaggacatcccaggactaatcaatgtggggaaaggtgctcacgtcattgcattagcatcacaacttcaagaaaatgctcgttaaaaccagagtgacttgcaccagcacccgccccagaacggccgaatgcccatcagtgctggcaagtctgaagcagtctggcctcacaccctgcgtgtaggagtatgcagctctttggcaatctcttctgttttgctttgtttgtttttaaccatcgaactgcagaagataatattttctgaggctcagcctgtacataccctctgacccagcagcctgcagccctcgttctacccaggagagctgagtgcatctgtccacaccgacagacgtgtccatagccactttggtcataatctcccaaaacaagaatcagcccagtgtccatctacaggggcatggatcagtggaggcctaatcgtacagggccccaaacagctgtgaaaacagacatagtactgctacctggaagaagcttacattttgttgagtgaaagaagccagacactaaaaagggcatactggccgggcacggtggctcacgcctgtaatcccagcactttgggaggccgaggcgggcggatcacgaggtcaggagattgagaccatcctggctaacatggtgaaacaccgtctctactaaaaatacaaaaaattagccgggtgtggtggtgggcgcctgtagtcccagctactcgggaggctgaggcgggagaatggcatgaacccaggaggcggagcttgcagtgagccgagaccgcgccacggcactccagcctgggcgacagagcgggactccgtctaaaaaaaaaaagagggcctactgtgtgcctccagttctgtgagggtcagaagctgatccacagtaatggctgccaagcagtgcttaccttgagagagggaatagcaggaaagccacacgacgagccttctaggatactggggatattctctctatagatctggatgtgtatatgatgtgtacattcaccaaggtgtacacatgagatatgtacacttctctgtattccattacaccttggtttttgaaaagacagaaacagcatgctcagcttattaagaacctgaatattttcagacaaaaagtatgtctagtgttagtccacttttttttttttttagttttagactcacagagccctcttagggtcatatttagttgtatatcatctgacaaaagagggaatggctcacccagctgctacagtcagtcttgtagcctttgtaagatttgatgataaatcatacaataaattaaaactttcggctgggcacagtggctcacgcccataatcccagcactttgggaggccgaggcggaggatcacttgagcccaggagttcagatgagcctggccaacatagtgagactctgtctctatttaaaaaaaagaagaaaaaaaaagtctgggtgtggtggctcacgcctgtaatcccagcactttgggaggctgaggcgagcggatcacaaggccaggagatcaagaccatgctggctaacacagtgaaaccccgtctctactaaaaatacaaaaaattagccaggcgtggtggcgggcgcctgtagtcccagatactcgagaggctgaggcaggagaatggcgtgaacccgggaggcagagcttgcagtgagccgagattgtgccactgcactccagcctgggcgacagagcgagactccgtctcaaaaaaaaaaaaaaaaccccaaatcttaactcttactgctaagtgactgctttatcgaaactgttctgtttcgggacatttgattctggtagagattttgagacctgctttgaagaggacaccaacatttcagtcacacagcaatgctcctgtcttacctgggatccatgtgggaggatgcctcagtgggggatttgatctgtgttttcaatttaacctcacatcttactggaatggatggattcacagacctgggggtcgcccattggactgggagtaactacgttggaattacaagtaggacaacaaagatgactattaaagaaagcctcctgagtgctggaagcacagcaggcgtgggtctgtccactcactgtaatgtgatttgcacaggaaaacatcacatagggcacatcaactcaggaaagatagtcgttgaaaagctacctcagctgggcgtagtggtcacgcctgtaatcccagaactttgtaaggctgtgaggcttgtggatcccttgagaccaagagtacgagaccaacctgagcaaaacagggagaccccgcctatgcaaaaaatacaaaaattagccaggcgtggtggtgcactcctgttgactcagctattcaggaagctgaggcagaaggaccacaagaagtcaaggccgcagtggggtataatcacatcactgcactccaccatgggtgacagaggtgagaccctgttgcaaaaaaaaaaaaaaaaaaagcaaaagaaaagctgcctccatttagcaataatttcaaacatgatgtttgggtacaaaattggtgtacttaatggatatttctgatattcttaactaaatttgaagctgtgagggaagacaaactcagggtccacagggtgggaaaagtccacaagatcaccctcaagtgccgtcattctctaggaccccgagagccctagcggttgttacgcttgcagttatgatttattacagtgcaaggctacagattaaaatcaaccaaggcaagagatgtatggggcctcttgggggccaaggtgggcggatcacttgaggtgatctggacggttccagacacagggctttcctttgtctcctccctgtggagttgaagacagcgctgatgttcccggtgacgttgacacagagcactgccaaccagagaagcctccgtgtccagaggtttttttttttttttggagatgcagtctcactctgtcactcaggctggagtgcagtggcactatcttggctcactgtaacctctgcctcctgggttgaagtgattcttctgcctcagcctcctgagcaactgggattacaggctcgcgccaccacgcctggctaatttttgtattttttagtagagatggggtttcaccatgttggccaggctggtctcgaactcccgaccttaagtgatccgcccgcctcagcctcccgaagtgttgggattacaggcatgagccaccgtacccaccctgtgtccagcatttttactgggacttggtcacaaagacacagctggctacccacgtggctgacctccatctccagcccctctgcaggtgagcagaaactacatagcccaaagccccaacctaggactggtcccagaccccacgtaaacaaagacagccattaggtgtgacattctaaggactcagagatcacctcccaggagccccaggcaaaagccagacctcatttggggcgaagttacattcttttttattattattattatttgcccatcattgtctagaagttacattctgtatgacacatctgtcagatccctggaagcttcctcgccaccgactgcatggcaggtggtgctcatgtcactcggcccttccttggccccacacagctgcaccaggctgagaagagcttgaatggaataaagtcagacacagctaacagctcacttttttgtctccaactttgaattgctcctttccaagaaaagaaaaaaaacttctttttgtttaattggatttttttttttatttattttttgaggcagagtctcactctgtcacccaggctggagtgccatggcacaatctcggctccctgcaacctccaccttccaggttgaagtgattctcctgcctcagcctcccaagtagctgggattacaggtgcacaccaccatcatgcctggccggaatttttgttttttagttggctctccagaaccctctaagtagttcagctctgcaattgagttaaatgtgaagcctgaaaagagactggcatctgtgtagacctgagttctaacaattcaaagagtgaacacgggacgttgtcctctggattcggtgtcaggagcctgcctcgccgagctggagagtgtgcccatgactgcaggtgggagccacatggtccgtctaggtggcgacacctgaggacagaagtggtttagctgggcacccgctgctgtgttggggccagacccttttggagaggcagggacgcccttcctgtcaggtggaatcttttcaaatattgcttttgatcgttggagatacttgcagccccctagttcgtgttttattctggcagaattgtgtttgacgtgacctctgtgttgacctcatcatacgtgtacagttgtcttgcctgggaatcttatactctgttcttctgcactcagattcacagccatgaggccgctcctcccaaggccctggagtgtggcactgccagctgtcacagccacggtcctttacattgtatacacagagtgcagtgacatgcccctcctgctcaggggccacagtaggaacaggctggagtgttctgtggtaccatgccggcagtgctggcttctgctgtccaggggcttgtggtggctccagtgggaagggccacgtaagcagaacaggaagtgtgagcagtgtccactgggaggagagggacaagtgtcccaggcagagaggacacagtgcatgcagaggctggagggaggctaggggcttgagtggggctgcgccagcaccaggggcctcacaggggccctgggccacacacctgcccttagccaagggcgtttctccttggtggtttgaaatctcaaaccacattgaggaacctgccagaaatcgaaaccagaattaagaaattaagttacatgtaggagattttactttaaaatcagaacatgcagaaacgttctctgtggcttcgggtcaggttcgggcttgtggggctgtacactgccagttgataccttcttccctgggttctgtgtttttttttttttttttgagacagagtcttgctctgtagcccaggctggagtgcagtggcacagtcttggctcactgcaacctctgcctccctccctgggttctttatagcagtcagcagctggtggctgaggcatttggggcactgtgtccaagtgtcaaggccgcatgtgtgtcagggggcacacccttggtgtgcttggtaagggctcagagaagggcatctgctggtccatgtgggctcagccagcagcctgctaaagaccaccccgccagccaccagcctgcctgcgacagtgatagggcagagatgctgctacaataaagaccatgcgggccaggcgcaggcgctcacatctgtaatcccagcactttgggaggccaagccgggctgatcacttgagctcagaagtttgagaacagcttggccaacgtggcaaaaaccccgtctctattaaaatacaaaaattagccaggcatggtggcactcgcctgtaatcccagctacttgggaggctgaggcaggagaatcgcttgaacccaggaggaggtttcggtgagccaagattgcaccactgcactccagcctgggtgacagtgagactacgtctcaaaaaaaaagactgtgctagacggtggtgttgaacttgaacttgatgcttgtgctgaggtcaggagacacgtgcacagcttcagggctagaggggcacaatggctgcagactatgctcgggcagctcggaaagacggtgacgggtccaggctgccgcagctaagcctcacaagagctctggccccaccaggcgggccctctgggttccattcccactccccactgcctggaggcagcagccctgtggttactgtaggagggacctgaatgcagtgaagatctgcactccacacctgtctctgtgcctcagtctccacgtctgcagcacaggggcctgactgaaataacgtggccaggcacacagcccagacgccagcactgtgtgcactgtgggaggggacgatggtccctagcccagggcctgagctgctgccttgccaattcgtggtgacagctttggcctgggtctggcaggggctggctgctactgctgaaggcctgtctgcactgtttccctgcctttccacaagcactgtccctcctggctcttcagagttgagtggttataccttgtgcaagaaaaacaatgaaacagattgtctgaatgtttcagacctgcctgaaacattctgcaggagaggtcatcccaaggcttgaaagtgtttgtcacactccttcaagcccccagggcagggcccctgagggaagggtgcaggtggagggtgggcaggagtgggagccattccttggggacaggggggctcctcagggctgtctggcccttggcctgtggttccaggtctatggtctgcttggcacatagcctggaccctggtgctgtgcaggcactggctggatgagggcaccgagcagatgagccccaggcatgcccacttatgggcataggctgggtgcagggcactgggtccaacataaccatggcagagggctcagggggcctaaaagtcatggatggagttgcccacgcagcctgcggtcaggttccctgtggagccgtgctggggttctgcgcctgccccaggatttgctggaagaagctccccctcctctgtttgtgagtcgggccctacccccaagtctccccctcagtgatagagacctttacataacacaaataaacaaggcaactggtttagaagaatgagtctgaaaactagaatggcgtgtttaaggaaagcttaggacaggacaattagagacagaggtgcaggtgtgtggagttggcagcaggaggcctgggggagccgctcgtgcctttccctcctgccctggcctcccttggaactcggagcagccccctgccttgaggaggcccttcctttcagtgagcctgtgccgcagtcgtccgagggaacacagtggggacatatttccttttttttttttttttttgagacagagtctcactctgtcgccaggctggagtgcagtagcctgatctcagctcactgcaaattctgcctcctgggttcaagcaattctcctgtttcagcctcccgagtagctgggactacaggcatgcaccaccacgcccagctaatttttgtatttttagtagagatggggtttaaccacgttggctaggatggtctcgatctcttgacctcatgatccgccagcctcggcctcccaaagtgctgggattacaggagtgagccaccatgtccggccggaaatgtttattaaaatagcagatgaggccgggtgctgtgactcaggcctgtaatcccagcactttgggaggctgaggcgggtggatcacgaggtcaggagttcaagaccagcctgaccaagatggtgaaacccatctctactaaaagtacaaaaattagccgagcgtagtgagacttgcctataatcccagttacgagggaggctgaggcaggagaatcgcttgaacccaggaggcagaggttgcagtgagccgagattgtgccactgcactccagcctgggcaacagagcgagactccgtctcaaaaataaataaataaaaatagatgatcatagacaggagggatgaagtagaagattcaaagcagcttaaaaaaaggaagtaaaaaagaaataaggtcaggagacaagattgagtgactgtgaaacatcaacaataggcagatttaaaataaagtcaggaaatagctagatcaaagaatagaaaggtgaaccaggtgtgatatccacctgtagtcccagcttcttgggaggccaacgcgggaaaatcacgtgagcccaggagttggaggcaccgctgcactcaagcctgggtgacacagtgagaccctgtctcaaaaagcagcaggaagagaggctggcatgtggggctccagggggtgtgaaggagggtccacaccctccttcctccacctggccatactgagcagcacattctctgagccaacggcccctacaaacacccaccctttcctcctggtagcccagagggcgcccctgcctgctcacttcccaatgtcgggatcctgtgatttctgcctcttcagaaaggacttgaggcattttctgactcagagccactcaggattccaggacctcctgtggtgacaacagggacaccagtagtgatgaattcagaaaagagcgaacgcccctcaagctgccctcccccagccctgcagacagtggccatgggcctccctgcactcaggaccgactgcacctgcctgcggcgtaggggagctggggctggcctttccttttcatcttcccctggcactgggaaatgctctgggtggtgccatgtataacaccctttgtcacagtgctctcatttcgtcgtgtaaaaggccagtccccgcctcgcagtgttggggcagccagcacaggcacgtgagacaggagccacacctgggttctcatctggcatctgcctcttgccatgctcaggttcttgcctccagatatagggcatcaaactaagtggtttccaaacttgggttcttggtggggagtgagatcagggtttcttaaaaactgcacttggaggctgggcacggtggctcacgcctgtaattccagcactttgggaggccgaggcgggcggatcacctgaggtcaggagttacaaaaaacggaacctaggctcatgcctataatcccagcacttcgggaggccaaggctggcgaatcgctggaatttaagagttccagaccagcctggccaacgtggcaaaaccctgtttctactcaaaatacgtaagttagccgggcatggtggtgggtgcctgtaatcccagctactcgggaggcggaggtttcagtaagccaagattgcaccactgcactccagcctgggtgacagagtgagactccgtctcaaaaaaaaaaaaaaaaagaaagaaattcaaatctcagtgtcgataaatgaagttttgttggaatgcagccaaagcccaccgatttctgcgttgtctgtggttcccttcatggaacagtggcagaactgagcagttgcaacagaggcaggcccagcaagcctcaaatatttacactgagctgagcgcagtgactcacacctgtaattccagtgctttgggaggctgatgtgggaggatcccttgagcccaggagtttgagaccagcctgggcaacctagtgagaccccatctctacaaaatattttttaaattagccaggtgttgtggcgtgtgcctgtagtcctagctacttgggaggctgaagcagtaggatctcatgagcccaggagttggaggcttcagtgagctaggatggcaccactgcactctagcctgggcaacagaacaagatcgtgtctgtaaaaagagagaaaagaaacagacaattcctagactgcagcaggtgtttgcagtagtgcatccagcaaaggactccccagggaaggaaatgggccaaagatgggaacaagcgctgcttggaagagcctgtgaaacagtgcttggcttctctgcacaacaaggaaacgtgtttagggccacattgtagaatggctacaaggacaagcaccactcacgctggctcagtatctcccaagtagagcatttccccaccctgtgacctagagtatcttctcccagataaattcctaggagaactgcaaactaaacacttgttcctgagtgtccacagacacttgcttcctggtgtccaaccctgagcacagcccagatgcccggcagcgggaactgggcatggctggtgtgtgcccacctcgggacctgctgctgcactcggcaacagggacagcaaggaggcaggaggccaggccaggtttgggggctcccctgtgtgtttctgcatcatcaacttgaagaagcagccaacctcggcccaggatcatccctgggggaaggactgacaggagcgcatctttagcctcatgcttaagatctgtgcattgggccaggtgcggtggctcagcctgtgatcccagcacttttgggaggccaaggtgggtggatcaggaggtcaggagttcgagaccagcctgaccaacatggtgaaacccgtctctactaacaatacaaaaattagctaggtgtggtggtgcacctgtaatgccagctacttggaggctgaggcaggagaatcgcttgaaccctggaggcagaggttgcagtgagccgagatcacgccactgcatgatgtgtgcattggtgttaagtcagctattaagaggtgtgggctgggtgtgtgtgggggtcagaggaggtgatgtttgccctgagatgaggtcagagcccacattcccatgggggtggactcccctttgtaggccttgacacgagcatgggagcggagctaggggcactgacatcaaaggtggtggcgcctatccagaggactccgggtttcattccaagtgcggggaggctgcagcatgtccctctttaatatagaggtgagggaggctctcagcaccctgcctgttgcagggaagcctgaggacaggacctccagggaactctgcaccagagcggaatcctcagaccggcaactgggtggtcttgattcatccagaacgtaattctcctagaggtctgggaaggggtgctcttgtaccttggttttgtgttttgtttttgtttgttttttgagacagagtctcactctgtcgcccaggctagaatgcagtggtgcgatctcggctcactgcaacctctgccacccaggttcaggtgattctcctgcctcagcctcccgagtagctgggattgcaggtgcctgtcaccacgcctggctcatttttgtatttttagtagagacggggtatcactatcttggccaggctggtcttgaactccggacttcgtgatccacccacctcagcctcccaaagttctggggttacaggcgtgagccactgcgcccagccgcaccttgttttttttttgctgcctgtagctgtttctcattagcctgatggaggtggctgttggggtggtggggtgcttattataaagccttctgctgtcacagccctggggtctcacttcctgggctctctgcatagggagccgccctccagggcaagggccacagtgtgcagtaagccccccatggccacagggcagggcgtttcaagccaagagtctgcactgtttgctggccactaagggcattgaatggatcacaaaactggcttttttttcccccagtcaaatagaaatggggttttgccatgttgtccaggctggtctcaaactcctgggctcaagcaatcctcccacgttggcctcccaaagtgctgggattacaggcacgagccaccatatctttaaaaatgtaatagaatggaaaatggcaaagcgcgctgcttttcatagaagagactatcgcattggggttcttctgttgcccctgcctgtgctgcacgtcctgcttcacagtgtaaagcgcaactcttgctgtgccttattgtaacaggtatagggtggatgctgccatcatgaagagagaggagagctctttgcttataaaattccgtagagtggagaacaggatgtgccggcttaggagagggaagaggtacaggcccgctctgcccgagctgcagatgggacacacatttcccgactcagaggggagtcgtgtctttctccagggtcaccgagcagcaagcgcatccactgtgtgttcttattttctgagcctgtggactgggtttaccaacagttgcctgtggcagagccggccaccagcccgctcataggaaaaaggaagcctgtgcctccagggagggcccacgatgggaatgcagtctgagaagggtatgtgctcccatgctggaccggctggtcccacacccaggaccaaaaacacctcctggcaggagatggggagatgtacttcatgaacacacgttggggaaggacactcctggaaggcagaggctcaaggcgggctgtgtccaggccaggagattcactcccacctcaatttcctcctcagcacggctggcctggcactggtgcctgcttcagagtttagtgtgtgtaaagtgtggctggcccagcaagcaggggatgatggcggttgtcaaggccaggggaggtgcagggacaggattctggctcccgtgtgtaacgtctgcatctcaggaggctctcatgttagaagctgggtcaggggcttcgtgatgcacacaaacaccaaacaagcaggaggccttccgggatcctgctcacgagcagcttcctggaggcaagcctggcccgtctgccccttggtgacatcaggaccccagcaacagaaccagggaagccaccatgttgtcgctgccattttccagcgtggtaaacagaagcaagacaaggcgcactcaggacacccaaacagacggcggggccagccagtggcatgggcgggctgccctgccctctggaattttctgggaaagaacataaggaaagaagcggtgctgatgaggcagctggagttatcaggacccaagctcagctcctccttcccatcaggccccgttggccacttttaggcttcgtccgcctggtggctccctgcttggggccgttccctggctaggcccttcctctgggccaaagcagagaggagagcgcgtttgccatgcgttctcattttcccagcctgcgggctgggttctgtcagagcaaggtcagctctcagagcttctgtccccacccaccctgtcctgctgagccaggctcaggtatgggtaagagctgggagcgctgtgcacgaggcctggcagcatctcatcactgccgctgtaccgagtgcacaagggcgcttcctgtggtgttcagggggttagatcagtccccagtgaggacagagcagagatccagatgcatcccaggccggctgcagtggcttctgcctctaatcccagcacttcgggaggccaaggcaggcagatcacgaggtcaagagatcgagaccatcctgaccaacatggtgaaaccctgtctctactaaaaatacaaaaattagccgggtgtggtggctggcatctgtaatcccagctactcgggaggctgaggcaggagaattgcttgagcccaggaggcagaggttgcagtgagccgagatcattccattgcgctccagtctggcgacagaacaagactctgtctcaaaaaaaacaaaaaacaaaaaaatgtatcacaggcctgtttgtgtggttgtctctgggaaatgttccagaagctacaagaaagcacatgtgcaggccaggcatggtggctcacacctgtaatcccagcactttgggatgctgaggcgggctgatcacctgaggtcgggagtttgagaccagtctgaccaacatggagaaaccctgtctctactaaaaatacaaaattagcctggcatggtggtgcacgactgtaaaaaatcccagtgactccaaaggctgaggcaggagaatctcctgaacctgggaggtggaggttgcagtgagccgagatcgcaccattgcactccagcctgggcagcaagagcgaaactccgtctcaaaaaaaaaaaaagcgcatgtgcaagaaatagctcctgagctgagttggaatttctcatccttaaacaatgtgggaacctgctgaggtggggtgggggctcccgggtgggcggactcgggggtgatagccgccggttctgccttgcagcagcagtggacgtcagctcagcgaggtcttcatccagctgccctcgcgaaaggagctgcccgagtactacgagctcatccgcaagcccgtggacttcaagaagataaaggtaaccctgacgttgtacctgcgccccgcatgtgcccggaggggagtctgacccaggggcacccccatctgagagctgtggtgtgtgggcagaatgaccagaaaccacctaggcggtgccttgggctacctggttagggacctggtcgtgggcttttggggttccttgtaagggttgggggtgtcctgagggatgtcagtgggcagtcggtgttgggtgttccttcaaggtcccactcacttagtgctgggcctcagtcatgcagttcccatgcctagtgagccaggttaccgaggctggcgcttcggccacatcctcataggcacgaggaatcctagcccgtggggtctccagcacacagccaggcctgcgggcaggcgaggcggggtcctgaggtaagacctgctcctcccgtccactgcaggagcgcattcgcaaccacaagtaccgcagcctcaacgacctagagaaggacgtcatgctcctgtgccagaacgcacagaccttcaacctggagggctccctggtgagggcaccgctgggggttggggatgggccactcccacagctgggctttgacccaacccgcccctccttcccttctgaattgatgggttaaaaacaagtcccgctagctgtggtggttcgtgcctgtaatcccagcactttgggaggccaaggcgggaggatcacttgagaccaggagttcacgaccagcctgggcaacataacaagaccctgtctttaaaaaaaaaaaagaaaaaattaaaaatttccaacttgggatattttagcaattacaaaagcagtatgtatttaccgaagaaaataaagataggcacaacagaagaaatagactcagagtcctctgtctgttggaattttattttaaattccctggggcacattctcttcaaaggaatcctgtgggtttgttctttcctgtgatagaattgacacatacacagcctcaacttggcaaactttcttaagtgtctttgggattgattcctctcagaaaaaagacttgactttgatgagtttgggaaagatgctggcttcaacaaggggcatgtatttccaatgttattgcagacctcagagattgtgcagaaggagggaggcacctgcagctattcccaaaccagtgtgcctgacctttcaccctggagcatttcagaagtctgatgctcgggcccctatggaggaagattatggagagggccttccaccctgggtgggctgaagccccgacccgctgaggctcgcattggccactgatcagctgtccaggggcaacacagggctggggctggggctggggccagggccgggcaggcagccctccagtcgggcccatccactcaagcccctggtgtctctgcccagatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatgtgagtcccgggggggttcaggacgccggggttcacgctggcccgagagcccccaaggccccagcttttcacagccctcccggctcccagacgccccttgctgtgggggtgctgcattcccagagctcaaggctgtctttccctcccggtcccctccagctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggtgaggccgggcccccgagcaggcagagctggcatgtggcaggaggcatcccggggccctgatgggacagccctgtggggcggtgctcccacgcccccacgctgcaggtgggaaagctgaggcttgacctgccatggctgaccccaggtcacacagccagtatgtggcagggctgccactcaaagccaagcctgtgtgaccccggaaccagctctcagtacccgtgggtgtctggggactgggggacacgtgagtcctcaggacaggcagcaggcggtcccagggcaccagggctcctgggctgaggccgggcaggccagggcttgattagggttgggtaggaggtgctaggattggggacccaccagacagtgccccgtctcctcagtggcatagagaatgggcagaaacgccaagaccacagtggatagtttttggggtgcagtggggagccggagaagatccacttgctggctttaaataatctcacctctgtctctggcccttcctggctgtgggacctggcaggtcactttgcttctcaagcttcagtttcctcttatgcaaagcaaggaggctgcatggattagggggctgcccccaccgaagggcctggctcccgctgaagcccagcgaatgccattttgtcatcacagaagcagcaaatttcagtgcctgggaattagtctgacgaaagacgcacgtgacgtttgaggacattcatgaagtcctcatgtggaggggaggcccctgtgtcaggcaggagggtctgggctgtgatgctgtctctcttgcctaatccagagcagggtgttttatggcccatgccaggctgtttaaaaaggttttatgaggccaggtccagtggctcacacctgtaatcccagcactttgggaaactgaggcaggaggctcacttgagcctgggaggtcgaggctgcagtgagccgtgatagcaccactgcactccagcctgggcaacagagcaagaccctgtctttaaaaaaaaaaaaaaaaatatatatatatatatatatatatatatatatatatatgaaagagcaaagatctttcacagtcaggaagaaccaagatggtttggaagctgtaggtcaggggccaagggccaggcaggtgacatgggacagagcagggaaggcacgtggagcctcgaaggtcccgagagggccgagtgtggtcacagggactcgtcctgtagagaaacatgaagtttgggcatggccatggcgccatctcggctcactgcaagctccaccccccgggatcgcgccattctcctgcctcagcctcccaagtagctgggactacaggcgcccgccaccacgcccggctaattttttgtattttttagtagagacggggtttcaccgtgttagccaggatggtctcgatctcctgacctcgtgatccgcccgccttggccttccaaagtgctgggattacgggcgtgagccaccgtgcccggcccacatcagtgttttcttgagcaagtttatttaaagtttggcaggtccctggcaaggtgccctggcaggggtggccaacgcacactctctcctcctgtcccctctccaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccttgcctgcaggtggacttgtgcctggctcccaccgtttctgccagcaggagtggcgggggccacctcatgtccaggtccctgtccttctcctggcaccagaacccatggggcccgtttcacagaggaggatactgaggccccggcaggggaagaggacttgtctggtcacgcgtgtggcctttgccactgcaggtctccagcatttgttcagctgagacctacagtgcagggagcaggcagctccatccgttccctgcccgtggcccagcctgggttggggagaccatcacagaaatgggcagatgccacatagagctctcagggccatgatgcaggaagctcagggcataatgggagcccaggtggtcagtgagggaagggacggagccgcctgctccctttcaaatccagaacataatttgagtttttgtttttttgttttgttttgttttgtttttgagacgaagtctctgtcacccaggctggagtgcagtggcatgatctcggctcaccgcaacctcagcctcctgggttccagtgattctgctgcctcagcctcctgagtagctgggattacaggggtgcgccaccatgcccagctaatttttgtatttttagtagagatgggtttcatcatgttagccaggctggtctcaaactcctgacctcaggtgatccacctgcctcggcctcccaaagtgcaaggattacaggcatgagccactgtgcccagcccctaatttgtgtatttttagtaga

SEQ ID NO: 425 - DNA, 2089 bp, Homo sapiens
gaattcggcacgaggtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaaaaaaaaaaaaaaaaa

SEQ ID NO: 426 - DNA, 769 bp, Homo sapiens
tttttttttagttttctgttcagattttatttgaaatctaattcaaattgtcaaagctacaaaaggggggaagacatctgtattatttttgctaagtcacaacatcctaaaacaaaatactactactgtcagcagatccattatacacatttctgatgaaatccattagaacaataaaaatttcatcttgagaaatagccacaatgaaagtaatttacacaatataaaacaatgacagatctacagatgcagttgctcatgagtttacacatgcatacacaaacaaacaaaaaaccccaggaatgctctttcatttgattttttgtttttttaaaaaacagaccgttcaggcacaaaacaaatcgcatttccaataagtgacagcatcttaaaaatttacgtcagtgtttgcttttctttgactttttatgagacctgtgtggagatctggactgggatctggacttctttcctgattctttaggagatctagaccgtgatcgcctagaccttttaggtgtccttgaaccagatggtgatcttttggcttttttgctaacatctctaggagaatctttgtgagatgacctggaccgtgagctctctttatgagatctttctgaacgctctgatcgctccgatttttggtgatggggatttcactcgtctaccactgctactgcgaagatgggctgggggatgtactgggtcccccttttcctttccttccttgccggaaacactcatcctttttcctttttgcctttgg

SEQ ID NO: 427 - DNA, 545 bp, Homo sapiens
tttgaaaaaaggcaaaaaagactttacattgcatcatacagcagatatcctaaatcagtcaaactatcagaggaaactgttggcgtacagccttacaaacaatttaccctaataaaagttccccagtcagaaaatgtgtttcacacaaaacatttttcccttcttgcatttcactaccttacacattatgtgaaaaatcattaaaaacacctactacatatttaaaaaagccaaaatttcagcaacttttattgactaccttttaaaagccctatgctgctgttttacaaggcataatagaccagctcatttggtcaaagcattctacatcattagtttgaactaacttttactgaaacagctacagcatcaaaagagttaaggcaaattggaattcatagaaaaggataagacacttcacactacgttgaaagaaagacagaaagctaagaaaagagacactgacggcaacactgaattacagctacactcgcactgcaagcacagaacaccatgggtgaagtcggactatttaaacttcagaa

SEQ ID NO: 428 - DNA, 815 bp, Homo sapiens
ggcccagcctgagtggtattttctttagggaccaggtagactttaaaacgagggtaagagaaaagccagtgtctttctgaggtaaataatttctgccaggaaacttcccagccccaccagcagcccccctaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcwgggaggaagagggaggtggtcaagcttgaaaaactggctttaggatggttctgactttgttctccctccccaagtgttctcaacctccattctgcagtgttcagagttttagggaaagggtttgggtgccccagcatccaggtgttgtgtggcttagcgcatgtgaagtgaaaaccttctggggttgtttggaagcagctttctggttcttgtgattgtatcctgaggtcccagaaccctattctcccacgaggatcctcagtgaccatggtggccacacgcctggccagcctgctggctcctgggtgagctgaagaaccttgcctgtggacttttcgagggtgagctggaaccgagagaacatggtcccgykcmtggacayamkcggggyatttycctccggccatgattcgccytggygtgtctttatgagcaccatgtaagcctccttgtattgagataattgggcattaaacattaaactgcagctctgggca

SEQ ID NO: 429 - DNA, 3207 bp, Homo sapiens
tctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccgatcggctggagctggaagcggcgcagaagttcctggagcgtgcggccgtggagaacctgcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagacccagagcagctacaagataaatccaatgagattctgactgccataatccaggggatgaggaaagaagagcctagtaataatgtgaagctagctgctacgaatgcactcctgaactcattggagttcaccaaagcaaactttgataaagagtctgaaaggcactttattatgcaggtggtctgtgaagccacacagtgtccagatacgagggtacgagtggctgctttacagaatctggtgaagataatgtccttatattatcagtacatggagacatatatgggtcctgctctttttgcaatcacaatcgaagcaatgaaaagtgacattgatgaggtggctttacaagggatagaattctggtccaatgtctgtgatgaggaaatggatttggccattgaagcttcagaggcagcagaacaaggacggccccctgagcacaccagcaagttttatgcgaagggagcactacagtatctggttccaatcctcacacagacactaactaaacaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggctttctccagtctggctgaagctgcttatgaagctgcagacgttgctgatgatcaggaagaaccagctacttactgcttatcttcttcatttgaactcatagttcagaagctcctagagactacagacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggagtcacatatccagagcacatccgatagaatccagttcaatgaccttcagtctttactctgtgcaactcttcagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaagtgttgggtggtgaattcctcaagtacatggaggcctttaaacccttcctgggcattggattaaaaaattatgctgaataccaggtttgtttggcagctgtgggcttagtgggagacttgtgccgtgccctgcaatccaacatcatacctttctgtgacgaggtgatgcagctgcttctggaaaatttggggaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaagtcagactatgacatggtggattatctgaatgagctaagggaaagctgcttggaagcctatactggaatcgtccagggattaaagggggatcaggagaacgtacacccggatgtgatgctggtacaacccagagtagaatttattctgtctttcattgaccacattgctggagatgaggatcacacagatggagtagtagcttgtgctgctggactaataggggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttgatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaaaaaaaaaaaa

SEQ ID NO: 430 - DNA, 1510 bp, Homo sapiens
gactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaaaaaaaaaaaaaaaaaaaaaa

SEQ ID NO: 431 - DNA, 3332 bp, Homo sapiens
gggaactcttagctgagcaggcgagagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtttaattgaacagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataagcatgtattccactgatgagaacctgatcctttccccactcctgggtaacgtctgcttctccagctcccagtacagcatctgcttcacgctggtctcctttgccaagatctatgccgacacctttggtgacattaattaccaagaatttgctaaaagactctggggtgacatctacttcaaccctaagacgcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttgctcaggctggtctgcaaaaagttctttggcgagttcacaggctttgtggacatgtgtgtgcagcatatcccttctccaaaggtgggcgccaagcccaagattgagcacacctacaccggtggtgtggactccgacctcggcgaggctatgagtgactgtgaccctgatggccccctgatgtgccacactactaagatgtacagcacagatgatggagtccagtttcacgcctttggccgggtgctgagtggcaccattcatgctgggcagcctgtgaaggtactgggggagaactacaccctggaggatgaggaagactcccagatatgcaccgtgggccgcctttggatctctgtggccaggtaccacatcgaggtgaaccgtgttcctgctggcaactgggttctgattgaaggtgttgatcaaccaattgtgaagacagcaaccataaccgaaccccgaggcaatgaggaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtggaggagtctggcgagcatgtgatcctgggcactggggagctctacctggactgtgtgatgcatgatttgcggaagatgtactcagagatagacatcaaggtggctgacccagttgtcacgttttgtgagacggtggtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatggctactcctcgtctgatggagccttactactttgtagaggtccaggcccctgcagattgcgtctctgcagtttataccgtcctggccaggcgcagggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctcaaaaaaaaaaaaaaaaaaa

SEQ ID NO: 432 - DNA, 1362 bp, Homo sapiens
attaaatatgcacaatattccatagctcactgaggattttaaaattataagcataggattttatattttggggtgaaagaattatctggcacattaggtattggagtttaaaaaaaaagccaaatttcacagtcttaataactttttttaaaaaaaactaaaaggcgcttcatgtccagtgtgtggcccttctgaaacttatggtcatctctcccactgaaaccaaggtcttttcaaatgtggctaaatggggatgaggagacacgggtaggactttcttggtgtgtgtgcattctttaaagagccaagttgcttcggggaaacagccaggaaaatggtcaagattatttttagaggttattttattggggattttaagaactaataacatcttgagttatttttaattcagggggatgtggaaaggtttgcaattgtcaagtgttttgttgtagcttagtatccataagggaaacttagactatagacataactacaaagccagtgcagcttttgttttctgtatgttgttgggggatcaactttcacacatagcaagcacatggcctccctgatgtcaggatgcctttgttaggatctgtatttgcccttaattttgttgaaatcttttttccttcttcctcttgaaaagttccaaaatatagtttattgtatctttcatcactaaaaatttgttcctttttcactatgggcagttcacacaaggcaaaaactattgaacagttggttttagtgtgttgtataactttgctgtatatcaaactaattttgacaagttttcatcctaagcctcaaatcatgtaattaataatttgcctgtttatttatgacctaattgtgattcttttattaataaaagctaatgggaaaaggatccctgattaagctgatgactagacctacaattaattttcctgcagtatatgaagtattgtaccagagtattaaaagatatgtaatattttattgataaatctatcctttaaaaggaatacgttttaggatgtcatcattttgatgtgaatcatgtaaatgttgataatatgctgtttattatacatttagtgtttcaagagattcacttaattgcctttttgcccacgtatattatgtagtctatttgcaactgttcttaaaaaaatgacattaaaagaatagtttatgtagagaaacattagtggatgttaattgtctccccacctatatttatgggtgttagcgcaactgctttgctagttgcaaagctgtattatcagagtaaaagtgtatttgtaaactgtatgggaactaaaaattaggaataaaaccattttcttatatgaaaaaaaaaaaaaaaaaaaa

SEQ ID NO: 433 - DNA, 1592 bp, Homo sapiens; identical to SEQ ID NO: 409

SEQ ID NO: 434 - DNA, 530 bp, Homo sapiens
ttttgtgcagtgaggtactataagaatttttattaatgacagctttgcaattaaatgtacattcactaaatatggaaacaagtgagaactaacaataaaaaggagttccaagaaaattgtcacggcatgaactgaatggactcatactgggccagcactttcggtcttggcatgaacagcttcatcattccagaactttcttgatttccaaggtttgtctgtaatcctagctgctcaggaggctgagacatgagaatttcttgaactgggaggtggaggctgcagtgatccgtgattgaaccactgcactccagcagtaggtgcttaacaaatgccatcttgaatgaatgaagaccctttctcacagtaacaaagttgggtccaggctccttcatttttgctcagcaagatgaagctgggattaggcatgttctaaatggcagctccatcttctctttttgccacccatgtttacagaaacgagtggacaagacggcccctgccagtgggaagcctattgcataacaaga

SEQ ID NO: 435 - DNA, 3575 bp, Homo sapiens
aggattctaaaaagagcaatggttcacaaggaaacttctgcctcaggtggggagaggagtccatagatcagggaaacttatgtcttggtgaaatggaagaccatgtttctaaacacctgtcgccaggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcatacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaaaaaaaatgataatttatttttaaggtaaaaataatccatgaagataaaagaaacatatgtctgcgtgctactttacaatgttggttttaaagataagcacatgggtaaaaatgagggtgatccttattcaaaaataacatctgactactataaaaatatttgcatatataagtttgacaaagaaaagaaaatcaatgttaaaccattaaatctgagcactgttagacttgattaatccatgcacatgattttttttgagtagggagcattagtacctggtgctagagaatagaaccctcaaataatttttagaattcttacctaatatgtaaaagtctgcatgactcttaacaatgagtcacatccattgattttacagggattttagttcgtaatccagaaagtaataatcagggattttattttaatcaggcatcaatccagattcactgttatactgaaatatcaaagtaaaatcctagttggcaggattgtaagtagaccgaattctaatttttcccaacacatagtggtaattggaggttactgttatgaatactccatctgactacgactaagagagtgaggggtggttttaatgaaccctctaagctctctcagttccttcccttccacaaaatgcaagagcaaaagcaaactacaaacaggccttgtgctcaaccactggaaatgcctcctgggataagaatggcagcacttgaaaattctgccctctactgatgagacttcctgctgcctttggacataactaagccaggaaactttaaaagccttctagaaatagaggcactgtatgacttgcaatcgtaggtatagtttataacctgatagcaaaaaacttgaaatattgcagcccagtttaattcagcactttcccattttcataactatgtgaaaacatctgggaatttgaatcactcctgaatacagaggcatattctttttaaactataaataccattttgagtgagaaagtacttttaaacaagaaagaaattgtacattatgactaaagttataaatacaatatttatatctataaatctgaagtttaacatgattaatttaaaaagtatttagtgcttgacaaagtagtgtcactcttaagatgtcaaagggaattagccattttttttattgtaataaaggcaggtgctatttttttctggtgagattgcacctggataccaggcttttgtaatagttaacattaaacatttgattcataaagttaattcactgcttaagcatgtggctcatatttaggaagctatataaaattcagtttttcatttaacatttgctcttttgcatatgaagagatatttgtatttttcaaatgttaagtaaaacaagatgtgccaatatcataggtaaataaattagggaaaatgtgggaaaaaaaaaaaaaaaaaaaaaaaaaaaaaaaaaaa

SEQ ID NO: 436 - DNA, 1601 bp, Homo sapiens
ttcctgccgttgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggg

SEQ ID NO: 437 - DNA, 1233 bp, Homo sapiens
ccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtggggaggaagaggaggaggaagaagaaggtgatggtgaggaggagggtggagatgaagatgaggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacagaaaaaaaaaaaaaaaaaaaaaaaaaaaaaa

SEQ ID NO: 438 - DNA, 2372 bp, Homo sapiens
cgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaaaaaaaaaaaaaaaaaaaaaaa

SEQ ID NO: 439 - DNA, 2260 bp, Homo sapiens
tccccagtgcctaactctgctgtctgctatatttcagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctgatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactatgtgcaccgggtgattacaggcaccagtgcagtgatgattgtacttatttgacacatactccccgtcgtcctggttcttgttcctgagaagggtgggtaacagatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttttccaggaacaactacattttctcatatacaggtagctaggggcaacacggttccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaatgcc

SEQ ID NO: 440 - DNA, 1148 bp, Homo sapiens
gcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaattttatttaaaaaa

SEQ ID NO: 441 - DNA, 607 bp, Homo sapiens
  misc_feature 446, 600: n = A,T,C or G
gcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacatcatgctcctgtgccagaacgcacataccttcaacctgaagggctccctgatctatgaagactccatcgtcttgcagtcagtcttcaccagcatgcggcataaaatctagaaagaggatgacagtgaatgcgaggagagtgaggaggaagaagagggcgaggatgaatgctccaaatccgaatctcagtccntcaaagtgaagatcaatcttgtccggaaagataaggcacaagaccggctgaatggcagccagcagcagcctagccaatggtccctatcgcaacgcgtcatgaatgacgatgacagttaagatgaacaagaagaagaccgctcaagaattagcancgaagaa

SEQ ID NO: 442 - DNA, 2440 bp, Homo sapiens
gctcgggcgcggggcgttcttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttccggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagatttattaaaacttgactgaacaaaaggggaccatcaacattgtagacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagttgtttgatgcaataaacattcaacattctggttttgtcat

SEQ ID NO: 443 - DNA, 2994 bp, Homo sapiens
gcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacgccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggaaaaaaaaaaaaaaa

SEQ ID NO: 444 - DNA, 1552 bp, Homo sapiens
gtgtcttctctttagggattgtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattaaaaaaaaaaaaaaaaaaaaaaaaaa

SEQ ID NO: 445 - DNA, 1651 bp, Homo sapiens
acagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaaaaaaaaaaaaaaaaaaaaaaaaaaaaaaaaaaaaaaaaaaaaaaaaaaaaaaaaaaa

SEQ ID NO: 446 - DNA, 615 bp, Homo sapiens
gaaaatgatattaattttattgcatcattttactgactagaacgccagacttagagtggatataagtataaaaataaccaaattcttacaaataatactttgctgctacagtactgaataattagtggaggttgcaattataatacaactttaaataacattctcataatgggtttaacacaatcaaccaggggctaaggtttaaaggtttacaaagagaaatccaggacaacatgaaaactcccaaagttcatattccagctaaatgcttcatttaaccgtcaatccaccaacacaaacattaacaaaactcagagcaactcatgatgaaacagtcgttctctttttaggacaggccaaggttaatacagaaaggtaaatgattcggattagtttcccaggcagaactgattccatcccatccctggcctatcccatcctccctacccaagaaatctgtaatgaagtatgttaagtgcattttaaaaatctgaatatgcaaattcttcaaaatgtcctctttgaaaatgcccaggtgacagacccagtctcggacctgtcgctttttagacctgaatggtccccctttggtttcatagggttttctgtgagcag

SEQ ID NO: 447 - DNA, 1154 bp, Homo sapiens
gaattcgaggatccgggtaccatggcggcgggcgagcaggagggagccatggtggcggcgacacagggggcagcggcggcggcgggaagcggaccgggaccgggggcggaaccgcgtctggaggcaccgaagggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttatgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccagggcaggtggtcatcaaaatagctacaaaccatatctaaattattccatttgcaacttatccccaacaggtggtgaagcagtattttccaatttgaagattcatttgaatggctcctgccacctgctaatagcagttcaaactaaattttttgtatcaagtccctgaatggaagtatgacgttgggtccctctgaagtttaattctgagttctcattaaaagaaatttgctttcattgttttatttcttaaaaaaaaaaaaaaaaaaaaaaaaaaaaaaaaaaaaaaaccatggtacccggatcctcgaattc

SEQ ID NO: 448 - DNA, 1952 bp, Homo sapiens
gagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgatctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaaaaaaaaaaaaaaaaaaaaaaaaaaa

SEQ ID NO: 449 - DNA, 1671 bp, Homo sapiens
cgggggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccaaaaaaa

SEQ ID NO: 450 - DNA, 1743 bp, Homo sapiens
ggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctcaaaaaaaaaaaaaaaaaa

SEQ ID NO: 451 - DNA, 574 bp, Homo sapiens
  misc_feature 495, 535, 564, 570: n = A,T,C or G
aaaggtgggttttggggatgtttaccctattgttttttatttggatgccctaaggcatataaagcgcatagtgaattacctactggaatgtaaatggttctaaaattaaaactgttaaaatagaaagagggaaaaggaaggcccaagaactcttaaagagaggctgagaacaagaacaaaaaaacccagaagtgtaggtaatacgtaacagcgcagacagaaccgttgtaggccatgtataataaataatgcatgccccaaatttcagttaatcatataatttcaacttgagttctaatactggaaccagccaaccacttgggcttcaacactgtactagatgtcagtagaatcgcttgatggaattacagccttgttacagttgagatcaagagagggtgctttttttttttccttcttttattaaagctatcattccaggctttgatcaaagatccaagaatatttggtctaccaggctggaatgaatgtggnttggaagtcagagtacatttaaaagctgcaccaaaatttngtagcccacaatctcaaaatttggatcanccaaangaga

SEQ ID NO: 452 - DNA, 689 bp, Homo sapiens
cagagaaataagttacaccttagtatcagatattaattttcttcagtgttcaggcaattaatatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgtagtttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttatggttaatagccactattctgttgtctggaattaaaacctgtataacttaattggcatccctttatcttcttagtcaataaaacctacaatcctctttctagaagaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 453 - DNA, 1812 bp, Homo sapiens
ggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccggggggatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaagataagtttaatactgtatcagggtttaacttttactatttcagatcttccacagcttgta

SEQ ID NO: 454 - DNA, 645 bp, Homo sapiens
  misc_feature 576, 639: n = A,T,C or G
gtttttaacactgtcatggctttattcaaaacacagttgcacaaaagtattaacttcaaagtttttaaggagattcttgaggaacttaacacaatatatacatactgccatacaaagagcattaaaataggaccgaaaacttctacaaaatataaaacccacccttacttatttgcatgaaaataccacccacaaagctaaataagtcttaaaagttatctggaggctctaagtgttgttttcaaaccaaagtactctaattttgattgcacagtaagatgattgataagaaagtcaatatatagatttcattttaaaaataagtattttgtaatctggcatagtatgtaatgagaattgttaggaactagaacagggaatttcagtttttaaaagcagaagaaaaatgttatctttttgctgcagtagttcaaaaatactttctctataatcttccaggtttgtgatctcacagttaaacaggtcaagacttttcaaattgttaagatgttgcagagcttctactgtactgagatcttttattgtgtttccactcagattgaggtaggtgagatntagacatatctctgccaggacttccaagcctccagaaattatattatcactaagctgcaatgntcgaag

SEQ ID NO: 455 - DNA, 425 bp, Homo sapiens
  misc_feature 388, 417: n = A,T,C or G
gcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggcccatgtggttgatttttctaaagctggagaaaggaagaaattgtgccttgcatattacttgagcttaaactgacaacctgggatgtaaataggagccttttaactggtttattaataaagtnctattggtgattttttaaaaaaaaaaacnctcgtgcc

SEQ ID NO: 456 - DNA, 1579 bp, Homo sapiens
ctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcgacgaggccagtgcccctggatcttgcctctgctccgacgccgttggggaccagttaggcgacagcgcccgcccctctgaggagacacgaaggtggttccccagctgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataaaaaaaaaaaaaaaaaaaaaaaaaaaaaaaaaaaaaaaaaaaaaaaaaaaa

SEQ ID NO: 457 - DNA, 1920 bp, Homo sapiens
  misc_feature 1567, 1721, 1722, 1815: n = A,T,C or G
ggcctgcctgccgctgttggggtggcggtgacgacaggcagcaaaagaccagctggtcccagattcgctgctggagtgctggatggagcctttctctgccctctgtgacatttccaattttagataatgcctcacatctctgtccccccgggcacccctggagcccccatgatccctaagaagacagcttgaacctagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctgggcgcccagggggtcctccagctcctcaaggtctgccctactgtccagaacgatctcctctcttagtgggtcctgtgtcggtgtcctttagcccagtgccatcactggcagagattgtggagcggaatccccgggtagaaccaggggcccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggctggaaatggaacatttaacagggcaaaactgttgaacgttggggtgcgagaggccctgcgtgatgaagagtgggactgcctgttcttgcacgatgtggacctcttgccagaaaatgaccacaatctgtatgtgtgtgacccccggggaccccgccatgttgccgttgctatgaacagttttggatacagcctcccgtacccccagtacttcggaggagtctcagcacttactcctgaccagtacctgaagatgaatggcttccccaatgaatactggggctggggtggtgaggatgacgacattgctaccagggtgcgcctggctgggatgaagatctctcggccccccacatctgtaggacactataagatggtgaagcaccgaggagataagggcaatgaggaaaatccccacagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactngagctgggctcctgtagacctcaggggtccctctctctagggtctcctgtagggcttatgactgtgaatccttgatgtcatgattttatgtgacgattcctaggagtccctgcccctagagtaggagcagggctggaccccaagcccctccctnntccatggagagaagagtgatctggcttctcctcggacctctgtgaatatttattctatttatggttcccgggaagttgtttggtgaaggaagnccctccctgggcattttctgcctatgctggaatagctccctcttctggtcctggctcagggggctgggattttgatatattttctaataaaggactttgtctcgc

SEQ ID NO: 458 - DNA, 1554 bp, Homo sapiens
accggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagccaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaaaaaaaaaaaaaaaaaa

SEQ ID NO: 459 - DNA, 1499 bp, Homo sapiens
cttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttacaaaaaaaaaaa

SEQ ID NO: 460 - DNA, 457 bp, Homo sapiens
  misc_feature 358: n = A,T,C or G
tttaaacaatattcaagtttattaaacaaataaaaaaaggattataaaatgtttaactttcatcagcttcaaggtttatgttgctcccgaattttgcatacaactgaactttcaaatctgctaacactcgctgaattgattccactctggattctaaggcgtcaatttcttcttgcaaatttttctttgcttcttctaacatttcttgcgtttcttcttgagaatggctaatgaagacatcaccaatttgataaggtatcattaagcaatcatcatctgcaagcatgatgtcatcacaagcatcttctaggttttggagttgtttcttttttacttctatttcttccttcagctctgngattctacttgtattccgtgcaaatttgtttatcttttgttgatcttcgaaagtaacattgacatcttctgcagccgccttcttcatggtggccgcgtt

SEQ ID NO: 461 - DNA, 2191 bp, Homo sapiens
ggtggccgagcgggggaccgggaagcatggcccgggggtcggcggttgcctgggcggcgctcgggccgttgttgtggggctgcgcgctggggctgcagggcgggatgctgtacccccaggagagcccgtcgcgggagtgcaaggagctggacggcctctggagcttccgcgccgacttctctgacaaccgacgccggggcttcgaggagcagtggtaccggcggccgctgtgggagtcaggccccaccgtggacatgccagttccctccagcttcaatgacatcagccaggactggcgtctgcggcattttgtcggctgggtgtggtacgaacgggaggtgatcctgccggagcgatggacccaggacctgcgcacaagagtggtgctgaggattggcagtgcccattcctatgccatcgtgtgggtgaatggggtcgacacgctagagcatgaggggggctacctccccttcgaggccgacatcagcaacctggtccaggtggggcccctgccctcccggctccgaatcactatcgccatcaacaacacactcacccccaccaccctgccaccagggaccatccaatacctgactgacacctccaagtatcccaagggttactttgtccagaacacatattttgactttttcaactacgctggactgcagcggtctgtacttctgtacacgacacccaccacctacatcgatgacatcaccgtcaccaccagcgtggagcaagacagtgggctggtgaattaccagatctctgtcaagggcagtaacctgttcaagttggaagtgcgtcttttggatgcagaaaacaaagtcgtggcgaatgggactgggacccagggccaacttaaggtgccaggtgtcagcctctggtggccgtacctgatgcacgaacgccctgcctatctgtattcattggaggtgcagctgactgcacagacgtcactggggcctgtgtctgacttctacacactccctgtggggatccgcactgtggctgtcaccaagagccagttcctcatcaatgggaaacctttctatttccacggtgtcaacaagcatgaggatgcggacatccgagggaagggcttcgactggccgctgctggtgaaggacttcaacctgcttcgctggcttggtgccaacgctttccgtaccagccactacccctatgcagaggaagtgatgcagatgtgtgaccgctatgggattgtggtcatcgatgagtgtcccggcgtgggcctggcgctgccgcagttcttcaacaacgtttctctgcatcaccacatgcaggtgatggaagaagtggtgcgtagggacaagaaccaccccgcggtcgtgatgtggtctgtggccaacgagcctgcgtcccacctagaatctgctggctactacttgaagatggtgatcgctcacaccaaatccttggacccctcccggcctgtgacctttgtgagcaactctaactatgcagcagacaagggggctccgtatgtggatgtgatctgtttgaacagctactactcttggtatcacgactacgggcacctggagttgattcagctgcagctggccacccagtttgagaactggtataagaagtatcagaagcccattattcagagcgagtatggagcagaaacgattgcagggtttcaccaggatccacctctgatgttcactgaagagtaccagaaaagtctgctagagcagtaccatctgggtctggatcaaaaacgcagaaaatatgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtcgctactg

SEQ ID NO: 462 - DNA, 734 bp, Homo sapiens
cggacgcgtgggctgcggccatggcagcatcttccctgacggtcaccttagggcggctggcgtccgcgtgcagccacagcatcctgagaccttcggggcccggagcagcctccctttggtctgcttctcgaaggttcaattcacagagcacttcatatctaccagggtaatatcaaaatatatgttcctaaaacatccctgagttcaccaccttggccagaagttgttctgccagacccagttgaggagaccagacaccatgcagaggtcgtgaagaaggtgaatgagatgatcgtcacggggcagtatggcaggctctttgccgtggtgcactttgccagccgccagtggaaggtgacctctgaagacctgatcttaattggaaatgaactagaccttgcgtgtggagagagaattcgactggagaaggtcctgctggttggggcagacaacttcacgctgcttggcaagccactcctcggaaaggatcttgttcgagtagaagccacagtcattgaaaagacagaatcatggccaagaatcattatgagattcaggaaaaggaaaaaacttcaagaagaaaagaatcgtcacgacccgcagactgtcctccggataaacagcattgagattgctccgtgtttgtgtgattaccgagttaatacttacaaaaggataaaataactcctgcttcccacgggaaaaaaaagaacaagaacacacaaaaaaaaaaa

SEQ ID NO: 463 - DNA, 2049 bp, Homo sapiens
gttgagccagtgcaggttcaggaaactgtggaaaatcacttgaagagtttgctgatcaaacattttgacccccgcaaagcagattctatttttactgaagaaggagagaccccagcgtggctggaaagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaagtgagaggccctgtttctgctcagcccttccttcctagtgctccccacaaaacccttcccatggcccgtgttccacagccaaagctgctagctccttctgttcaacgtagaggtaaacttgcttttggctgggcgtggtggctcacgcctgtaatcccagcactttgggaggccgaggcggatggatcacctaaggtcaggagtttgagaccagcttgaccaacatggagaaaccccatctctgaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcc

SEQ ID NO: 464 - DNA, 465 bp, Homo sapiens
  misc_feature 381: n = A,T,C or G
ttttttaataaataatgtatttattacaagttactattttccaaggcacattacagtgttctgttaactacagaaatgtataaaggacaaacagagcagattctccatgtctagcatttcgctctactgttcaaaagcatccgtgcatcaataaagcaaaaacaaaacaacacgtgtagatccaacacattcaggtcagtagaaacaaaccaaaacattttcccctcacaaacttgcaacaaaatacaccccatcccccccgacacccccttaccattttgcaaacaaaacagaaaaacaaaacaaaacagaacaaaataaagtgaagacttcaacacttggggcagtttagaaggaagctttcaccattttatagcattntttttttttttttttttttttttttttaggcagcaacactggccttggcaaaaaaaaaaaaaaaaaaaaaggctttttcttttg

SEQ ID NO: 465 - DNA, 3130 bp, Homo sapiens
attccggcggctccactccgtcccccgcggtctgctctgtgtgccatggacggcatcgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctctaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccctgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagccgatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccactctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgcctttcctgcagccacacacccacccggggtgtcctggggacccaaggggtgggggggtcacaccagagagaggcagggggcctggccggctcctgcaggatcatgcagctggggcgcggcggccgcgctgcgagcaccccaaccccagccctctaatcaagtcacgtgattctcccttcaccccgcccccagggccttcccttccttgcccccaggcgggctccccgctgctccagctgcggactggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaagggcggcgtgtcgcgcctctggcatcgctccggttgccttacaccacgccttcacctgcagtcgcctagaaaacttgctctcaaacttcagggttttttcttcttcaaatttggaccaaagtctcatttctgtgttttgcctgcctctgatgctgggacccggaaagcgggcgctcctgtctttgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgtgccttacccgatggcttgtgacgcggagagaaccgattaaaaccgtttgagaaactcctcccttgtctagccctgtgttcgctgtggacgctgtagacacaggttggccagtctgtacctggacttcgaataaatcttctgtatcctcaaaaaaaaaaaaaa

SEQ ID NO: 466 - DNA, 1273 bp, Homo sapiens
caagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 467 - DNA, 3321 bp, Homo sapiens
ttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttaaaaaaaaaaaaaaaaaaaaaaaaaaaaaaaaaaaaaaaaaaaaaaaaaaaaaaaaaaa

SEQ ID NO: 468 - DNA, 3281 bp, Homo sapiens
ctcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtctttgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcaaaaaaaaaaaaaaaaaaaaaaaaaaaaaaaaaaaaaaaaaaaaaaaaaaa

SEQ ID NO: 469 - DNA, 2225 bp, Homo sapiens
agggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagccttaaaa

SEQ ID NO: 470 - DNA, 444 bp, Homo sapiens
ctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttgaaaaaaaaaaaaaaaaaaa

SEQ ID NO: 471 - DNA, 979 bp, Homo sapiens
aaaatataagccagggtattactggccacctgactctacagcgtcccacatgcgaacacaggctagacaagggaggagtttctcaaacggttttaatcggttctctccgcgtcacaagccatcgggtaaggcaacggaatgtgcgtggggtcccctgtggctccgcggtcacaatactgagcctggaattgctgttagcaaaatatacatttgtgtcaccataaaaaaccgcgccgccggccctcgggtctcacaacaggtataaaacaattataaatatttacacccttgttacacgcttttacggaaaggggatccgtaggagagcccccgggacaggacgcgggggcggtagaaagagcacagagaagacaggaggagcgcccgccttccgggtcccagcatcagaggcaggcaaaacacagaaatgagactttggtccaaaatttgaaggaagaaaaaaccctgaagtttgagagcaaggttgttctatggcgactgcacggtgaaggcgtaggtgtaaggcaaccggaggcgatgccagaggcggcgacaacggcccgccccttccctgaagctcaggggctctaagataggaccggggctccctgtgcctgacccactgggcggcccgacctgctctctggaaactgggtcctgcctgtgacttaattacgaagggaaaataccaatgagcgagtaagcaggcatagcagggataactacccacaagggagagtataagattacattcataccattgtatctgtctggctatgcaagagttcgttgagaagctagttctttttgcctattacttggaaccgcactgacacttttgctcaacggagacatgcggaaggccgaacgtagaatgcagttttaccagcgatgatgcaccgtccagtgcagaagggaacgctgggaaaggacgctggccggtgcagacaacaagtaaagcggttggttaacgccacag

SEQ ID NO: 472 - DNA, 6250 bp, Homo sapiens
ctctgtcgccgctggagcagctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaagtacgctacttcctgaagaataaggtcagccctgatttgtgcaatgaggacggactcacagccctacaccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtatggggccgacttgcttgctgtcaactcggatgggaacatgccatatgacctctgcgaggatgaacccaccctggatgtcatcgagacctgcatggcataccagggcatcacccaagagaaaatcaacgagatgcgggtggctcctgagcagcagatgattgcggacatccactgcatgatcgcagcgggccaggacctggactggatagatgcccagggtgccacactgctgcacatagctggagccaatggatacctgcgggcagctgagctcctcctggaccatggagtgcgtgtggatgtgaaggactgggatggctgggagcccctgcatgcagctgccttctggggacagatgcagatggcagagctattggtgtcccatggagctagtctcagtgcaaggacatccatggatgagatgccaatagacctgtgcgaggaggaagagttcaaggtcctgctgctggagctaaaacacaagcatgatgtgatcatgaagtcacagctgaggcacaagtcatccttgagccggaggacctccagcgcaggcagccgtgggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctggagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaagggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcggatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataac

SEQ ID NO: 473 - DNA, 2054 bp, Homo sapiens
aagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctctggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagccaaaaaaaaaaaaaaaaaaaaaaaaaaa

SEQ ID NO: 474 - DNA, 3057 bp, Homo sapiens
gtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgacctagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactccaaaaaaaaaaaaaaaaaaaaaaaaaaaaaaaaaaaaaaaaaaaaaaaaac

SEQ ID NO: 475 - DNA, 2685 bp, Homo sapiens
ggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtcctttttta

SEQ ID NO: 476 - DNA, 1183 bp, Homo sapiens
agattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaaggaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaggaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaaaaaaaaaaaaaaaaaaaaaaaaaaaaaa

SEQ ID NO: 477 - DNA, 1867 bp, Homo sapiens
aaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcaaaaaaaaaaaaaaaaa

SEQ ID NO: 478 - DNA, 484 bp, Homo sapiens
attatcttaattactttattctaacaaatagtttaacacaaaaatacgaactagccctccagggatctttggggtctacgcttcccatcgcctcagtgtccggtgcatgaggaaggtgtcctctgaagggcggggccggagttaaagtcggagagggggcagaccgtccagggtcaggtgtggagattcataaaatagcgtttctgggtcacacaagatggtcatgtctggcccaggcccaggtggctcctttgggtgcggggctcgagcctgtggcggcaggagagccaatttctccctgagcgcggcattcagaacctgttcctccggcacctgcaggctcaccaggtcccggaagagccgcttggagcgcggcacgttcagcccctcggacacgctctcctccaggccgcagcggatctggaacgactttctcagctgttcctccacggccttcgcagcatcaaagtggctcccggctgcg

SEQ ID NO: 479 - DNA, 1202 bp, Homo sapiens
ggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaaaaaaaaaaaaaaaaaaa

SEQ ID NO: 480 - DNA, 5653 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaaaaaaaaaaaaaaaaaaaa

SEQ ID NO: 481 - DNA, 5189 bp, Homo sapiens
atggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtg

SEQ ID NO: 482 - DNA, 1212 bp, Homo sapiens
aggacagccatcatcaaagagatcgttagcagaaacaaaaggagatatcaagaggatggattcgacttagacttgacctatatttatctaaacattattgctatgggatttcctgcagaaagacttgaaggcgtatacaggaacaatattgatgatgtagtaaggtttttggattcaaagcataaaaaccattacaagatacacaatctttgtgctgaaagacattatgacaccgccaaatctaattacagagttgcgcaatatccttttgaagaccataacccaccacagctagaacttatcaaacccttttgtgaagatcttgaccaatggctaagtgaagatgacaatcatgttgcagcaattcactgtaaagctggaaagggacgaactggtataatgatttatgcatatttattacatcggggcaaatttttaaaggcacaagaggccctagatttctatggggaagtaaggaccagagacaaaaagggagtaactattcccagtcagaggcgctatgtgtattactatagctacctggtaaagaatcatgtggattatagaccagtggcactgttgtttcacaagatgatgtttgaaactattccaatgttcagtgtcggaacttgcaatcctcagtttgtggtctgccagctaaaggtgaagatgtattcctccaattcaggacccacacgatgggaggacaagttcatgtattttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaattgatagcatttgcagtatagagcgtgcagataatgacaaggagtatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctga

SEQ ID NO: 483 - DNA, 1886 bp, Homo sapiens
ctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttaaaaaaaaaaaaaaaaaa

SEQ ID NO: 484 - DNA, 533 bp, Homo sapiens
ttgcagtgagcagagattgtgccactgcactccagcctgggcgacagcatgaggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcgacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggactgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgtcgacgcggcc

SEQ ID NO: 485 - DNA, 484 bp, Homo sapiens
ttataaaacacatcacaattttattgcttgaagaatacagcatatgaaatcacaagaatgtcaaaatgaaaagtcactaggcttcaaacgtataatacattatcagatgcagtaaaatattaacctgaactctgcatcagaaaaaaaaaaaaaggtgtggaaaatatctaagttgtttacttaagaaacagatatacttaaaatagaaagtataaggatgttacagtacaaattagaaaagccaacacgtattaacttatcgttctagactagactacctttggtacttaaactttttaaaaaacaatttcttctatctcatccaaatgcacttcatgggtatgacatccatgaagtaacttcaacttaaaacattcagcaaaattaaccttttcacttcatgggggaagtatatttaataaatgtataacaatatttcccttttactaaaactgcaaaatatgatcattaagaaacctaacag

SEQ ID NO: 486 - DNA, 578 bp, Homo sapiens
  misc_feature 456, 459, 501, 511, 520, 540, 560, 565, 570: n = A,T,C or G
aaatatgagcatttatttggcacccgatggcaatacaaaatcctggcagtgggagtggaaaggttctctctctcaaatacttccatactatgtcgacccaaaggcaggacttggcagcaaggctcacaaaccacccaaacaaatatttattgagcaccttgactactacaggcctagcattttgctagggaccatgggagatgtgaaggaagttatctcacacatgatatgtcttcaaggagctaaaaatgccagtggataaaagcaaaacacatggaaaaacaaagtacaaataataatccgtgtatattgtcaaaaggaacattttatcaaaaggtaggattgtagctaaggttggcttgccttcttccctcttttattcaacaaacatttaatgaaggcccactatgtgccaagcctttggtccatgatggggaataaaccaaacaaggtttntgncctcatttcaagcctggtaggggagaccgaaatggaccagtnaaagtgcctntttttaacntgcataaagccatgaggggnaaagccaaatttggtgccgnacccnaattnactggtta

SEQ ID NO: 487 - DNA, 874 bp, Homo sapiens
tgatgctttccttggttgtacaggtgtacattgtaaaccttcatgctgtaaatggaattgttttatctcttgggatacatttgcattttagtgtacatttacgtccctgccctcttgacctggcaatatagtgtgtataatgtaaatttatttctccaaatcgagagtgattttttaaaaattttttatctttatatggtttcagaagtatgaaccagctttctttttattattgtgagatcatttgttttataacatagtgttgactgttaatatggacctgctagaattggatcactttcaattgaagtcagggtatgtgcataatagaaagtatggactgagatattggttaccatggaggccaatgcttttttcatcttattaaatgtgatgtgacttttttcttgtacagaagagtactgtattttgaatagcctactcccaagtaagagcaaatctgtatgataacattttttcctctggacataagacataacagtaacacgatgtacatttacaagcggcttatgtacatttcccaacaatctttttaaggccaaaatgtgaccatatgtgtattattaaaatcgttttaatcctttggctatgaaatattttcggaaaaaactgctggtatattcagtttctgaagtcaagaagggtcggttcggtggagtccgattgttaaatttgttgaccttgttcgtggtgaaactatggactgcttcgggtgaatgaggagattctcacaatggagaactctggcatgacagggtccgggcttgacaaggcaggggcggactatgcgggacaccgcgggaaagggttagaggacgcaggtaccttttctttcgctgctgttgcatcctca

SEQ ID NO: 488 - DNA, 1684 bp, Homo sapiens
cagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttgg

SEQ ID NO: 489 - DNA, 2766 bp, Homo sapiens
ggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaaaaaaaaaaaaaaaaaaaa

SEQ ID NO: 490 - DNA, 1031 bp, Homo sapiens
acagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgccgagaaaagaaaacccacatgaaggaaacaacactggcccagggtcgagatgcctacagggtggtcgctcgtgggctacaagtacaaggaacactgctcagaacccacgtactccagccagcctcggcaacatggcaggcaatgcaccagagcacagaggtgtcaggaaccagtcaaaccctacacttctccatgtcgcaccaggacaaaagagactccaacgtgtaggccaacggagaactaaagcggaacggcacgcaaccggaccacgggaaccccaccgcaacccggggcccaaggccaacaacatgaaaggccccacagtaggccgacgcacgcggctgggcacacaacacgatggagaccaatgggcagggcacacgggccgtgtgggaccgcggcgtgccaccgactgcaccaatggccgtaaagacacgacagccggaagaggcacaagagacacaaaggtggtacaccagcacgagggagccacaccaccatgacgcaggagacaa

SEQ ID NO: 491 - DNA, 273 bp, Homo sapiens
atgggctgcctcgggaacagtaagaccgaggaccagcgcaacgaggagaaggcgcagcgtgaggccaacaaaaagatcgagaagcagctgcagaaggacaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaa

SEQ ID NO: 492 - DNA, 555 bp, Homo sapiens
taaattatccaaaatgatttctttattgagattaactacatagatttcacagtactatggaatacttatatttagctaaagtcacaaacacatttcaacattcaaaatgatgagcatcattaccattctaatctacaaagctcatgaataaagaaaaatacaaaaacctcaagttttacaaaaaaaaaaaacttttaagtctacatacattaacaataaaaccatttcttccagataacaggtaaaagtataaaggcataccactgacttttttttttctagatagccaggaatgaacgaatgtttaatatctacgacgcttattagggccttcaaagttgcccccttgacttcctctaccaaagccaccaggaccaccactcacaggacctacaccactcattggtgcttgaggggtttcagaacctgttctactccccataggtgaacccatctgagatggtggtccttgaggaaatctgtcattgtgcactgctccattatctggcatcattggagttcccatatttgcggctccttctggtcccatggcag

SEQ ID NO: 493 - DNA, 1128 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactaccgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggcc

SEQ ID NO: 494 - DNA, 1130 bp, Homo sapiens
cgtccgcccacgcgtccggccgccgccgcgccgccgtcgcgtctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaagcacaaacagacttactcttctccggtcacggcagttctgaaccgtagatattcttccccatggggttccacagcgtaccttaaggtatatgattgccacgttcacaccactgtgggccagcaatcagcgtatggccagctatccaattcccattcggcgcgtgacccttcaaattaactggctgagaacgcttagcataatgccgctcaaatgttccggtaccaagtccggagctaccgttataagacttcatcacaaaccgtgtaaattctccgggcgacacgccgacttaggggcgttcctaaaccccggaagatctaatagagcggcccccacacgcggtaagacgccagtattataaacagcggatcgccacccgagtatatcaccaccgaccgcccacggcagctctacattctgggctatcagacgccgtctcggagagaaaactctataaaacaaaggcgcgctaacccgtaccccaactcatgagcgcagacgatgacggccccgcagactcgcatcacaaacttcctttagttattcgtcagctacagtcgaca

SEQ ID NO: 495 - DNA, 1039 bp, Homo sapiens
atggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaaaaaaaaaaaaaaaaaaaaaaaaaaaaaaaaaaaa

SEQ ID NO: 496 - DNA, 429 bp, Homo sapiens
ttttaaactatacagttctttatatacaatttttacaaagtaacacttttttaaataatataactggacacaaaaatatacactttagagaaattcacatcggtaattgtataaagctctcctctagggtcctgaaaatttaggacaaacattagctctgtaaataaagtgttactgtgacagtcctgaaaggccactatatatatttatctacataatagatatcacactgacattttcaaggctaccagctttactatataatttttagattatgtattcaagtgttgaggtgcttatgattatgcaaacattaaaagaatagtggtataagaagtagctggggaataaatttgagccagcatttagattacaggctctaaataccccaacttaaatgctaaatggctgatactttctcacttcaaa

SEQ ID NO: 497 - DNA, 139953 bp, Homo sapiens
aactggattgtttgtaacacaaagaaaggataaatgctggctggatgcagtggctcatgcctgtaatcccagcactttgggaggctgaggcgggtggatcatgaggtcaggtgttcaagaccagcctggccaacatagtgaaaccacatctctactaaaaatacaaaaaaaaaaaagggaaattcagatacacgttacaacatggacgaatcttgaggacattatgctcagtgaaataagccagtcacagaaggacacatactgcatacaaggtacctaaagtgtcaaattcacagacagaaagtagaatgtggttgccagggcctgcagagagagggaatggggagttatttaatgggtatagagtttcagttttgcaagatgaaaagttctattacacaacaaggtgcaaacagttaatactactgtactatacacttataaatggttcagatggtaaattttatgctatgtgttttttttactacaattaaaaataaaattgtctcatcaaggagcaagcaccctggggttttcatacaactcccatccctcgcccaccagctgagaatcactcttgaggtgttaactccccacactccaagggccatagagcatgccctgtagagagatacagggagccacaggcacacatggaatggtctgaggtcacctcccagtgcccgggagacattggggcactgaccacatctgccatatcatttacctttgagtcctctgtaaaacaggaatgataaatacctacctcgatagaccagttgcaaaggctactttgaacatacgcagacttagacttaacacagtgcctggcccacagttaaaatgttataatcaggctgggtggtgtgatggctcccacctgtaatcctaacactttgggaggctgaggtaggagagttgcttgagcccaggagttcgagaccagcctggtcaacatagcaagaccccatctctacaaaactttttaaaattagctggatgttcatctgagatgtgaggatctgaaaaaaaaaattagtctgatgggctggcccacgcctatagtcccagctgcttgggaggctgaagcaggagaatccctggaaccctggaggttgaggctgcagtgagctatgatggtgccactgcattccaacctgggtgacagagtgagattctgtctctaaataaataaataatttaaaaattagtggggtggctgggtgcagtggctaacacctgtaatcccagcactttgggaggccgagacaggcggatcacctgaggtcgggagttcaaaaccagcctgaccaacatggagaaaccccgtctttactaaaaatataaaattagccgggagtggtggcacatgcctgtaatcccagctactcgggaggccgagaggcaggagaatcgcttgaacctgggaggcagaggttgcagtaagctgagatcccgccattgcactccagcctgggcaacaagagcgaaactccgtctcaaaaaaaaaaaaaaaaaattagcagggcatggtggcacacacctgtagtcccagttacttgggaagctgaagtgggaggatcccctgagcccaggagttccaggctgcagtgagctatgaacaagccactgcactcactccagcctgggcaacacagcaaggctgtctcttaaaacaaacaaaaagactataatcattgtacacatctgccttgtctattggcaggaacagcgccaggacggcaggggaagagctccgtttccctccctgctctggctccctttaaaggtggctgcctctcagcctcctggcccacccggccttcagggccacaggcctcaagccagctggacacctcacaccggacagctctgccctgggaatcctggaaccccctgctagtaggcgccacgacccaggtcgaggaatgccctcagcacagagactgtcccctggggcagctcgccctactgcctgataagggcggctccttcgcggctcccagactctggagcctgcgggctgggctgcagccaaacgcagacacccctctaatgccgacagcctggcccccttaccctgtagctctccgccctcaggatgcattcttccccagaagctccctgcccacccccacctggaaggcctccctcgtctgaatcagggcgcacacagctgagtctccagcgcggacaccccgtcaccccaacacccttctcctccccccgaacaaccgcttacgatttttagaaatcagtaaaatacatgcccagctccaaacttttggaagcgcctcagagttttgcagagcatagcagtggttctgggctccccagtgcaccccagacttggctccctcctgcccagcccacagccgcgtcccgagagtgaaggggaagcacaggcagccctttccgccgcccccgctggcatgacatcaccttccccacgccgagaagctgaagtctttctcattttgtttcatgctccaagcgcagctttaaaaacctttcctggaggtggggagggaaaatacccaaaatattagccgtggctacagctgggtgtaggatgcagggagttactgtttccttctttatacgtttgtattttccacaatgaccacattctattttttattgtcaggaaaacgaatgagtgttttttaagtaagcaatttagaagcctatttggttgccttcagcatttttcagggcctcagctcgtttctggagccagcttttcagccgctcttctctccgttctctcgctctctgagtggagttctctgccttccaccctttgcttctgtcctttgaaaatgtgagcgaagcacagttgcttgtgcaaaccacaccagcctcctgagatcctctcgattttccttctcactgggaatatttttcatcagaatttattctcccaaactaagaaagggacctcatgtccccgctcatctgatgcactgagaacacagcatcattttcccagtattcttgccaagaatacacaacctgaggcttatcatgaggaaacatcaggcagacccaaactgaaggacattctacaagaaaactgcgtggactcttcaaaaatgtcaaggtcaggaaagacaaagaaagcccaaggaactgtcgccgattggaggagattagagacagggcaaccaactgcagcacgtgatctgggatattgtgttgctataaaggacattactgggacagttggtgacatctaaatctgaatacggtctgtagattagctaattgtattgaatcagtgttcgtttcctgacttagtcactgcactgtggctgtgtagcagaatgtcctttactttttaggaattatacactgaagctttgggagatagagggcatcacatctgcaatttactctcttatgattcagaaaaatatatatatttgtacacacagacagagaaaacagtaaggcaaatgtggcaaaaatgttaatatttggggaatcttgatgaagagtttaaaaaaaaatccttttgttctgttcttagaatttttctgtaagtccctttgcttctgacctctgggttaatgcagttgacacaacagcctgactcctaggctgactgctgactaattctttgcttgatgctcttgaccttggactgtgtcctcccccgatttagcccctgtagagacagtgagcaggaagactagtttggtgaataataaatccgctgtcactgccaccatcaccaccaacaggggcagagggacttttgctgagcactcactatgtaagtcaatgctcccataccctgagtgatgtacacagtacttcactcagtcctcacagtagtcttctgaggttgccattacaatccccaatctacagataaagaaactgaggctcagagagatgaactcacttacctaacgtcacagcagctattaagtggcaaggccagaattgacccacaaatctctagaaccccacagtcttacactaatctgccctgacactggtaaggagactgactggctgtactctgttctgatattttctctcctgattctcctttgctgaaataatagaaacaaaaataattgtaccagccataaaaaaatgaaatcctgtcattttcaacaacatggatgaacttggaggacatcatattaagtgaaataagccagacacagagagacaaatactgcatgatctcactcatatgtggaatctaaaaaaaaaaaaaaaaaaaattgatctcatagaagaagagtcagagagtccaacagtggttaccagagcctgggaagggcaggggagaggggaggatggggagaggtcggtcaacaggtacaaattacaattagatgggaggcataaattctggggttctgttacacagtagggtggctatggttaacagtaagatattgtatattacaaaatagctagaggagaggcttttgaatgttctcaccacaagggaatgataaatgcctaaggtgattgacatgctaactaccctaatttgaccattatacaatatatgtattaaaatatcaaactgcaccccatacctatgtacaatgataatgtgtcaattaaactaattaattttaaaaaattattataaagctatgctgctccatagagtgaccacatgtagctgtttaaatttaataaggctgggcatgatggctcatgcctgttatcccagcactttggcaaatcaaagcagagaattgcctgaggccatgtgttcaagaccaatctgggcaacacagtgagatccatccctagaaaaaataattttaaaatgagctgggtgtggtgatgcttgcctatagtcctagcttgactgggagtttgaggctgcagtgagctatggcatgccactgcactccagcctgggcaaccaagctgagctctgtctctaaaaattaatcagttaattaattaattaattagaattaagtaaaatctgaaattcagttcctcagtctcactagccacatttcaactgctgattagctccatgtggcttgtggctacaattattggacagagcagattgtaaaacatttctaacacggcaaaaagttctattggacaatgccgttccaaaaacttttacatgtgttcatgaagatacaaaaaatgaaaaataaacaaaaaaaaatttacatacccttcactgaccaagataattttttattcaaagttaacttatttttaagataaaacttcaaacacaaaattgacttcaacactgttctcacttgtcacacagaaaccaacttttcagccgcggcagcatcaggtgttagggagagacacctcctggcagcacatggaattacaacctagcacaatcagacactggaaccagccagggactgggtttcagcagccatcggtggaataccaggagattcccaagagtgggagaaaaatcccataccaagaaacaatcatggataaggcaccaggaagacatactaggttacaaaagcccatccaaggccaggcgcagtggctcacgcctgtaatcctagcacttttggaggccaaggcgagcagatcacttgaggtcaggagttcgagacaaaagcccatccaccaccagacataaatctcctgtgtcacatccctcaagccatgcatggctgcacagagatacataataataagtgtcggtcatttgaataaataaatgattgattgattaattctgattatttcagaactctaccattaagcattttattgtcttctttaacattctttttcagttggacacatattatgaagggaatgtagagctgggatttactgcttcaaacaacttagctgacacagaagtgttcgatgatcaaggaacgtctggactttagcaaaatcatcaagaacaagaaaacatcaagatgagtttctggtaaagcataaaaagaagttcctggctaggcacggtggctcacgcctgtaatctcagaactttgagagaccaaggaggacagatcacttgagtccaggagtttgagaccagcctgaccaacatggtgaaaccccgtctctactaaaaatacaaaaagtagccaggcatggtggtgtacatctgtgatctcagctactcaagaggctgaggcacgagaatcgcttgaacctgggatgcagaggttgcagtgagctgagatcatcccactgcactccagcctgggcaacagagtgagactctgtcacaaaaaaaagaaagaaagaaagatgttcccatttttttttcctttggcccaagatggtggaaatgaaagatggcttactggattgggaaatggattggaccctaaatcattctttatccactcgttccacagatactgattgggcctcttggtagccaggcggcgggatgatgagtagtgctggaggccacttagctgagttgtgcacacaaaataacacaatgcacaaaaggtttatcttcaggaactcatcccgggtagaacaagtgctcagcagagatctgggctggtgaaggcagcttgcggtccctgactcttctgagaacctggggatccaggttcagggagaccaacgctattggatacaaatcttgaatttaaagaaattgggatgtaaataatgatgcaatccccgaggctcatggagtaccccagtgacaggagaggttttccatgggattcaagcaggctaatcagcaagacaatctgggctgtctcagtgagccgtggcctgaggctacttgtgggccacctgtccagaattggaggggtcccagggtctgatgtagcttcagagagatggaatagtaaagaggatcatgcattgcaaagtccacaacagccccccaaaacaaggacagtccccttatttgatgaacttttgttgggttcctgtcttgtgccgagctgtgtgctaggttctggggagacagagaccaataagcttcagagacctgagaagtagggtccttctcttcttcatcactttcttcacaaacccacttcagtttcctcttaactcctggcatgagtaaggtgctatttcataacccttttatctttattaaaggtgtcaggtatccaataggaaaaaaaatgcacaaatgaatttaaaaggcattcacacaaaaggatatcaaaatggccagtaagttcataaaaagatgctcaacatcagccaggcgcggtggctcatgcctgtaattccagaactttgggaggtcgagatgagtggatcccttgaggtcaggagcttgagaccagcctggccaacatggtgaaaccctgtctctactaaaaacacaaaaaattagccagatgtggtagcacatgcctgtaatctcaggtacttgggagactgaggcaggagaatcatttgaacccaggaggcgaaggatgcagtgagccgagattgcgccagcacactccagcctgggcaacagagcgagactccgtctcaaaaaaaaaaaaaagatgctcaacctcaatggttacagggaaatgcaaattagacccacaatatgctgtgactatacactccctagaatggctaaaattaaatttctgaaaatatcaagcattggtgaggatgtggaggaagtgaactcttacatgctgctggtggaagtataaaccagtacaagcactttggagaaccatttggcagtttcttctaaaattaaacatacactcaccatgtgaccaagcagttccactcctgggtatataccctgaaagaaatgagtgcgtacacacaccaaaaaacatgtacaaaaatacacattgctgctaaatcgataacagccaaaaactaaatacaactcaaatgcccatcaatagaagaatagataaatacattgtggtgtacagcacagcaagaaaaatgaatgggttgctcttacgtgaaatatgaatgaatctcaaaaacacaatattgatcacaagatatcaaataagccaggcacagtgtggctcacacctgtaatcccagaaccttgagaggctgaggccagaggatcccttgagtctaggaacttaagaccagcctgggcaacatagggtgaccccatctctacaaaaaaattttttaaaaattagctgggtgtggtagtgtgcacctgtagtcccagttcctcgggaggctggagcgggggcaccgcttgagcccaggagttcaaggctgcattgagctatggtcacaccactgcactccagcctgagtcacagaggactaagacccctttttaaaaaataaaaataaaaaataaaaaaataaaaggcaaaacttatctacatatgatgagagaggtcagaatagtgtctacttgtttagggcagtgggagatggggattgagtgagaaagggcctgaaggaacttactagaatgatggaaatgttctctatcctgatcttggtggttgttacatgagtgtatacataggtaaaaattcattgagcatccacttaagatttgtgtattttactatatgcaaattatgcatcaataaaagagcaaaaacaatcaaaactcttaggtgaccacacctgatataagcatggctgatacattaaaaagcttgcatatattacaatgaataccatcatttgggaatttaatataattttgtaacagcctcagaaacagtcatattccagaggcccttggcaacagctttgttgcttacagctcaccagcaccaaaagggacccgtcgctttccaaccaagggggctgtggccctgcccagaactctcaagggatccacctttctgggtcgaactctcacagctcccagagtacctggggccaagcacgtgagctgccagcaggccttagcaccctgggatgccagacctgctcaaacttggagagggtcctacaggtccttggaggaaaattacaagccccaagtacactggacacacagagtttgcctgtgatgaaaacttagatgaaggaagaagccctttaggagggtctttcttgtcttctgcagatgtgcggctctagccgtgctgcaacgcagaccatggaccaggagctcccaacctcagctgcacagcacaggggagcattggaacatgggatgcccggaccgtctgacccacaccaactgaatcagaatctttaatatggtgtttctcagagggccccctggagccacagcaacattgtcacctgggaacctgttagaaatgcacattctcaggccccacttcagacccactgaattctgtggccagccccagcaatctttgttctgactgttctcacagtccctgccaggggttctgatgcatgtggaagtgtgggacctaattagaaactgcatttctagcaagtttccaggcggtgcagatgtggctgctctggggactacactctgaaaaccaccagagtctaactgtctaatgggtagagccaagctctgggagagagtgggggaaattaaaagctacccaggtgagtggctctgatgcaggtgagagtaattagcattgccatagcctctcatcgtctcatctgacaagaggtacacagctggagagggagctcacacaggtgagggcgttacaggagaagaaataccatctcctcaatttgacctgtctgtggtctcttcatttctataacactgcaatttggggttcctggtacggcagaatttaggttctaggtgcctagccctgagaatttgttctggcaatattgaagctggagacgtttttgttagaacactttgcataaaagcctttatggggaaggggacctgattttaccttaaaaagctaatttttggcccaagatagatgagacttagaaggggagaggaagtaaaggaggagtaaagagaatgaaaagaagagatgatgtgcagggctggggaggagagagcaaatggggaggaagagaaagaactgtgagagaaggactgaaagatcgtctctcctttccaaggagcgtccgccctctctctttttttaaaattgagcactgagaagggatttatgcaagactgggtgcaagagctgggcaagctgatatgcaaagcaggaaagcaaaggattgaaaggagtcaaagtgctgtctttggcagcacatgtataaaattggaatgaaggccgggcaccgtggctcacgtctgtaatcccagcactttgggaggctgaagtgggcggatcacttgaggccaggagttcgagaccagtctggccaacatgatgaaacccgtttctactaaaactatgaaaactagccgggcgtggtggtgcatgcctgtaattccagctactcgggaggctgaagcaggaactcaggaggcacaggtttcaatgagccgagatcacgccactgtactccagcctgggtaacagagtgacactctgtctctaaataaataaataaaactggaacaatacagagaagattagcatggcccctgcaaggatgacacacgaattcatgaaaagttccatatcaataaaaattattttaaaatttttttaaaagaatgagttaaaggagaccccaaaggagtgagtgggggctggaggccaggcccaccatggcagagggtcagacttcatcagggtgaaaacttcctgctgtgaaaagccaaactacagactgggagaaaatgttcacagcacctgtatctgaaaaaggatttgcattccaaatacataaagaacccatacaactcactaataggaaggcaaacagtgaaaactgagcaaaagacatgaacagacacttcacaaaggacatgcaaatggccagcacgcacaggaagagatgctcaccctcagtagtcttcagggagatgcagaatgaaaccacagtaagatgctacctcacactcacaagcatggctgaaaataaaaagatgtgtaataccagtattggttagaatgtagggcagctgaaactcctagctcactggcaggaacttaaaatagtacaggctggatgcagtggctcacgtctgtaatcccagcactttgggaggccaagacgggcagactgcttgagcccaggagtttgagaccagcctgggcaatgtggcaaaaccccatctctactaaaaatacaaaaaattagctgggtgtggtggcatgcatctgtaataccaactaccccagcaggctgaagtgggagaatcacctgagccagggaggtcgagactgcagtgagctgtgatcatgctactgctctccagcctgggtgatagagtgagaccctgtctcaaaaaataaagatacaaataaaataaaatagtacaactgcttgggagaactactggagtttattttaaatctaaacaaacacccaccatttgacccagcaattctactgttatgtatttactgaagtaccataaaaacataggcccacaaaaagacttgtacacaaatgtgaataggcgtaagtagctagtggccaccataatgctgttggatttgattgctcaaaagcttgtggaagtctacattggaataataggttgcctttttaaaaggcttgtatccaaatgtgcgtaacagctttattcacgattgctaaaaattggaaacaattcaagtaatccatcaactaggaaatgggtaaacaaaatttgttctcttcatagaaagggatagtaataaaaagattgaaattactaatagatgcaacaacatggatgagtcttaaaatcactgtgtaaaataaaagctggatgcaagagtgcctaccatatgattcatttatataaaatttttaaacaaagagaactaatttatagttacagaaagcagatcaacgatgaactgggactgaggtgactgcaagtgggggactaaaacactttctggggtgatggacaggtgttatatcttgtttaggtgcatgcatttgtcaaaagttgtccaactgaatgcttaaaatgtatgaatgagttttattgtatgtaaattatacctcaataacgtttatttaaaatgaattggccggcacggtggcttacgcctgtaaccccagaacagcactttgggaggctgaggcgggtagatcacctgaggtcaggagttcaagaccagcctggccaacatggtgaaaccctgtctctactaaaaatacaaaaaaaaaaagaaaaaaaaattagccgggcgtggtgacaggcacctgtaatcccagctactcgggagtctgaggaaggagaattgcttgaacccaggaggcggaggttgcagtgagccgagatcgtgccattgcactccagcatgagagacagggcaagactccgtctcaaaaataaataaataaaatgaatcaaaaataaaaatataaaaaaatagcagaaaagaaaaaaggacaagaataaaataaaaataaagaaaagaaaaataaagaaaaaaataagaaactttgtggtaaaaataataaaacagtaaaataggaagagcacacagaatgggaagagaaatggaccaaggtgaaaaccgtgaagagctgtcgaacttgaagaatagaaaaggaagaatgagcagagatgcacaggcagaggtcagaatgaagtcctctgggggtcaaagaagtaagaagcttggtggccacagacagcagagagttaaaagagccaagggggccagccagtaagattaatgcctggagagggctgtaggatggggcccgagtggagaagtgactcctgagaggccagttctgaaggtgggttgaggggtgataacttgggctgagggagcagagaaggagccttcggcagctttgtcagggagcctggggaaggagagtgggctccaacaggaggctgctgggagaaccccaggggaaacccacctggtggcctcaatctcctgacactgtctttcacgtcttcattcctacacagggatagatattgctatttgaccactgcccctgcacaaggtgtgccaaaagtccccaagcccctttcccataagaagtttactgtatgtttgcactgaggaaagctaaataagctaggtgaattccccaccccaaattcctagggatgccgctggcttgccccaccaaatcggtctctcctatctgcctgtattgctggtgggaatgtactttggtttgacttccataggagctggtttggcaaaaactatcaaaactacaaatgcacactggaggtacaaatacaacaggaggtatttatgctacgataaacttgcacacggatgaaaccatgtatgtacttggttatttgttgcctcattgtgatgctgtttgatcaaaacagacccaaatgcccctcaagaaggccattagataaatactaatatgttttgttttgttttgttttgttgagatggggtttcactcttgttgcccaggctgaagtgcaatggcatgatcttggctcactgcaacctctgcctcctagattcaagtgattctcctgcctcagcctctcgagtagttgggattacaggtgcccatcacaacacccagctactttttgtatttttaatagagacagggtttcgccatgttggccaggctggtcttgaactcctcacctcaggtgatccacccacctcggcctcccaaagtgctgaaattacaggcatgagccacctcacatggccgtattttttttttttttttgagacagagtcttgttctgtcgcccaagttgaagtgcagtggcgcaatcttggcccactgtgacctccgcctcccaggttcaagcaattctcgtgtctcagcctcccaagtagctgggattacagacgtgcaccactatgcccagctaatttttgtgtttttagtacagacggggcttcaccatgttggccaggctggtctcgaactcccaacctcaggtgatcagcctcagcatcccaaagtgctgggattacaggcgtcagccaccatgcccagccttaatatgtattaagtatgtatattcatcttagtccatttgtgttgctataagaaaataccttaaactgggtattttgaaatttatttatttatttatagacagggtctcactgctaccttcatcttccaggctcaggctatcctcccacctcagcctcccgagtagctgggaccacaggcgaacaccaccacatccagctgattttttgtgtttttggtagagagggtttcaccatgttgcccaggttggtctcaagctgctgagctcaggtgatctgcctgccttggcctcccaaagtgctggggttacaggcatgagccaccaggcccagccttgaaacttattgtatttattacagctctgttgactggaaagtccaagatccatcattgctgcctggtgagggatgctctctgcttccaagatggcaccttgccgctgtgtgctcacatggtagaaagtggaaggacaagagactgctcccttcaacctccagccctttcataaggctgctaatcccagtcataagagcagagctctcatgacttaatcacctcccaaaggctatacctcttaatactggtacattggggatttcatttcaacaggaattttggaggggattgcatatttattgtactttattcataatttaatatctattttaaaaattatagccacatgcatgcaatggatactattcaggcacaaaaaacaggattctctctatatacagacatcgaaagtcttccgagttatattatcaagtgaaaagaaaagcaagacacataacagttatatagtacaaaatctttttccttttttttttgagacagagtcttgctctgtcacccaggctggagtacagcgacacaatcttggctcactgcaatctccgcctcccaggtttaagagattttcgtgccttagcctcccaggcagctgggactacaggcatgcaccaccacacccggctaatttttgtatttttagtagagacagggttttgccatgttggccaggctggtctcaaactcctgacctcaagtcatcctcccaccttggcctcccaaagtgctgggattacaggtgtgagccactgcactcagcctacagtacaaaatcatttgtggggtttttttttaaaggtatgtgtatggaagctgggtgtgggaggcttacacctcccagcactttgggaggctgaggcaggaggattgcttgagctcaggagtttgagaccagcctggccaacatggtgaaattccatctctacgaaaaatgcaaaaataagtcgggtgtggtggtgtgtgcctgcagtccccgctactcaggaggccaaggtgtgaaggtcgcttgagcccaggaggctgaggctgcagtgagctgtcattgtgccactgcgttccagcacaggcgacagagcaatatcttctctcaaaattttaaaaaaggtgtatggggtagggtgtaaaagaatatatttgctctgtcacccaggctggagtacagcgacacaatcttggctcactgcaatctctgcctcccaggtttaagtgattttcgtgcttcagcctcccaagcagctgggactacaggcacgcaccaccacacctggctaatttttgtatttaaaatacacctcccccataaagtctttgcaggtgttggggagtgaacccaggaggtggagcttgcagtgagccaagatcacgccactgcactccagcctgggtgacagagcgagactctgtctcaaaataaataaataaataaataaataatttaaaaaaaaactttactcttgggttcaatactgggggattgcaaattaaactgaaaaaaagacagattagcaagaaaaaagagtttaattacccggggaatgcacagacacatagaagtgctcaatgacggagtggttagaactgggggcttatatgccttagaaggagaataggagggctaccatgggaagaacaaatagatttacaaatgggtttttaggagaagaaacagggtattttagaagtttgtgatgaggtttatttatgcaggtgcaaatagtctctgtgtcttcctcatggccatgaaactcccctgaatagaagatttgtggtaggtttattcttggtccctctcctggaagtggaagctgccccaaagacagaatgtatggcagtcttcagttccaagtgggccgcacacaaggatacacaagaaactgataatagtggttacacatttgaagggcaggggatagaggtgaatgaaaaccaagaagttgtgaacagggacttgggaagacgtttttagaaattttttcatctttattttttaaattttagaaagatatgaatatattgcccattcagaaacaaacaaacaaacaaaaaaccctaggttctaagagtgattgtaattcatttaaggagtggtttccccctatttaggaaaagatggatcgtgcctcattagcaaggcctagtgggattcagccctgagggaggtgcaggagattttatcatcatctttgtcagcatcactgcactttctacagagaaggttacagaacagggtcaggtcgtcgccctttctactttgcttagagggacgcttacagcctgtgtcagctgtcagtcccaagacctctgtctccccagtctcctccagcctccagaaaaacaaaggcagctgtggagggtagaggatgggctaggggtgggacccaagactcactggacaatggaaacctttccccttcaagcagatgtcaggattattatttgcactttgcatgtggaaaagaaggactgtaacacgctgacaaatgcctgcatcttgttctaaaattcctgacttgttgccaataaaagaatcaaagtgctttctagctcagagaaaaagctgctgctaatttgaagaagattccagaatagaaattcaggtcaaccaaaggtttttcagacagagttgatgagcaggtcttacatggcctgaaattcaaagatacaaaccagagaaagaagagatcaaagctcttgtcctggggacacattaaaaactagatctggacacatctcagttctggagccaagcaattcctccctcagggtgtcgaaactagtcttctcctcagcctagagccctcctctctaaacctgcttattctggccctgtcttctcatcttggtctcatcttggtctctttgaggtagaaaatcagcaggacttattttctgagcacctgtaaggcccctgctgatcaaaactaggatgcagggccgggcatggtggctctcatctgcaatcccagcactttgggaggccaaggcgggcggatcgcttgaggtcaggagttcgagaccagcctggccaacatagtgaaaccccgtctctactaaaactacaaaaattagccgggtgcattacgcgtgcctgtaatcccagctactcaggaggctgaggctggagaattgcttgaacccgggaggcggaggttgcagtgagccaagatcgtgccactgcactccagcctgagtgacagagagagactccgtcatacacacacacactcacacacacaaaaacaggatgcagtaaagaagccagctgaaaccagtacatggccaccaaagtgacctctggctgccctcatttttcattactaaatagactcccaccggtgccgtgacagtttacaaataccatggcaatgtaccgtggcaatgacccagaagttaccttatatggttccaggaactctccaccctttttctagaaaattctgaatgactcaccccttcattcgcatataattaacagtgggtataaatagaactccagcaatccaagcggtagctcctgctctgattcctcctccacattgctactgctgcctcacactgccactgttgctcaggactgctctgtggagcagccagtttgctgtacactgctcctctgggctactctgggctactctgtctatgggacagctctgccctgtctgcggagccaccattttgctatacactattgctctaataaacttgctttctttcactgtcaactcactcttgaattctttcttgagcaaagccaataaccctcccaggctaagccccaattttggggttcatctacatcaggctcagagagaccttctccgatcatccaaaatatacagtccatccaatgtatctaacatatttcctattttattctcttcatagcactgaccacaaatgaattcttacttatttgcttatcatccttctcttccagctagaatgtgctctcatggtacagtcgtactgttttgtctccctatgtccccagtgtttagaacagttacttagtacacagcaggtgctcaatcaatataggctcagttaatgaaaaaatgattaaaagttaaacttgagatgtctgtgaaatatccaaggagtggtgtcaagaagagagttgtcaagtagtcaagtgtgggaaagatccaacctagaggtacatatttgggtattactggaacaaactcagtttttttaaaattgataaaaattgatgacaacagcaaaggagaatttaaagaaggaagagcctgagctccaaggagcccaaaatttacaggttgggtggagaaaagggaacaagcaaagaagagtgaaagagatcagtgaggtagaaggaaatccaagagataagttatcccagaggctaagagacaagactgtttcaaggatgaggaagcagccacctatgtggaacaccaccattggaattgccagcatggagattgtctgggccctgataagagcaatttcaaggcagcggtgagggcagaaaccactggtggatgggaggtgaggcagtgggagcactgagtgtcaatgacttcagaagtttaactgagaagaccagcggataaattggatgtagctataggcagatatagctcaaagaaaaattcttagccaggcgcagtggctcacacctgtaatcctaacactttggaaggccgaggggagcagatcacctgaggtcaggagtttgagaccatcctggccaacgtggtgaaaccctgtctctactaaaaatacaaaattgcttgaacctgggaggcggagcttgcagtaagctgagatcgtgccactgcactccagcccgggtgacagaacaagactccgtcttaaaacaaaaaaaaaaaaggaaaaataaaagaaaggttctttttctgctcaactttttatttttatttttattttttttaaattggaagaattatattaccagattttaatacttattacaaagctatagtcatcttgacttatgtggtattggcaaaaggagagatgtacagatcaatgggagaaaataaaaagtctagaaatagacccataccaatatggctaattcctaaaaatgaaaaacctacagaaaagttgaaaggatagaacaatgaacacttctgtacccttcactttaatcatttgtcaaccctttgtcacatttaattcccatgcacatacccgcatgtattcactttggggtaaatcactggaaataaagttgcagacccccctgtatatcagcatgcttttcctaagaacgagctcattctcccacatgacctcatgatatatcccactcaaagaaatttagcatcaaagttatctaataaagagaccatattcacatttccccaaatgtttaaaaatgtcctttgtagctttttctctggtccagcatccgatcaagagtcatgcattccatttggttgccacatctctgtagtctcctttaatcagaaacagtcccctgtatttttctgtctttcatgccactgacattggagagtttgggctggttgtcacgtagcatgtcccacattctggattgtcctgatttttttgtcatgattggattcaggttaaacattcttggcaagaatatcacagagatgatatgaactcttaagggtgaatctctgttaaaggtggacaacactcagcctacttaaatgctgacaaaaaggatccagtagatgggtgatagaaattggaaggaaatttggacggggaaggaaattagaaagatgaatgaagtaatgaagttttgagttggcaagagaggtggagtcagagcacaggcaaaggggtttgccctgacagggagcagacgcatttcgtcggtcgtaacagacgagaaggagaagatgctgacaatgaatgtggtctgaaatcgggagaaggagtgtgtttggatttgatggcttctttttggatttgacggtcttcttctcagtaaaataaggcagcatctgcgggtgaaactgacagtaagagtagaagagtggaggggagtttagaggaagagaaagtatgacaaagtcattggtggcagtggcaaagcaggcttcctggagaaatataaaaagctaggcatactgttagtgggaatgtaaactgtggaaaacagtattgtggttcctcaaaaaattaaaatagaattaccatatgatccaccaagttcacttctgggtttatactcaaaagaattgaaatcagaacttttaagagacattcatacaccctggttcacagcagcactattcacaatagccaagagctggaagcaactcaattgtctgtcgatggacgaataaacaaaatatagaatacacagtggaatattattcagccttaaaaaggaagaacagttgggtgtggtggctcatgcctgttatcccggcattttgcaaggctgaggcaggcggatcacctgaggtcaggagttcaagaccagcctggccaacatggtaaaaccctgtctctactaaaaatacaaaaattagccaggtgtggtggtgcatgcctttaatcccagctactcaggaggctgagacaggagaatcacttgaacctgggaggcggaggttgcagtgagccgagattgtgccaccacactccagcctaggtgacagacaagaccccatctcaaaaaaaaaaagaaaagaaaagaaaaaggaaaaaggaaagacattctgacacatgctatatcatgaatgaactttgaggacattatgctaagtgacattagccagccacaaaaagacaaatactgtatggttccatgtatgtgacatctctagagtaataaaattcatagaagcagaaagtagaatggtgattagcaggggctttgtggaggagtgggcaatggggagttttttaatgggaatagagtttcagcttggaaaggaaaaaattctggagcttggtcgaacaacaatatgaatgtacttaacactactgtattgtacacttagaactggctgaggtaaaatttgtgttgtatgttttcttaccaccataaacaaacaaactaacacaaatatacatacacctatggagggaaaagaagttaggcaggccatgtttagtatccaattgatgcttgagataattcatttatagagaaattagctgattagctaagttacaaacttttctccagcaatattctgctgctcaggtatgtaggtagagaagggaaatatttgtgttcattcaggatggggctctacaaagagagaggggccagggagctgaaggagtttgtgaagaagtgtggtagattgtcttactgtccaataagaattttctcctcctgccttccctgaccccaacccagggcatggaaaagagttccctgcccacattgcccttgggcttgaccattgacttgttttgaccaacaggctggcagaagtgtcagggtgcctgtcccaaggctgggccttaggaagtcttgcatgttcccctccttctcttatgctcctgccatctgccatggaaagagcttgccccagccagccacggctccttcactgcggtcgtagaataacagacccccaagcaccaagcccagttgttaagcaccagaccagtgggactcttgggaggaaggacactgtgctgggtaagccactgagatttgggggcttcgtcaggtggatttcactatgtgaaacagttttgtaccctgtttctctccctcaacaagagatcttgagcatttggccaggtgcagtgcctcccacctgtaatcccagcactctgggaggccgaggttggcaggtcacttgaggtcaggagtttgagaccagtctggccaacatggtgaaaccccatctctactaaaaatataaaaaattagctgggtgtggtggcgggtgcctgtaatcccagctacttgggaggctgaggcaggagaatcacttcaaccaggaggcagaggttgcagtgagctgagatcgtgccattgcactccagcctgggcaacagagcaagactccatctcaaaaaaaaaaaaaaaaaaagagagagcgagatcttgagcatttaaaacttcaaggacattattctcaatggctgaatattccatttaataaataacataatttactgaatggttctttcattattgggacacttagaattttccatgttttcattgtattgcaggaaataaaatgaaataacattgcaggaaatattgtatataaattccaaatacaaggtataaatacttttaaatttatattttgaccccagtacaatatgcatatggatttttaaaaatcaaacaaaaaataacaaaagattagtggatatttgaacaaagcctctaaaaatcaaggacagaaactgtgaggtattgctaggatagccccagtttcttctaccaggaggttgaattaataatttcaccacagccgggcagagtggctgatgcctgtaatcccagcactttgggaggtcgaggcaggcagatgacttgaggtcaggagtttgagaccagcctgggaacatggcgaaaccccgtctctactaaaaaaaaaaacaacaaaatttagccgggcgtggtggcgtgcacctgtaatcccagctacctggtgaggctgaggcatgagaatcccttgaacatgggaggcagaggttgtagtgagcagctgagatcacgccactgcactccagcctgggtgacaaagtgagactctgtctcaaaataataataataatttcaccaccactgagatgatctcgtgacatgttttgtccaacaaaatgaggcagaagtgacattatacagttctgatcctgggtctcaggaggcctggggtttctgctgtgttgcagaaccctgcccagccatcctgagaacagcccaatctggcctgcctgatggaggataagaaaccacatgaagcagagccaagtaataccagctgagtcctaaaagctccgccagccccaactaaccaccagctgcctttctacaagtgaatgatcccaagcaaagtcagcagagcccaatataaatcagcagaacaaatcaaccaaccaaccaactggtagacttgtgactaaaaacagatgatacttttatatgtcactaagactttgtagttgtttattaggcagcgtcattgtgccagtagataaccaatacaggaatcaaaactttaaaaacaggaaaagaagcttccttccagttttcaatcggacatatgaggaacttggaagtcatgactccatcttaataagttaaaaaaaccgaacaaactaaaaatcagcaactcttggctggttgcagtgggtcatgcctgtaatcccagcactttgggaggctgaggtgggaagattgcttgagctcaggcgttcgagaccagcctgggaaacatggggagacccccgtctctacaaaaataaaaaataaaaataagctgggtgtggtgacgtctgcctgtagtcccagctacttaggaggctgaagtgggaagattgcttgagtctgagggggtcaaacctgcaataagccaagattgactgggtgacagagtgagactgtctcaaaaaaaaaaaaaacttcttagatctgtcacagaattgaggtcacagggcaaaccactgcctccaaaattggagagacagacagatcgtacagagaatcacaacttatcactgcagagtcacaggtgcagagaccttgctaggaacaagtacagggacaggaaagcctgaactgcaatttacaaattgctggaggctcagtgtggacaagtctaagagtttaaaactccggggatggggccagtcttgaagggcatgcccatacttttggtttcttgggggtttttttgtttgtttgttttgagacagggtctccccctgttacccaggctggagtgcagtggcacaatctcggctcactgcaacctccacctcccaggttcaagcgatcctctcatctcaacctcctgagtacctgggataacaggcgtgtgccaccacgcccagccaatctttgtatttttagtagagatggggtttcaccatgttgatcaggctggtttcaaactcctgacctcaagtgatccacccaccttggcctcccaaagtgccaggattacaggcatgagccaccgcgcccagccacatgccatacttttgtgagttttaccttcaggagttctactggtttctcacagtaaagactggagaaaacccccctcatgaggtttcttacaaagctaaccattctcctaccataccattttcatcaatcacactccttagtatttactcaaaggacttgaaaatgtgtccatgcaaaaacctgcatactgacgtttatagcagctttatttgtaattgccaaaagttggaagcaaccaagatgttcttcagtaggtgaatgggtaaataaaccagtacatccagagaacggaatattattcagggctaaaaaggaatgtactctcaagctatgaaaataaatagaggaatcttcactgtttattacttagtgaaataagccaacccgaaaaggccgcatgctatatgattctaactatatggcattcaggaaaaggccgaactatggagacactagaaagttcagtggtctccagggtttgggaagggtagggaggggtaaacaggcagagcatacaggatttttagggcagtgaagctattctgtgtgatactataatgatgaatgcatgtcattatacatttgtcaaagcccaaagaatgtataataccaacagtgagccctaatgtaaacttggactttgggtgacaacaatgtgtcagtgtaggttcaacaattgtcacaaatctaccaccctggtacggggtattgctgacgcagaagactgtgtgttgtgggttggaggaaggaggtatatggtagctgtactttctcttcagttttggctaaactgttaaaaaaaataagtgttcttaaaaaatgatcatgccaggtgcggtggctcacgcctgtaatcccaacacttggggaggccgaggcaggcggatcacgaggtcaagagatcgagaccaccctggctaacacggtgaaaccccgtctctactaaaaatacaaaaaattagccgggcgtagtggcgggcgcctgtagtcccagctactcgggaggctgaggcaggagaatggcgtgaacctggaaggcggagcttgcagtgagccgagatcacgccactgcgctccagcctgggcgacagagcgagactccatcaaaaaaaaaaaaaaaaaaaagatcaaaagtctcaaagcaacaatgtaaggtcccacctcaagaacttaaaaaaagaagagcaaaataaactcaaagcaaatagaagaaagaaaataataaaagcagaacttaatggaaacaaaaacaaaaaaaaataataaagtcaataaaacaaggagttgattcttggagaaaacaacaaaattgtcaaaactttaccaagactgagaaagaaaaaaggaaaacacaaattaccaatatcgggaataaaacagaggctatcagtagacattgcagacatcgaaagaataacaagaaaatattacaaactgctctacacatataaatttgataacacagattgcacaaaaagaaagtaaaatactcagatatacatctatcaaaactttccggccggcacggtggctccatgagccgtgttcgtgccacggcactctggcctaggcaacagagcaagaccctgtctcaaaagtacaaatttaaaaaaaaaaacttgcacaggatctgtaggctgaaactacaaaatgccagtgaaagaaatcaaagatctaaataaatggagaggcatcacatgttcatgaattggaagactcatcacagaaaagatgtcagttctccataaaaattgcataggtttaaaaaaatacccatcaaaaccccagcagagttttttgtagatatagacaacattagtttaaaatgtatccagaaaggcaaaagaatagctaatacaattttgagaaagagaaataaaatgggagtaatcagcctacccaatttcaagacttacaatacagctacagtaatcaagactgtgttgtgctagtggaggaagagacacatagatcaatggaacagagcagagtatccagaattagatgcacaaaaatatgcacgactgatatttgacaaaggcacaaacacaattcaatgaagaaaagttggccttttcagccgggcgcagtggctcacgcctgtaatcccagcactttgggaggctgaggcgggtggatcacaaggtcaggagttcgagaccagcctggccaacacggtgaaaccccatctctactaaaaataaaaaattagccaggcatggtggcaggcacctgtagtcccagctactcgggaggctgaagcaggagaattccttgaacctgagaggcggaggttgcagtgagccgagatcgtgccactgcactctagcctgggcaacagagcgagactccatctcaaaaaaagaaaagaaaagaaaagaaaagaaaagttggccttttcatcaagtgatactgggacaactggatagccagaggcaaaaaatgacccacctaaaccccacaccttctacaaaaattaactcaaaatggattgcagacttaaatgaaaaatgtaaaaccataatacttttataaataaacaaagaacatctccagagtttagggcttacacttgatagcaaaagcactatctgtaaaaggaaaaaaactgtatattgaactttatcaaaattaaaactttttgctctgggctgggtgcagtggcttatacctgtatcctggcactttgggaggccaaagcaggaggatcgcttgaggctaggagttcaagaccagcctgggcaacatggcaaaatcccatctctacaaaaaattttaaaattagccaggcatgctggcatgtgcctgtagtcccagctacatggaaagctgaggtgggtggatcgcttgagcccaggagtctgaggttgcagtgagctgtgatcacaccactgcactccagtctgggtggtaaagtgagaccctgtctcagaaaactattattattattattattattattattattattattgttattgttattttgctctgtgaaagactgttgagagggtgaaaggcaagctataaactaggagataatatttgtgagtcacttattcaacaaaggacaagtatttagaaaacataaggaatccctaaaactcaacggtatgaaaatacgccatccagttagaataaaatgggcaaaaaatatgaagagatatttctctgaagaggatgtacagataacaaataaatacatgaaaagatgctcaacaatgtcagccatcagggagatgcaaattgaaaccactatgcgatattatacacatctatcagaatggctaaaatacaaaacagaatagggacaacatcaaatgctggtgaggatgtggagaaaacggatccctcatacattgcaggtgggaatgtaaaatgaaatagccccctggaaaacagtttgacagtttctttaaaaaaaaaaatctaaacatgcaactcccatatgacccaacaatttcactcttgggtaattatcccagagaataaaaacttaagttcagatatgaacttatacatgaatgattatagcagccttattctcaacagcccaaactagaaagaaacctaattcctttaatgggaaatggttctaaaaaagatagtacttttatatcatggactactattcagcactaaaaaggaataaactggtcaggcacagtggctcacacctgtaatcccagcactttgggaggctgaagcaggaggatcactgaagccaggagttcgagaccagcctaggcaacatagtgagaccctgtctctattaaaaaaaaaaaaaaatagctgggcatggtagtgcagcctacagttccagctactccagaggctgaggtgggagggtcgcttgagcctgggaggttgaggctgcatgatcacaccactgcactccagcctgggtgacagagtgagacactgtctcaaaaataaataaataaataaataaataaataaaaggaataaactattgatacaaataataacctggtaggattggcagaaaattatgctaagtgaaagaaagccaattataaaagtttatatattatatgattccattcttgaaatgggaaagttagagaaatgggttaaggagggagtggctgcaggaggcaagtgggtgtggctataagagagcaacacgaaagatcctggtagggacagaagtgtgtgtatctgatgtgttatgtcaatgtccacatcctggttgtaatattgtactgtagttttgcaggatgttaccatagcagccaaggatacacaggacctctagattattttgtacagttacatgtgaatctagtatatttatctcaaaatagaaagtttaattgaaaacaatcaaacattaaaagatgcattaaaagatggagtcagtgacattttccaaaagtagaacagcaataaaaaaataagatggaaagtaggaaacaaacccacaagaaagagatggcattcattcaggtggtctgaaattgtgaaggctaattttatgtcaacttgactgggctgagggatgcccatggctaaacattatttctgggcgtgtctgtgaggctgtttccagaggagatccacatgggaattggtgaagtgaataaagcaaatggcctccctcacttgggtggccatcctccaattcactgagaacctgaataaaacaaaacagcaaaaaagaacaaatttgctctgtttgagctgaaacatccttctcctgcccttggacatcagcacccttggttctcatgcttttgtgcttaagctaagacgccaccagcctcctgattctcaggccttctgacttccactgatctccaccaccagctttcctgggtctcagcttgcagatggcagatcatgggattcctcagcctccataaccacacaagtgaattccataagaaatctcagccgggcacggtggctcacgcctgtaatctcagcagtttgggaggctgaggcgggtggatcacctgaggtcaggagttcaagatcagcctggccaacatggtgaaaccctgtctctactaaaaatacaacaattagctgggtgtggtggcacacgcctataatcccagctacttgggaggctgaggcaggagaattgcttgaacctgggagtcagaggttgcagtgagctgagatcgtaccactgcactccagccctggcaacagggcgagactccgtctcaaaaaaagaaacacaacaacaaaagaaatctcaatctttctctctctgaaaaagcaagagagcatgaatgtcatgttggttctttttctctggagaaccctgactaacacaatacagacatccaactcagaagagttccaagaaagaacagagaaaacagtggggaaggagattatcaaggaactaatacaaaaaaccaccagaatgaaaggaacttatttcccacattgcaagatccatataaaggtaaatcatcacaaaatgtcagaactctagggtcaaagaacacagagaggaaaaaggaaaagggtcttctgggggttctgtggtataagccatatcacttctcgctcccctgcccgccccccgcccccgcccccgccccccactgctgactgaggatgcagtagcctcccatctgcgaagtcaatgaccactcctccatctgcttcccagctccattctctgggggtcttgctcatcttactgtcagtttagccaagattcaggagagagctgagcctaatacctgggctcagtctaccctctcaactcagaagtcgggcgctagaatgttaccctacgttagattctgaaatccaaatttttgcttctgcctctggccacctcacaagggactcacgtgcaaccaagcatcggcgatgccttccccacctctcaggctgcaacctggccagggcggctcttttcacgtgactttgcccttgatatgcttgttcatctgagtccatatgttacctgtttagcaagtgggtgatggcgtccctctgtgaggaggtagacggatgctgagaaaattagttcctagtgcaactcgaggggtggggagaggcttttgcctgccttacatcaaccttgctaagatgttattttttaattacacaataatatttgaataatatcacaaaaattaaaccattacaaaagattcctcctatacttgccatttccaataccagaggcataaatttccagtcctttttgtatacattttcctagatgtttatgtatccataagaaatatattgtgctgctttagtgtggatttttttttcctttaacacatgagaaaacggtatgtcatattgcagtttgctttttttttctttttcactcaataatgtatgtcagccaccttcccatgtcaggactggcaaatctcccatctttacattttactattacatggagtttatagtaaggatgacacattttatagccattctgcttgggatagatgtttccgtttttccaggatttttgcaagtgatggggctgcacagcagtctgtggtccaaagccccgtgccggcccataggtgcagtttattagccgtctaccacaagataagaacagaaatttgggataggtgttgagaaacttttatagcaatttggcggggtaatgtcatatcgaatcttccaataaaaattggaggcttatattttctaagtctttattttttaaattttcacttctctagtaattcatttttactacaaaagtaaaaatgtacgtgtttatgacagatcagaaataaaaactagaccacagtctgagcacagtggctcaagcctataatcccagcactttgggaggccgaggcgggtgatcacttgaggttaggagttcaagaccagcgtggccaacatggtgaaaccccgtctctacaaaaaatacaaaaattagccaggcatggtggcatacacctgtagtcccagctacttgggaggctgaggcacgagaattgcctgaacctgggaggcagaggttgcagtgagccgaggccgcaccactgcactctaatctgggtgacagagcaagactccatctcaagaaaaacataacaaaccaaaacaaaacaatagaccttgcccccagattcccagatttttgagaagagctgcttttgtggacagcttaatgcatgcctaccctctcattctcatgtcagcatctctctgccataaatctaaagaatgactctctggggcacaggatttagacatcatttattgtaatcgagagtggcaatttgcccctcaaaaggctagatccccaccaccattggtatcttgttgtaactcacatgttcctgaataccaacgagacggagcttctttttgtatgtgtattatccatatatatgtcctttgaagccagcctcaagtccaggaagtcagccaagtcctgggttgtgataatcctcctgcagcctcatctggtttgaacttcccagaagtcctaggaggtgaaccaggcagggataatttcctctttaaacattccagttcctcctgtgggacattgaggctgaggctgcacccaggccacatgcatatgtatttattggcagggctgggcctgagactaggtctcctagcctagaattccctccaaagattcacgagagtccaaagactaacacccatggcccgggtccaaaagttcactaagaggacaggctgaggctacatgatgggggaaggggggagtcagaattagggccaagaactagatctgggaggtcagggagggaaaggagaaacagtgagaaactgtgacgcagcacaacatatatctcagcactgggaatgtctatcttctggcgctgtcggaggagataagtagattatctgtcagcccaacagtctaagcaaagaagaagccaggagttccttccgtcaattcacctaatcttttaacactgcttatcggtggggtcgatgtaactcaaacctcctaaaacaacacggggtttatcctgtccgactcaagcaatgaacttgcaactaccaagacatcaggccaaaccatcactcattttgctcaggtgtgcctttgtgcaaatactcaccctgccaagtctgggaggccatttccagaaaccatgggtggtgggttgtaatggccggtctgcctcgtggcaggcaagcaggtagcagtgaaggaacatgccatgagaagtgggtgcaaagagagaagatctcagagttgggtggagacttagaaccatctaacccaatccttacccacattcataggttcaagtaccaggtctctgcaccatttctagacattacttagcttccctgaacctcagtttattcatctgtaaaatgggctctgcctgcagtgggtgacattggggctgcacctgtatcctgcagaccctgatcatccctgtgtacaactttgcctgtgtgcttagaagtgttagagaattcacactcccaggagcaacccccccaaatagcctaacaccccaactcctgaggggcaggatcattcttaggtatgagttctacactgtctcccagggaccccccatgagactgagctccagctacccacagcaatgaggtgcttgacaatacaccccaaatcagtcgccctcctctccctctttcacttccctacagccccttgagatcactgtccatataaaacacttgcacaagaatccatgcaacagagtcagcttctgggggaacccaaattaagaaactttccaactttctcacagtgttgttggtaagatcaggtacagctctcagacaaaggtcgaggttatcagcatgaaaccgtggcactattctgtgtgccaggcaaagggagccacaggttagtctgagttgggtattctggggcttttgaactctaggtggtcacatggagactttaaggtagaatgaacataagccgtaaaagacagcagagttggagcctactgggctccgcctggttttaactgctcccaacacaacaatcacaactgccaatctccaagttccaaagaactggctctgccaacgactcagaaataagttttgagcataatctagcccgtagttgatatcaagcagaagatgtgatctgtggttctcatagctcacaatctatgcagaacccaaagagaatatgtaacaattaactgagcaaaaccagcagcaaatcctggaacatcgtgtggaactagaagaagatggtggtttgttgaaagaacacaggagccctgaaggagctccaaatggtcaaggttggaagaatttaaacaataagaaaaataatgatagtttaggacaataacccatagagttaaataaatgtccacaagtccacactgatataagtatttgattaaataagtcaatagggaagtgacagctcttccttgcaatgaaaatccagtcaatccatgcggaaggaaggagcaaaggagaaatcagcattaggtcaacaccacagtggtgattgttgcagacaagagctgctaatagacaacagaataggtggaaggtttgaggaaaaaaggggtttgcaaagccttaagtatctcttccaggaggtttgttgacaagggtggggtttggggacagaaaaaacattaccaaggaaaagcccatcagagaccacttgaccaggtgatcagggccatcatcacagacgtaagccatcaacgccatgcccccgtgacacgtgcagtgagcaggatgcagccccaggcctctggcgcccttgcctgggatgcacaacctgagcccaagttcagacaggcctgaactaagagacttctgcaaagtaactgatcaatactcttcatgggtatctaggtcctgaaagacaaggaatgaccaaggaactattatagagtctagaagactagagagaaaaaaacaactatatgcaaatgcgggatcctggatgggattctggagcaagaaaaagacgttaatgggaaaaccagtgaagttcacacgggatctttggtttgattaaggctgctgtactgaggttaatttcctggttctgattactgtgctatggctttgcaaattgtgctatggttttgcaagattggggtcaactgctggagggacatagagaagttgcctgtaccaggcttgcaaattttctgctacttttactactagttttctaaaagtgggtcaaaatataaaggttttttaaaaaagcatcaaatgtccagtttttcagcagtatctttattagaaaaggaacaatccccacattgtgttgatgtgagcagtactcaaaactgaggcaacagatctcaaaatattttggcatgtgggagtggggaggtaaaggctgaagcctcctctgtccgaagcatgcccccgaggctgggaggaggcaaaaatgacaaatcacatctgaatctgtttggcagaaaaaatgtccagtgacctgtccgagggccagtcacacatttatcaggagtattagcagctccgcattcccagtgcaggtctcccaggtccacgccctagcctcagcccaggacaggctctgatttctccgaaaatgatgtgcaaatctgtttcaaaccacatgaccttttgccacaacctctttgtggcttgttctattggatcagaagccaggagtattttcggaacattgctaatgctctgagcatctcagttctaggcctgtaggccacatatgatgtgcgttgggccagaggcccaggtcaaggtgtctcgagggaaattggagtcaatggtgaagtgagaaagctcttgtgaggcctttggccccagtgggagggccagggacagaggtgggcctgcctggtgagcccacctgcaggcaagaggcaccctggggaggtgccaggaagcagggcgcaaggcaaggaggcaggaacagccacgtctgctcctgccctttaaacaaataccaggctgttcgagtccagagaagaaataaatattgacaaaggtgcggagcggcaggaaggccaggtggccgaggccccagaaggaacatggcctagatagggtctcctgggatgactgcgaggaagcctcagccccgagccaccctccccaggggcccttggcgaggctgcctctacggaggtccttcccccgtctcggcaggtgcttcggcaccttgagggcttggactcaggctgtcaggatgaggagcctatccacgggatcagttgctggtgtttgccaaaggtgtgtcccagaggggccacccgtagcctctgacggtgccacggctggaaggccctggccaaacacctgtcccacttcaacagcgcgttcagtggatcccccaaaccaaagggcctgctggcgttcttcagtgagcttctcaaagtgtgggtgcagggctctcaatagaggcccctgggcgctgggtaagaggcacattcctgagcccacacctacccctccaggacactgcaggtcgaagctcaggaatgtgcattttcaccaccttccctagtgattttaggcagagggctcattagagccaagtaacagaagaggaagcgaagtctcagagagggagcagcactctttggcagcacagggagtgaggggcagcgagggaggagggtccagggcagagtgaagtggccacacctgctctgtcccttggctggaaacagcctaatggtccagacgaccccctgggctatgggagctcaaatcacttcccgccagaaggcttctctgacccctcacctccagcccagggagatgcccctgcctgtcccctgggctccgcggcccctgggcttcctgctcccctggcactgggcacactggaatgcaaataaccaccgacccttgaatgtccccaccagcatggtgcctggcgtgtagtggatacggccgggatgcaggtgcttgagccatgccatcaggaatctctcccatcatctcagtcctgccttcccttctatggccccctgcagtccccactaaccccagcttgccctgcagctccaacagaatgggagtgcatccccaactatcagcccggccacagtcccggggctccctgtccttggactgccaggggtcaggtgccagtgtgtgagccagtatctgtggctggatgcaaggagatgaggctcccctaggctagaccccagtgctctggccacagctgcatgcggggtgggggcagcctaccagaaagggcaagactggaagtggggaggtgccccacaggaaaaccgggattctaccaagggcaggaggctgggcaggcggaaaccagcaccatccactccagcccacctgccctcctgacctcccacaatggctgctctgatgaccagaaggttcctcagaagccagttaaatctgtttctcctaccccacacacctggctctgcctcttcctttgttcccttggtggtcctgaaaggctggctggctgctgtcacgttccccaccaaccaccccaaaccccactcccctgccctcggggtatccctggtcccccccaccttctcatatgtgcagtcttcatgtcgtggattccagaccccggccctgctggctgcctgcccagccaagaacacctgccgtggacacctccccacgcctgggccaccacctgcccagtcctcatcacccgccatccaaaaagtcactctggtgttgaagactcatctaaacctggaccccaaaatgctactggcatttagtcactattccacaggcccgttctgattatttgttattttattttatttgaggcagggtcttgctctgtcacccaggctggagtgcaatggtgcaatcactagctcactgcagccttgattttctgggctcagatgatcctcccacctcagcctcccaagtagctgggaccacaggcacacaccaccatgcccagctaatttttttattttttggtagagacagggtctccctatgttgcccaggctgcgtgattttaaaaacataaatatctccaaattatctgaccctcctagagatgaaatctccctgtggccgctgttcttttttttttttttttttttgagatggagtctctccatgctgcccaggctgagcttgaactcctggcctcaagctatcctcctgcctcagcctcccaaaatgctgtgactacaggtgtgagacatggcaccaagcctgtggccactttttctttattttcacatgagataaagacaccacctgagaaagtatttgagtgtgtgtgtgtgtgtgtgtgtgtgtgtgtagctggggtatggagtcacatgtgcgtgtgggaaacaagcctgaagggttgctttggcacatcacctctgggtcttgccattgcagtgatttatttgcttttctgtattttctaccttaacatgtaattttggggaaattaaaaaatcaatttaagaaacttaatggataaacaaaagacagtcaatactggaaaaggcacaaatcatgaaggtaaacccataggcatggatgtgaatctcagcagtgtgtggtcttgggcaagtggcttgtgcctttgcctctctgaggcctggtttctcacccccccaaaatgggggattatatagtaaatggcaaaagtggctgtaatctttgccacttctcccatcaaaagatagagtttgttttccctccccctgaatctaggctgcccttgtaagttgttttggttagtgaaatgcaggagaagggatggtgtgcttgttccaagtggacctcaagggccttgcagcttctactcactctcttggaaccccgcccagctgccatgagaacagcctgggctagcccactggaggatgagagcccacacagaactaagacaagctatctcagttgaccccattctgagccagccagctggccccagcagacctggaagttgacctctgacaactgagtgagcccagctaccagaagaactgcccagctgagcacagccattagaaataaatagtttgggctgggtgcagtggctcacacctgtaatcccagcactctgggaggccaaggtgggtggatcatgaggtcaggagatcaagaccatcctgtgaatggtgaaaccccatctctactaaaattaaaaatacaaaaaaaaaaattagccgggtgtggtagtgggcacctgtagtcccagctactcaggaggctgaggcgggaatggtgtgaacccgggaggcagagcttgcagctagccgagatcatgccactgcactccagcctgggcgacagagcaagactccttctcaaaaataaataaataaataaaataaacagtttgggggtagtttgttatgtagctaacaacagctgacaaacacactaaacatgcccctaacttatgacctttgcccttgctctttgctctgcctgaaaccccactccctgcaaactccatgggccttttctctctcactgccttcaggtctctgctcagtgaggtctcccctggccagtccatataaaaagcccctctcccatcactctccttcgtatatatcttgccatagcacttaccacctcgcttctttatgtatttacttgcttatttgtttattgtctctcttcccccaacacacacaccatggaatatgagtgtcatgggggcaaggagattctctattttgtctaccactattagcgcccagcacctggtaggggttcagatatttgtggaataaacaagttcatcttttgccttaggggctcccatccagctggccacagcgctctcactaagaagacgtattctgggcacctcccagctgcccgcctggctctgggccctcaatccctgaatgacagtggtcactgcacttgaataaccctctagagtgtaaagggacttcctcctttcctgcaacccactaatggggtctgcagaccccactctccagccctgtttctcaggtgagataactgaggcggagagactagtgcaggtgtagggacacaggtatcttgtggcacatcttgcctggtgctccctcaggccattggacagaggcacctcctcccaccaccaagagctgggccaggcatcagggatccctggtctgagccttttcttctcctaacttgcattgagacctgaacagtccctaacagggagacaaaaaaaacttctcaacagtgagaagcctctgacaatcccagcacctcattaaatagactttcatcatttcatgcaaagctaccaaaggaaagaaaacatcaggggctgttagaccttggccaggggtcccctcaactctcagagcgtcaggaaggctgaggaagaggggtgagggggagggtcccccgcagcctctggctggcctcacccagccatctcccatggcacctcctgccctggtcagaagccctcctgccctcctgggcactcaggggaaatcctctgcaacttgggatgaaaaccacagagcaagagtccctggaattcacgtgtgactgcttggtaatgttgccttagcccagctttccccaagagctgacccaaaaggaagattcaagcagaagcattttgtggggggatggccccaggaagccccagtaggagtgtgtgctaactctgggcattcccagcttggtggagtgtgcccctgccatcaggggtgcccttgagaagagaggcaggcaggtcctgatgtaggatgccactgggtgtgcaggaaggaactgcaggtgactttgggggtccagggccctgaggaaaactgagaacagcactgctgatcccaggggaggggatggagagcaaagggtgactctagggaggcatttcagcagaggagacccatgagaaggggaggaccctccatcttcaggctgggtattgaattttccaagcccacctggctaacgactttgcccccagaggcacttgagcaaagggccagccccagccagagccaggagagcaggctctgcactgccgcaggagagctgctagcccagcctggctacaccatggaagcccaaagacaggagctcttttacagaaatgaaacccctagaattagtccccagaccaatggctctgcatgcaaaggcacagacagcatagactgaaagtctactgtgtgcatagctgcagccaggagatgggcaggggcccataagagaacaccaaggtcatgttcattaagcattcactgaggctgtgcatggcctacctcagcgctcacagcccctcctcctagtggcaactacgactctcccctgagataggaccggtattccaaacacctctccggggcaggcaggggtggcagccccttcactaactggactctccttttgtgctcagagtaacccccctcccattttaccaacgtggaaagggatgagcttcaggagcttggccatggtcaccggtgccagggagtgagacagaggcagaaccctgggaggcctgggtgattcaaacacatcacagagtctttaccctaagggagctgcaatccagccggggaaataagaccccgaggaaaatgagcaagagcagttaaaccgcaacataaggcaataatacaaggaggctaccacccagagccggacattccacacccagcagtcggcctcgccgcctcccgcccgcttcttcttgtaagggcctttctcaagaagtggctaaaaagggacttaggatagcacttggcggacaaaaggggttgttggcccctgctctaaaacatttgccaacacatcttcccatcccctagggctttaagaatgatccccacccttagctagtcagtggctgcaaagcagcccctttcattaagccagggaggggggtccagtggaaactgagcccccgatctttgggaaactgctgaggaggctataaaattagagagaaggacgagcaaattacagagagggagtgggcaggcagcagggcctttcatcagcctgattagctaaggaaagaggcccagccatgggggaggaaggccaggggaggtcgccggctacctcctgggggattgagggcccctccaaagttcaggggcctcagcccaggcttctgccttcaggtcaaacctgtccttgcacagtagggggaggacccaacattttaccgggatgcaccatttctcaccctctgactctggggcctggctgaatctcctggagtctcattctcctcatctgtaaaacagccccggctcacaggatgtaactgtgactgaactaaacaagtggttggttctcaaccctagctgtacatcaggaccaccaggtgaagacatgttaaacctccaatacttaggctgtaccctgtactattgatatcagaatctttggtggggggtggggagggttgggtgggaacatcccaagcacagggacaactggaacagagggcctgcgcaggagagcctggggtgtcctggaacaggtgtggctggatggggatgaaggagagggatggcacaggagggaagttcacagaggtcaggggagctcagctacacttgcagatcacaaaccaccccacatttcatgcaggaaacaaccacaataaaaccaccaccattttattgtgcttgggcttctgggaggctagagtctggacaggccttagtgggaatgactcgtctctgttacataacatctggggcttcagctaggaagatgtgagtgtcttgcgggggcaactgtctaatacagtagcccctaggctcatgtgactatttaaacagaaattaattaaaattaagcaaaataaaaacttagcttcctcaattgcaccagccacattccaggtgcttaatagagaagtgccagacttggctgggcgcagtggctcacgcctgcaatcccagcactttgggaggccgaggtgagaggaacccttgagctcaggagttcgagaccagcctgggcaatacaggtagaccctgtctctgtaaaaaataaaaaattaaaataatttttacaaaagagagaattgccatacttggcagataaaaatacaggacacccagtgaaatccgaattttaaataatcaacaaatttttttttagaataactatgttccaaatattgcatggtatgtattacactatattatttgttgtatggaattcaaatttggcagtgttccatgttttatctaaatcccagctaacatgtggctaacgaccactaggctggacggcacagataccgaacattcccgtcacacagaaagtccttatgaacactgctgctctggagaggtcttcactcacctgtctgcttcctgggctgggaggacgtgaagacggggcttcactggaatgtgggacctctgtatctggcgtgggtcctcacggatggcaaccacattccaagagagtggcccaagagcaaggcttcctccgctctgtacctggaggttacccgccagcgtcacttctgtcctgttctggtgggttacacatgtgccattccagccaacccaggttcaagaggagggggatccgattccttctgatgggaaagctgcaagatcacattacagaagagtatacgggactggaaatattgttggaaaatacaacgttggagttggggacatcaaatcacgtagggctttgtagttgttggaaggactggggctttgagtcaaacagggagtcatgaagggtatttgcagagtagggtcacaatctgactcatgtgcgaagaagattcctttggctgttgcaagtgaataaaacgtagggggtgaaggcagagtctgggagtttccttaggttgtacctagccctaaactaaactgaaatcagaccccagcctagtacttggtggtggagttggcatgacgatcccagcttctggaccctatttccctcttccctgcaacaaggacccttgcaagtagcccctcccctcacaccagcttcacctcttgcccccaattctgaggcgagtcacatctggtcagtttcactcccccgccccctcctatggcgacaagtgctttaacagacagtgcaaaaggggtcaaaagcactgcagacatgaaccagactttagaaaaacacatagcgcgagccctgttgggattcgcagcaggcgtttccaatgtttttctcgagactgcaggcttgggatttcctgtcttctgaggcattcgctgagcaggccaagatcagcttcataggaaggcaggaatggggcttcctacattgctgtctgcaggctctctctggctcctttcctctcctccccttagggtcttttttgtgtattctttctcctacttctgacactttttctgcccccagataaatgtccagccacctgcctcccaacaggactgaatcacgggatcatgatacaatcaacaaatccaaggagctgagaggccccgggagctgcagctgcatccagctggaatcttgaaggctggctctagctacgggtttccaccctcatgcgaagtgtgccaactgcttcgcagaaacctcctaacttcagcagggcagagcaatgggaagctatgtcaagaattgctatgggtatccggcctgatttaggggtaactgatacacagcctaacaccgcacagcaccgttcttattaactgttccttgactttgccctgtcttaggttgaccgtccagagcatgggtcatcccctccctgtctttttgcaatgtagagaggatggggtaaacaacaaacacatgacctccattccctctccaaaccccatcagaacaactggaaaggatctgcaatgtaacagttaaaaagtaaggccgttcataaacagttcctgaaacccaagcagctggccagtctcctgctccatttccttgcagcaagtttcagtggaaactctataccccaaacccccaaatccctaccctttgactgatgcgaaaaatccccccaaacaggcctttgttcctttagctgaggacacaccaaatgtattaatgaacgtggataagagctggaaggcaactatcagaagtggctgtggactaggattacaggctgttattttcctggcctgaatattacaggtcccacaacttaagaagctttaaaggaggtttgtaaagcatgtattaaaaaataaggcaggcccagttgggcagtggctcatgcctgtaatcccgttttgggaggctgagatgggaggactgtttgaggccaggagttcaagaccacccagggcaatataacaagacccgtctctacaaagatttttttaaaaaaattactcaggcatggtggcgtgtgcctgtaatcccagttacttgggaggctgaggtgggaggatggcttcagcccaggagctggaggctgtcatgagccatgaccgcaccactgcactccagcctgggcaacagtgagaccctgtctcagaaacaaccaaccaaccaaaaaaaagaaaggctcaattaaaaattaaaatcctcccaaacagctacctaaaccattcacaacttctagctaatgaagactttggttgggtggggtggttgctgaaggcagggaagaggctgggaggctcagggcctctgtgcttgtctgcagggggccctcacctcttcctcatgggaagcaggccgtggaaggacaaagatgcaaaagagctgttttggggcctcaggaaaactcctccatggatctccacggagagagagaaccaacagcagaaaacctccagaatccaaccccaatgctggcatcctgaatcgttttttgtaaacaattcctattcggataggaaaaaaatctagaaacatttaataacttattcttgagatgtggtattttactgttattttgttttacaagatgtggggacttcattaaatccctacatgtattaaagttagaaataaacattaaaaccaaaaaagtcaatggttttgaatggtgacaaaccaaacctccaataagaaatcactgtgggcagctcacccacgcaaggggcaccttgtgtatgtgcgaggagtggatggggaagggcgtcccctggaccttgcagacccagctgtgtctaaaggacataactgatcactgcccaaatgttgtccaccacccccaacttccttccagacacatcacatggcctggctgtgaacccccatcaacatcacaactgttttgacaccaggctcagatggggagttctcgaacagcatggcctcagcaatggaggttgtgtcttgggtaaccagaaacctgaagcccgcaggaatcctggaggggactgctggtctgggaaaacaccattcagaactacttaactctcaagtagcctgacatttctcttcctgctaccttagctataagctgataatctgagcagctctgcggggataccaggctcctgctcagctgtgggtgggcaggtggctgtgctgggtcgcccctgccgcctacaggcagaaagcggatggtgcaaggtttccttccaaacggaaatcgcccttcacagagctgagcctgggaattaccacaaagaaacctcacaaagaaaaggtgcgcaaggcaaatgttcagaaaacagacccctaaaccctgagatggcacaagtgaatgtgttgggtggtgaactggccaaatgcttgtgctctgtcaccacaaacgaccccagtggtctgacatgacctcaacggcttcacagaccaggggtgtgctttccttcctcgtgacaatctcctaattttgcttttcagagtgggggagggcggggagaggggaggtggatggcagttgtccctgttgtctagtctggagtacagtggtgtgattttaacttactacagccttgaactcctgggcacaagcagtcctcccaccacctcagccctccaggtgtatgccaccactgtaggttagcattttttgtagacacggttgcgctgtttctcaggctggatcctagcttttaatgaaatcgtatgacatgtgaactgtgcagttttgcgtgtgccacgaggcaactttctcagccgtgccttgggcaagtcacagcctttttggcctggatgccttaaggcagcccatctgaaaccacttcccattcccatttctagaaaccttcaagggttccctatgaattgtgcacccacatgggttttcctggaggatcactagttctcagaaccatacaagcacacagcaaaagcctctccacacatcaccctgaagtgacccaaattcccatttctcaatgtgggacctatgctctcctgcactccagcaagatagctgtggattcccacctgatgctgttcctcctgctgccaagtgcctgcctgcctttccaggtctcagcacaccacacaggtcgcagtcagcatctaaacccatccccccaccccagaccactatgaatgcaccctcacatacaggtaaaggtagcaactcactaggtgactgacagaaggggaaaggtgactacatccctgacccagagtgcctcaaatttcctaagtgactgtcaggtgcaatttaatgaaaagccttggaacaaatacagcaggtaaaacatctacaatcataccatccatgaaggctgtattagagattgctggcataaaactaatttgaggggcctctgaagtgctgactccagctcacagatcagtcagctgagagaggcagcctagatcacttggtgagcagcagacccagcactcaagattcatgcctctgctgtccatttgacaaggtttagtctcaagaaaatgcaccaaggccccgaggccaacagccagagctccaccaatcagggctgatcacactggtgctcaagcactgcggcccaggaacctgactgcaggagtgctggctctacactaacagaatgctgggcgtgtgtgggtggctgctgtggacattatgggggagatgggtaggaaggacagatttggttaggagcccagactgaagttacaactgccaagtttaaattcactcattttgtgcaccgtttcccaagtatgtactgtgaaggtagaaggcactgtggccgcctgtaaatagctggggaggcaagacacgaagaccagataaatgttaagaaacatgctccctgtatgtattgaaatcagttctgcaaccctcataccagttggctgtaacagatgctaaatgtggtgggtaaaatgtttttagtctcatggtcttaccatgaattacttattagaaaggtaaaggagattaccaccctaagtgctcagtcatcaacaaaggaatagacacacaactcctgaagacatgtcattggcaccagggagtggtttcgtggaagacaatttttccatggacaaggtggggtgtggaaagggatggcttccagatgaaaccattccacatcagatcatcaggcatttgattctcctaaggagcgcacaacctagacctgttgcatgcccagttcacaatactgggtttgcactcctatgagaatctaatgctgctgctaatctgacaggaggcgaacctcaggcggcaatgctggctcacctcttcctaacaagccatggacctgagactggggaccactgccctatggtaaaggccctggccaaaatgcaaacctccatcaggtcaggagcaaacagacaaacccacatttagagaccatctaaaaaaggcctggagtacttaagaatgtcaagactaggacaaatttcccctgaccgcccccaggactctgggcagaacctgaaaaccctgtaaccacagccaaaccctagcaccacctgcactcctgggacacactctggttgtagtttccacgaaaacaggccgtacattagtagcacgattattttattatatgctttataaaaaaacaaacacccaaagacatacaacacaccgccctcaccccccagcggccattagggagggggcttatacttttcctaatgtagatctggccatcttataaagcagaccacattatttgtttccatatatacctgtagatatttctctcccctcaaatatttatatctcgactaaaaaaaggaggtgcaaagagtatataaagataaatgagattttcttgctgttgttatagtacaaacaccagatgactaccagtggagtaacagggcaaaacaaaaacacaaaccccaccttcagtgaggaatggaaggtctgttaccgacctcaagtagctgaatcacctgctgtaactggcacctccctgacaatcatgggtttgtagggacatgggccaggtgatggcttctacttgtttccagaaggctaatgtgtcctacaccctttcttagtaactaaagacgaactacgggagaacccagtatttggattctgcccagaggtattaaatgcacaaggaaaaattagttatgtccaagtagcaagcaataatatttttaaaccaacatggttaaatgttaagatttgtagaaatcaaaatatttattcacataattttaaactaaagttgaagctaatatatcttccgtggtaatgatttaagtgcaagtgatgcttggctttctttcacattcatttcttttcttctgagtgaaggcatatcagttattcttgaacaagtcaatacagctctgcaaaagggagacattgttctgtggggaaaaaaggcaaggcagaccagtgaattattaaaacttgccatatacctggaatgactcaagtacaccaacacggcttttcacgggaggtttaaagtcagccagagcaagctggcccttctcttcatcaaatcccaggtgaactgcaacgtaccacgcatccccatttcatgtttcagctcctctccctcagtgggtaaggctaccagccaaagagccgacgttcactccagcacctctgccctcacctgcttgctcctaaatgtgatcctgcttactgtaacttcttaagacactatcagtgcgttgttccatgaaggcaagggccttggaaagattgaataaaagttgctagaaattagggctgggagctttagctcacacctgtaatcccagcactttgggaggccaaggcaggtggatcacctgaggtcaggggttcaagtccagcctggccaaaatggtgaaaccccatctctattaaaaaaaaaaaaaaaaagttgctaaaaattagtcatgggtgacattataaacaagactacaaataaacaatgagtggctcccatcaactaagtactacagacgattaataccacaaggccaccccaactgcctgatgacaatgggttagtaaactgggaaataacttggaaaaaaccataaaagatgttggcttcatctgtagaaaacacttaccctggcatgttttatttccagttcagacatttcaattagattctttctaaatgctgccactctcttccgtttgaaatttatcagttctacaggaagaaaaaatgtttatgaaaccaagaaaaactaaacaattttcatgttcactttaactaccaaatggcattcttacaaatggtctccaatgctttcaggcaccagcattatttcctcacatttgtattatctctgtgactgggacacatcagacatctattaactgtggtgatacagctatcactgtctttaagtggaaaacatcactgaatcaccaagcatcgtgagtgggagagcagcagcttatgacttggagaacacgttgatgagcagcctcactctcaccctctaggtaccagtgactgggaacagggctggagtatgggtggtggtgagccacatacttcaccaatggcttgtgaaaatgcttctcaaaagaagacataccaggttcatgcaaacaacgttcagcagcactagccattagggaaatgcaaattaaaaccacaatgagattacctcacacctgctagaatgcattttctcaaatagatgaaagatcagtgttagcaacaatgcagagaaaagtgaactcttctacaccgttgctgggaatgtaaattagtacagccaccatggaaaatggtatagaggttcctcaaaaaactaaaaatagaattaccatatgatccagcaaacccacttctgggaatataaaaggaactgaaatcagtatctcaatgggatatccgtacttccatgttcactgcagcattatttacaatagccaaaatacaaaatcaattgagaattatccatcagtggatgaagacaatgtagtatagatacattatactatccggccttttaaaataacaaaattctctcatatgggacaatgtggatggatcttagaggacattatgccaaataaaataaaccaggcacagaaagacaaacattacatgatctcacttacaggtaaaatcttaagttgaactcctagaagtagagaacagaatgatggttatcagaggatgagggtggggtgctggggaaggtgggaaagagaatgggtagaaggctgcagctaaactcaaggaataaattttgagatctactgcacaacagggtgactacagtcaataatatatattgaaacagcaaatttcaaatgtattaccactgaaaaaaatgaaagatgttaattagcttgatctaataatttcacattatgtacctgcaaagcatcacactgtattccacaaatgcaatacaatgacttgtcgattaaaaataaaacttaaaacatttttaaatccaaaacagtgaaaaactgctacacgtattcaagacaggtttacttgatgatctttagggcatgcttccttttcatctactcctttttctttttttttcttgagacggaatcttgctctgttgcccaggctggagtgcagtggcgggatctcggctcactgcaagctctgactcctgggttcacgccattctcctgcctcagcctcccgagtagctgggactacaggcgcccgccaccacacccggctaattttttgtatttttagtagagacggggtttccctgtgttagccaggatggtctcgatctcctgacctcgtgatccgcccgcctcagcctcccaaagtgctgggattacaggcgtgagccactgcacccagccctttttcatttcatctactcctattgccatcagaattcggcattaatgacccattggaaattggaacaaaccaagaatatgcatgtccgccctaattccttcattgaatttgtgacatcaagttctgtcttgcagttttacttgactaaaactttgaccatcacccaaccttctgctggtgctcaagtgttcagagcagactcaccctccttcctgtctctacagtgctgtgcaaaagaactacaatacaagcagccacatccaagttaaaaagtcacaaatttcatagtgatatgtcaagtctatagtgcttgcactacaaggtgatgtttatcagtcccttggatatcctgggtgaagataagctccctgccttcctctagacctacacacagtaccagggctccatacacttaactattcacctcctgtgaaaccagcccttacccactgactcaactctagtcgtcagctcagctgcaagtctcagaaagcacttataccaaaggcaaacaggttaagacccaccaatctcagcattccacagaatactgtatttttagatagtgtacctatctggcattttgaatataggatataatcaatgtgggcgaaaactttaggcagtaaaggtagacctgaattggcatcattttttaaagttttatgttttttcttcaatctcctctaaaatttccagagccatgaaactggcctataagatttcaactcagtagttttgaagtgtgtacgtttccttgaaaattttagttttaaaaaaaaaaaaaaagctgtaattgtttcagaaacagggtagcatgaaggttactttggaagaacccaacacagcctcagagcctgtctacatgacatttgccaggaagctctgtgcctttgtgccttacagttaaggcattgtattataatcctgaatagacagacaaatgattagaaatctataaagtctaggtttcccccaggtagcttcaaacatgttgatgaacacatcatttccctatgtctagattaccctaccactgggaaacaagaaagttaggaaaaaactaagtaagatatgaatttttcatggaaacacgcgttagggggttgggattgagtccaacagtgccccactacaactactcacattctgggtaatccattccaacatttgctctgacatgttccatggcccctgagaaccccagagaagatccacagaatcctcttaggtaaggactacatattatactcatgttcaatagaaatggtgaaagtcctctgctctaagaggtgaaatggataaggcaagaaagaaccctatggatgtggacatggaccggacttgtgatccctgaaacctgcatgtgtgtgcaacggcatatgtgtgcacacacacatacatttcctagctcagtccactgaagggcacagaagcagagataccccgaaacgatgagcatactcagatgctggtaactgttcccaaagaaaaagaaccctggctccttgaaaaaatggccagtttcaaggctggagcagagagtaagattagcatggcctatcactctaaaaaagacgggttaggctgttacaaccacatgccagcttaaaggtgctcctattggcaaagtctggacaggcatcaaaaataacttggtaatacaataatgaattctaaaccattttaaaaactgggagtccatgactctaataaagataaaggaaatttctgagaaaagggaaggcttttttgtagtaggatgacaagtgccaacttgggtaggaaagctagagctagagatgagggaaatcgtctttctgcaatcgtcagagtaacagctggtttaggcaagaatcattaatacatgctaaacctagggaggaagtttgatgaagaccaaggtatttgcatggtcttaaattgcctcaccacagattgatgggggttaaaatagtaactacacagtggagaaactggatttggatactatctaattgagtaatcaaaattaccaccacgaatgaaggagagacacactgtccaatcagaagtgacaccccaataagggcatattacttctattctgccaggagcccataaccagatctaaacatgaggaaacctaccaaaagtcagaaatacaggatttgtaaagagattctctaaaaagactgatactgttaaaaactaagaactattccagagtaaaggagactaatagctaagacaaccagatgcaatcctagactggatcttgtagaggacatcaagacaaacatgaaaatacagagagcagattgtagacccaaagttaagtttatcacagcaaacaaccatactgtaaccatacaagagaatgtcttcagtcttaggaaataaaccacaacgtttttagggctaaaagaagcatgacatatgcaacttaatctccaatggtacagaaaaaccaggtgtgtaacgtttgtaagcacgcaaagccatgaggatgactgtgcatgtgcaagtgataaggcagaggggtgaagtgctgacactgggtgaaggatacatgggtgttttttgcactatttgtagaacttttctaagtttgaaattattttcaaattacagtacagaaagaagaatgtcctgctcaaccttcttttgcagattcggaaagttgttcaaatttctggcagcactcctgctggtgtgcctcagccaacttgacgtctttgctctttaaccgggccttatccagagctttgtttgagttctcatagtcaatgagggctttggtgcgtctgtataagagatcctgggaaaaaaattaacaggtatacatactaagtatctaaaccagtctaaaaaatagcccaagtgccaatgtaccacctgagatgttagtggcaataatctacctctacaccttccctctcccagagtatttttaaatctccagcttcgcagggatgagcaatgctgatagctttgttgagagctttttttagaattccttatatgaatcaagtgattactcaagagtgaaaacagaaggacttttgttttccagtaattcagtaaataaagttaactttaaaaattaaatattgtgtatcagagataacttgaaatatacagtcactgctgggtaagtcaagttgagcgctgctaaaatacaactgggcaatgaagtagtaagaaacataaccctaccctgcaaatcctgcttctggtaatctaccttggagatccacttagtcagatataaagattctttgcaatcttacaacagagtagaagttactttagtatctgaaatgagcaattatgatgtatagattacacatttaaaactaggtgaaataataactgatgggtgaaactactaggcctatttttgtatatactcaaataatcgtaagtgagctcttaattccatgaaagtagaaaataggctattaaaaaagtatgtttttaaaaactcccaagattcagaaaacatgccaaagggcaaattaactaaaataaaattgcatgatggggggaaaaattttttttactcttttactttctgatgacatttcagccttagagggcatacaatcctatctaattttattttgcctgatttaatacatttcacataaaattaaaacatatttgttcagggcaatgcagacaaagcatgtttcattcccaaaggttattctgcttaccattttgtccacatatacatataacgcttcacggctcaaaggctgcagggatacttgcaattcaataaaaactcccaaatcttctttgccccagaaacagccctttctgcatgttatgtcccacatcaatgacctataatcccccaaactattacctgtctacttcacacaacccatacagtgctgtcagatacacaagctttatggatacaatgccagaaaggcatgtcatttataaaaacaagtctgataaattcttattctgctcctttgtataaagaaactttttaaacagacttctggtcctgcactgctctgagaagctgagcaactctcttcctaccttagcagcttcaatgttgagcatgtagtatcggaggagctctgttagcttcaaatcttcatctgatgaaactcgaccctctactttctatatagaaaaggaaaggtcaccatcaaggcagaaagctatagattataaaatatatattatgaagaccaacacagaaatccttacccttagtttttcaaatagctcagcaaccttcaataggtacctggaaatgtacatataattttggtttaaggtcttaaatcatctataaaacatgatcttaccagtgtgcaagacaggaatgggtcaactcaggagtcctagcctttggtactttagcattaatttaaaagtagtgctctcacttcaactgaccccaaatagtagagaaaatggtcacaaaattacacacatgtacagcaccacactcagcctcttggtgacccttcggtcatcctgccatgcgcccaaatattcttattaaatgccaatgctgtgtaaaccaaggttggtttctaatgagctatgctatgggcatcacaaagcagtaaatatgctatttaattcgtcatggttctgccattagcctttcaatttcgagtcagaagtagtatcacctgttttgccaagcctggatgttaagtaaaatattgtcttacaccagaaatgcccaggatggagaaactgaaacacatacataagtgcagagtgaaaatggaagggtttttaattaatgaatgaaggtaatttcagaaaattgtacatcaaaacagctgtgtgttagactggggtcattaaattattctcatgaccactataaccaaatctcttcaaggtccagggcaggggcacatgttctcaggatctcctgaggctgcatcacaggccaaaaaaaaagaaggtctagggcattaccaggcaaaattgcaagcaccaattgccaggggaagatgcaagataaactcttacaaactccaaaactaaagaaaacaggcttttaagtgtgacagaaactactgctttgacaacatttactgtatttgtttacatatagaagagcccaagtcccctacaattgtcttacaagtgtcttatgtccagagaacatgtaagatgagtgctagagacttgtcttactgagcttgtaactccagagcaggaccatgtagtcactactcatttatgcttttaattacaccactcggcactcttcaattgggttaggggaaatgcttttccaaaaaaacttactttttgatgactgtgggctcttctaaagccaggctatgtaagcaggctgcggtgtggatatagtcatcggcaacatctgcagaaacaaggacaagtctttttatccaaacacagccaggctcatcagcaaagctctgactagcggtaaatgatatttacttttatgagatctggtcattttgtcagctttcacacaagaatctttgatcctattgtaatagttaataaggaagttcttctcttgctcaaagaagtcatctacctcctagaaggaagaaaaaaagaaccagacatttcatgaaatatactatccctgcagccttttacatttatcaatataaaaatatattgcttagaacatggcatataaacgtgagtaaagtttaacctctacagatcagggaattacaaatttacgatactatttcttaaccaaggctgggaaaaatcaagggctggcagaaaatgtctacagaagaatcacttaacaaccaccagtaaaactggcaccctaagacacagcaattttacgctagtacaatggttctaccaggtggaacatggccacttagccttggatacctatctgtgtgtgaatgaggtttttttttctcgattggtttcagactgggaggaaatcctggtatctggtaggcattggccaaggatgccaatgccaaatatcccataatgcatggatacaggacagtcccatacaccttaaactggaccaagtccgagtttcctaatttctgatgatgccctctctacttagcacctgtattctgggctccctggagtggcaaagccagataccagacagtaattgtaagggtaactcagttacaaaggaatgagaaggcccgagaagtagtaaagtaaatcatacctctaacggtaacggaaacgttattttgtattcttgtctttgtgctaacgccttgaaatccagtatgtaaataaaatctaaagtttggttccttagttgtgccagctaggttgcatgtcaagtgcttctctatcacctgtagttggtgaccaaactggacagtgtagttctgagagtgggataaaatactgatcttgtactttattttagaaattaactgagtaatctccctccttacagaaaaggagaaaatgaagccaagtgtggaaaggttcaagttgcttctcctgggacagaacaaggtgctctgggaaataagtgaaaattgaataagtagatgaaaattaccaaaatctgaagaacacttacatgtcttaaaagttaaccatttgtttcacaagtatctctttcaaagaaacaaaaggtcacctattcccgatgaagtaaaaaattttctccaacagccaaaggtcacttaccttaactccagtaaaaaggacttcatcagcacttttcaccacacttttgaagaagccaccaaacatctctttagtatttttccgcctaacacttagctaaaagaagaaaattccaaagagtttatatggtatggatttttctagattctcttaaagaagttctgagtaacattttaagtaatcctctttatcagtacaggcaaatgcataaagtatctttaattctgccttaacctccaagcttaaaacacctaatggctaaacccaaacataggtaggtcatctcattctaaaaggcttgacagattttgaaagactgactagaagctaagtcttagtggctctgaaatccttgggaaaattactgttctcttctatccatattaagtagcaaaaaccaaaacatgttaaaaagaaaaatagcataaaagtcataattcgcggccgggcgcagtggctcacgcctgtaatcccagcactttgggaggccaaggcgggcggatcacgaggtcaggagatcgagaccatcttggctaacgcggtgaaaccccatctctactaaaaatacaaaaaataagccgggtgtggtggtgggcacctgtaatcctagctactcgggaggctgaggcaggagaatggcgtgaacccagaaggtggagcttgcagtaagccgagatcgcgccactgcactccagcctggatgacagagcgagattctgcctcaaaaaagaaaagaaaaaagtcataattcaacaaaaagcgtaggtgggaagaaaataaattacacaaattttaatttccttaaaatgaacttagttaagtttggaattgttaagaaattaactaagggatgtttgggactgttaatttcttaaaaagaaacctaggttttggaaggggaaagaagtcaaaattttctttaagcagagttttacaaaaaatgacttacaatgaaggaaaagcagcatctaaaaaggtttccattgtgtaagaaattcaaaactttaaagcagtagaaactatcaagtacattttgaaagtataaacatttgaagtggattatcaaaatggaataaaaatgccttacatcctgatcatattccaggaaaacatgaaagttgcgatctttactgagaacagggtgagaagaaagccgctgaagaaagacttcatgggaggacacagtcttcttaaacacagcgagatactcactgaaaagagatgtgcacatggcattcagttgacacagctcaactacctgaccaataccactcctgattaattctatggccctgctcatgccaccacataaaacactgcaactggaccaaacagtatttcagtataaactggtgtctagttagatactaaggcagttgccatttttgaatctgtggaataagactatggaggaaagcaatgttgtaactggatttgatgggtcaagtccatgagctcctaaatctacatgcaattactgttacttagtagccacagaacatttgtttctttaaagcaatgagaaccctttaactgcagcctaagtatacagcatgagtctaatgaagctaaaagttaacaaaaattacaaagcagctttatctcaacctagacattaaaagtcaccttaaaattcctaacggtagaaacttggatctgttgtgttcagtgcctcattccccagagctggtcccgagagccactcaagtgtgtgctaaatgctttcagggcctggaggtttgagtgctgccctagatgacacaggggtttggagagggggagctgatggttgaagaggggaggaatgagtacttttcagctaagatgaggaaatgcaaggatggattcataagaaactttccaaaaatctatttttgtttgaaaaaattaaatgacaaccagattaaaatatacttgctgcctgtagacctggacttcctctttcaaattatctatgtgatggttactgagaatgctactctataacagcactatttggcctggcccaggggcagctcactataatctcagcactatgggaggcaaaagcaagctgatcacttgaactcaggagttcgagaccagccggggcaacacatgacgaaacccccaactctctagtttcttctcaacgtctagtaaccaagcttccgaaagaaaagctttgtacattatgagcaatttataaaggcacaaaagtttatttcctcactgtgccagaccagcatccttaataagtatgccctacatatgggaaaagacaactactctatcgggtattagtgtcaatggcctccaatgaatcaatgtgtgaagtacaaagaccatgtcccacactatgcaagatgtattactagttttagaaaacgacgctagggacctaattaaacagctgcacttaaaacaaaattaagtcaggttcttctacttatttttgtacacagcaccacttttctacttctcaaaagacagagcccaccaggaaaatccacttacgcttccagttcttgtttcatcttggcaaattcttctttggtcatagacccttcaccttctcccagtttctgcatcttctctcgaggaccatcaaagtcgggcttcgtaggagcaggtggaatctgcagcagaggcaggaactcatgagcctcttgtcccagcagcgatgttttctagttggtgcctcattctactcttgctggtccacaggagacaaccactccactcctgtggggctatttaaaagtcaactcctgttttttcttaaccttccttaactcttctggacatttaaaatgaggtgtcttcctgagagttgcatattcactttgatggcaatcatttgttcagtttatccattatagacaattgttcagagcacaacagtgtctatactgcttcagtgttcgcctaaaactagtacaacgaatgctaagcaccaaagatgagccatcaagattataaagtgttcagtattccaaaggaattttttcctaatcccaaaggataatcaaggactctaattttgaatgaaagacatatctaaatataagcttcggtattaattttgtttaatgattaagcaatcatcatttggagagcttcttcagtctgcctggcaggacaaaacgcgtggaaatctcctttaaaatcagttaagtctgttcctgccgccaagaaataacaatcaagggctgaaaactgcctccttgagcactttttttgtttttgggagaaagagtctcgctctgtcacccaggctggagtgacgtggcacggcctcggcttactgcaacctctgcctctcaagttcaagcgattctcatgcctcagcctccccagtggctgggactacaggtacgcaccaccacgcccagcaaattttttgtatttttagtagagacagggtctcatcatgttgcccaggcacgtcttaaaattctgagctcaggtgatccacccaccttggcctcccaaagtgctaggattaaaggcatggcctccttcagcaacttttgagaaatcttatcacaaactattaccaatagcagtgtttcctagaaatcaattctactgacataggaaaaaacataccagagaaaaaccaaacctaaaggtaggtaagactaaagtcattacactgttcacacccctttacaatgtaaataatgtaagcctgtatgcaccacctcaaagctgtaacactattccttcacatactttccacttgacagtcagcaaatactccagtaggtagatgaaatctaacttttcacaatccattaaaaaaagtggatataagtctcttttaaactaatgcatagcaaggcagaaagaactagcttatttgattttctaaaagactcacaataagcccagcatagtctgttgtttcaataagagtgtcatgtagccacacaaagtcttcatgttgccttgtaacagaaaactctgggctctgaaacgtgggcagtgtggtctgtaaagaaagaaagaagttaactggtaaccacgacttttagataagtgatctgggtttcctaggctacacagtgggaaaattctgcataatacatcataatatgatccagtaaagaacaaagcagttatacatgatctcctgtcatgaaagtcatagctaagattcaacctgaactctaacgatttctccccaaactccacctttctgaagcttgtaatgaatatcccatcagaatctactggtagaagttcagttctaagaaataagccacaaccctaattctatttttttgtttctgtgtacttttttttgtttatatacatttttgggacagggtctggctgtcacccaggctggagtgcagtggaatgatcttggcttcttggctcactgcaacctctgccttccaggctcttaagccatcctcccacctcagcctcctgagtagctggaactacaggtgtgtgctaccacatccggctaatttttatatttttggaagagacaggtttttgccatgttgcccaggctcaaacgatctgcccatcttgtcctcccgaagtgctaggattacaggtgtgagccacccaacccagccccaaattctatttttgtaagtctgaatttaccccccacccccaacttatgacaaagaagaaaaataaattttaaaaaaacctcttagctgtaacttactatggttctaaaaattgtccctggcttccttccttttcactccagtgaatgctgattttacctcctttgatctggtaagctcaggcagagaattatgtcaccagtctttttacactacctccggaataactgaagtgtgctattcaagccgcccaggcgttaagaaaaaaccacatgggaaaggtctttcccaatttagtaaatgctgaaaaaaagcaagctacagagacaaacttcccttggatgcaaattaaaaacaaagctggggcccggtgtggtggctctggctcacgccttgaatcccagcactttgggaagctgaggcacgtgcatcacctgaggtcaggagtttgagccgagtgtggtggctcaggcctgtaatcccagctactctggtggctgaggcaggagaattgcttgaacccgggaggcaggggctgcagtgagccaagatggtgccacttcattccagcctgggcaacacaatgagactgtctccaaaaaaaaaaaaaaaaaaaaaaaaaaaaaaacaaaaaaacaatgcccacagcccagggctctgccacagcagaatgctgctgccgccacaatggcactcacctgatgcttactgtgagatagattagggaggttctcacttaatagtgctaccctacgaatagcaactgtttcaagctcagggaatctcttctcacatccactgtgaataacaaggctgcaacctagcactgtatgtattaccactgcatgttacttacctttgtgtgcactgtaaatttgactttgtctctctcactgagcgcatcaggtatgtcaatctgaagcgagggatcaacattcaggtccacagatacagatctcagctgaaatacattttttgcgtattagtttcaaactcatttggccctaaaaaattattccaaaaatgagtagttactaaaaagcagtttatacatagatcatttagaaatgtcagttgagctgggcgcggcggctcacccctgtaatcccagcactttgggaggccaaggcgggtggttcacagggtcaggagatggagaccatcctggctaacatggtgaaaccccgtctctactaaaaatacaaaaaattagctaagcgtggtggcgggcacctgtagtcccagctacttgggaggctgaggcaggagaatggcctgaacactggaggcggagcttgcagtgagctgagatcacaccactgcactctagcctgggcgacagagcgaaactgtctcaaaaaaaaaaaaaaagaattaaaaattaaaaaaaagaaaaagaaatgtcagttgagacatttctaagtttatgtgaaactgaggggaaacccattcttcacatgcattggtatatccgaagtattcctgtaatgtaaacaacagctacaataatgtcatgtacaatacatttggccaaatacctgactgtacactaaggcctgaactaaatagaacaaaatcttgaattcttacataaatgccaaagtacaatgaacattcaagaggcattaaccaggccacacaaatatctgaaaggaaaacctggggagatggcacagagaacagtcatgtggaataggatcctgggtggagagttcagagtaaacctgggactgtttcaaatagccaaggaatctagacaggaggggtgaattagaaaaaccaaccaaggccttacttaattagcacaatcccactgtggttacacatgagcaacaagtgtgagcatcactctgaatactcaattaactgattttctgagctggaaattgagaggaaaaaaactacctaactccatttctgcccgtcaaaaaaaaaaaaaaaaaaaagagaggagagaacagtggcagcactaataggaactgggctattagggaaaagtgacttaaataaaagtacattaaagcagacaaggtggtggtcaatctgaaaacctgacacacaaggcacgaggaactcatagcgtaagcatctcattgccccattccttttactgtaaggagtgctaaagtaaagttgtcataacactggattacccaaagcacggaatgccaagtgaagattacaattaagaagatgaggtatttcactccaaatttccctttgggtccctttcttcaaaataaaaagttcaagactaaaaacttatgtacttaacctctaaaacttgaaaatctggtcaatcagctataaaaagactaaatatattcactaaaagcacatggattacttaagtttcaagtactccctttttccttaagcactgtatatttataattctgaaagccagagggagcctattacaatggctttcctccaaaaaattaagctcaagtagtcaccagaagttgattttaacatcaactattagtaagatcaaaacagatacttttgagtcctcacatctcaacctaagtatttttcttccacatgaattcttgataactcctatgaaatatctgcttgtctggcttaattttcacatgtccatttgtgagatctctgcaaacaaagataaagcttcaaggtctgcgacttcatttgatcataactgactccagctttggcgtattttctgataagagcttccttccttctgctaagttaacactggcaaatacagcctttaaaaatacctcaaatcattaactgaatgtgattgcagaggctataccaacgactctactgatcttaggcttatctgtcaaggtcaggcaggcccaagaacaggaataaacagagccaggcctaagaagtagccatggtctctggaggagacataggacagctcacaggacaggtctaaggtgcctttcccagagctcaaaaactgccacatttcctaagattccatttcctaaagtcacaaaccctgacttctagcactgctcaaatgaatatgctgacagttccattttcgctcacaagcccagcaaactcagtgagcctgtgaactccacatgggatacccttggaattcgaataggaggacccaagggggatgtaatcaagtaaatggagctcatttgtgcaccacagttaaagctgcaatggatgctaccagctgctttagctgcttttcgttcctctgaataattatcttctcttttcgtccctttccccatgtagaggtaatacccccgactatacctgtcttcctttctggttagtatagaaacatattttttgtttcagaatgtgatgaagacaaaaagaagaaaaccactaggttatgagtgactgcaaccacagcatatcaaacatccgaggttcactagcagccattttgcccagacatttcgccctaggaagggattcaagcaaaactccaatcacttgacatgacagtcctaaccaccaaataagcaaataatgcaatgttgtatttgggccttaaagaactgtctaaaagagagtattggcaaaacccctcagcatccaggccatcattaactcaatgtcccccaggcgcaagttaaatgaactttctcatattatagcatataaccctccagatgagacaaacatgggtagaaacttgtgaaatgactagagcttctaagtcagcatttgtactctcactcgggaagcatcaagtgtgaccaaaagttcagcattccttctgcttagtcaacaaacccactccacagtgctacagaacttgctaaataattgccaggctccactcttcccctctcacttgcctctgcctccatccccccttaagcttgaagggctcagagtactccttagccctgctggccaacacttgagtctctgacttaggccacagatgttacaatgcttacagtggccgtttacaacagttaacaaagcaggctttagaaccaagtccagccttgggcatgccggacctttaccatgcaaagttttacctcttttccagatcccttaggtcacttgtaagaatcaaattgaaaatatacctactctcaaataatttaagttttaaaactgacttctggctgggtgtggtggctcacgcctgcaatcccagcaatttgggatgccaaggtaggcagatcacttgaggtcaggagatcgagaccagcctgaccaacatggtgaaaccccgtctctactaaaaatacaaaaagtggccaggcacggtggctcacgcctgtaatcccagcactttgggaggtggaggcagctagatcacaaggtcaggagatcgagaacatcttggccaacacggtgaaaccccgtctctaccaaaaatacaaaaattagctgggcatggtggcgcacatctgtaatcccagctactcaggaggctgaggtaggagaatcgcttgaacccaggaggcagaggttgcagtgagccgacatcacgcgactgcactccagcctgggcgatgagagcgaaactccgtcttaaaaaaacaaacaaacaaaaaaacacacacaaattagcctggcatggtggcgtgcgcctgtaatcccagctactcaggaggctgaggcagaagaactgcttgaactcgggaggaggaggttgcagtgagccaagatcgcaccactgcacttcagcctgggcaacagagcgagtctccaaaaaaaaaaaaaaaaactacacataaaaaacaaacccaacaacccagcctgagcaaaacggtgagacctcatctctatttcagaatttttaaaaaatttttaaaaacctgacttttgtagatttcccttgaaactactggatcacgtatccaaagttttaggtaaagtttcagttcatgatgtacttccctaccaggtcaatccttacaatacggattataatcagccttcacggtaaacaagcacggcttcatttggaaagcacattttcaactgttttaaaaaatcgcagtgcttttggtaagagagccaaggcacttccctaaaaggagaaaagtagttacggaatccctgtgcatttcctcacctattcatcagcttcccagctggggcacatcagacactggctgcaggacaaccctgcagctgttgagctcctgcccaccagtcttcataaactcacttttggtccaaatttcacttacgactctaccagcaaagctgcctcttcaaaaggtttaatggcttacagagggcaaagggcacctggatgactgaacaacacaaaaggcaagattctaaaactcagaacccaccaggagaacagaaaaaatacagttttttctaagtggttatggtgactgcagactcagtgccaaaatgaaaaagacacagtccaaagaagtgaaactccacaatctctgatctgttagattggggctagttgaacagtcatttaaatctaatagtcatttgtatacaatgtaagacatggatacaatatgcagtgctagcctgtattttcctatttgaatatcccacataaattactacagataggataaaaaagacacatatctatttaaatgacttcctagtttccattccaaaagcagaagatatgtacttaagcagcacatgctacagtgtcttctctttcaaactatctgttcctagcctctagggattttgttttgttatgtttcattccactgcctaagaaactaagattttgccagcaagagggccaatatgacaaatcatcgatgattcttagcatggagccaagaagcctgcctccttgatcagattttcagctggaaagatatccacaccttgcctagtccaatatttgttaagtgagaatataaaattcaaagatgttctgtcacactctagatttgtattaatgtccacaaatattaaagattcacatgatacatatttaggaaacacatgctactttgttactgtttgaactctcaggaaacaatgttcccattggtgctccgaattgttactattctctgccatcctgaagataactaatacgtacctatctgtgttcaatctcagctttagattatggcactggtgtgtgagaaacaactggttcaactaactataagcaatatattaactctgcttttttttttttttttttgagacggagtctcactctgttgcccaggctggagtgcagtggcacagtctcagctcaccgcgacctccacccccggggttcaattctcccagatactcctgcctcagcctcctgagtagctgggattacaggcgcccaccaccccacccagctaatttttgtatttttagtagagacagggtttcaccatgttggtcaggctggtctctaactcctgacctcgtgatctgcccgcctcagcctcccaaagtcctgggattataggcgtgagccaccgcgcccagcccaactctgcttttacaggtattggctctcattccctagccattggttctccccttcctgtaattcaggcctgcaatataatttcttagtcccccaaggaaaacagaactaaagacttctaacagaagatctcagtctactaacatagctaatagctattaaagctactcaggcatcggcttaataaaaaactaaagggctgcagcaagtgatcagattttcaccactcatctttgtgagatgggtctcagagggccccgtccctgctgacaccaaccattcttaccggtagcctgccaacacacaagcagttcacagtagaacactgcagactgcagggcattttcaggctacatagcctcaagttcctagaacaggaactgaggcttggaagaaggtcagtgcagcgcactcagcgaatggataaactgaatcatcatttcacaaggctgcaagcccatgtactaatggaatcaacatggaaccagagttaaattactgccttaaatatctaatgcatgtcaagaaatccatctaattactaagtaccgaaattataatactttcaaatgaattcacaaagcaaaacagctgaactaatgatctgtaaggatctcctggcagataaatcctactgggaatcaatacaccactgctaccaagaaagcaggtccaacaaatgaataaaagaaacccagccaggcagagaggttcttgtctgtaatcccagcactttgggaggctgaggcaggaggatcgcccgcggccaggagtttgagacaagcctgggcaacacagcaaagccttaaaaaaaatcacctaggctcggtggcctatgcctttactcctaacactctgggaggctgaggtgggaagatcacttgagctcaggattttgagtctgcagtgaactacgatcagaccactgaactcgagcctgggagcaggccgagaccctgagaccctgtctcaaaaagtaaaaaacagaaatgccagtttcctttactcagagctaaaagccttcacctactacccaatcccatcatggctccctcccaaaagttcactggcataccatatcaagtcagcaagcccccttttttgtagcagggtctcactctgttgccaaggctggaacaagccctcttcaacaaagctaagatggtccatattactcatgtggatgagggtgttgaaggacatttactgccttccttcatggtctcacttcatgatcaaaccaagatgcacaggaaataggtttgacaatttacctttaccaagaaagacgattcagcaacagtggtagagctgcctgtttgaacttaaccttggtcatctcagtttgaaatacaaatggcagcatggagagcaggctgcccgctttttggttggacatttctttcactcttgagtttgaggtacagcaaatttcccaaatcattcagatgtaaatattccaatactcagaccaggggcccattcaggaggctgagtgcaggaagatggcctgagctcaggagttcgataccagcttgggcaacacagcaagactgtcttgagaaaaagaattctaaacaaaataaatacaagaattcaaaacaaaattcatgaaagatataggaagggtgagggaagaagtccaacattttatcacccaccagctaccaagtatctaacagcacaatgtcctagctctgcggtgctcttgaaagaaaaagtgaaaaccctgacaagggagccatctggatttgtattcctcaccatttaccatgactagaatgcttaggagtgtgcccttcagaaactgagcttttcaggcagaaaattagttttctctccagaccatataggaatgcctaaaaaagttatgccaaaatgtaaaaagaagagtcaagccaaggacccccatttttaaacttaagtgttggctgcccctcaaactgcaacttactcctcctggggtactatggtttgcctttaggcagcatgtgaaggtgtgaagatctcttttaggagatcttgtcagagtacctcaatggccaatcagaaaacaggtattaagggtgaagaagccactttttggaaagttagatcatgcagagaaacttaatttacactttaatagccgtttctcactattgggatcattaaaagttagactgtttccttaaatactatttaacttcactacacactgttgtgaccacgggctatttaagacattcagggtactaacctatagatctgttctcacctaatttgctcgagcatcaagaccctgataataaagacagaaaaatgctgaaacagcagaattttaaaccaagttcccctctgcagcacaagaaactcaggtaagtttccagtgtccaaagcctacactcacaaacacaaacacgaagccctccctttgcaaccctcaagtacccagaacctgctgaagaaaaccatctttcaccaccttttgttaaggttcctcagtattagtggaaaagctttattctcacaaagatatccaacaatgctaatttttacatggcatgttatttccttaggcaagattaatagaaaacctgaaaaattcgcaacaagcacacaaagactagcttctgtaacacaacctgaccccacccatatcacaccattttagaaggaagtccgtttaaaccagtgattctcaaacaggcaattttgacttcttatcaccatgggaggggaggaggccgcgtcctagcagaggccaaaaacagttgcttcacatcctacaacccagagggcactcctcaacaaaagtgatcaggctaaaatgtcaacagtgctccccaggttgagaaactgaattttaaactcaacctctagtttagatgaccactaggtctcaccgaatgaggagtttacagctcagaaacaaatctagaaaacttaacagccttggccaagcacaatggctcatgcctgtaatcccggcatgttgaactggatggtgaaaccccatctctaccaaaaaatacaaaaattaggtgggcatgctggtgtgtgcctgtagccccagctactcaggaggctgaggtgggggtgatcacctgagctccccaggtcgaggctgcagtgagttgtgatcgtgacactgcactcccgcctgggtgacagagccagaccctgtctcaaaaaaaaaaaaaaaaaagcctcttggccatttctacctatggccaaaataatgtgaacagataatgaccttttagagtattcacaaatggggatcttaagacaccgagtacaagttactgaactagaactaaggcgtgggaagcttgatacgtcatacttcctcaacttagaaaatagttgcaagggtagcataaagcttcagtccacaaagtttgtaagtttggacttgctatggtattggtcaaagttcaggattgttcctatactaaccaactgcactccattctagctaatggagaacaaaaatacccctagaggcagcttccacaccagttaaacacgaaaccagagcagcagtacttagtctacaaacactcctgagtaggtaagaggacagatatcattcaccaaagtccctgtaaccaagcagtaagttaaggccaagttgttactgtcaaggaaggagaaccccctagttaaaaatagcactaggctgcgaaggtcgagttcaaataccagcctggccaacatggtgaaacccggtctccacaaaaatacaaaaattagccgggcatggcggtgagcgactgtaatcccagctacttgagaggctgaggcaggagaatcgcttgaacccagaaagcggaagttgcagtgagctgagatcgagccattgcgctccagcctggacgacagagcgagactccgtctcaaaaaaaaaaaaaaaatcaaaaaccagtaaatagaggaccagttaggaaccaaattaaccatgcatctcttcccctgaactattttctgaggaagaaggcaaaccccaacaccctcggctaaagaatgtaacaaaatgccagtgtctggctaccagacacgactgacacagtattccctttcagttttgctgaattggccaaaatgagtattgggctagaattcaaaatcctgaagaatcaagtatgtccccctaccttagtgagtcttaattaactccatccttagggagaattccaaaccaaagtaaattatcaggagggcatttaaacaatttaagtaacacacatttcaggtaacacacaaaacatttcagttgactaccgaaattgtattatggcaaaaagttgcccaagacttagtttcccattatttcatacttgccccaaactccctttcagttaaccataacaccatctaggccagaccacagcaggttatcagcatcagcagagatcagaaaacaaaaataaagccacgcgtcagggtaattatttatttttattgtctctttattcctgtaatgtaaaaaggaaaacaatgtcatgtaactctcttcgctacagatacggacagtttctgtagcctctaaaacaggcaggaaatggccttcataaccattctccaattttgctggaggatcagggtggtggaagtcattttaaaaaccagctgcaatatactgtactaccagagagtggggtgaagcaattgagtccttttacctagctgactccgaatcaagacagctaaaagaatgtaccagaaagaaagaaaaaataaaatgctaccaaaatcccaatccattatctaccctttatggagaaaagtacctttataatgttttacaaagaatcgtggtctcaagtttccactttgttttagtaataaagaactttcaaaaaaaaaaccactctaaacaacaccctcctgtatagaaagctctattttaataattaatgcaatgatacccttgttggaacaatccagccgctttgaaactctggtatttacttactagatgaacaagtttctctatggaggtgcctttaacttctcaagaaatgtgtaagttaagacggctccaaattacattttaagagagccttgtatttttagaggttctttttcatcggtcagaaaaacttacgttgacgattctgcaagaaaggttgctcgcaaaccatgcatcgcaaagctaccgaggcaaatttaaagaaccaatgaaaaagagtggaggctcgtctgaatctttaattggctatgggaatttcaatttattgcataaataatcttttagacctcaagatacacgtgacctagggacagtttacatcaatgggcaagacttaaaaatagacaccaagttcagcaagtatttgagcacctactaaaaattacacaactcccacaacaacgcattttgcgtttctaaagttgtaagcagcatgttcggacgcttgatgcaatttcccaagttgtttgggccccccccccaaaaaagtcttctcagtaaaaggtggggggaaggagggtattttgggggcaacaaaccaaactggtctgtcgcatgttaagtcaatttcacgttcacctactggtcaccacgaagccgaggaaagttttaaaaagaacattccggggtctccagagatcatctctccaagtccgctcggcaccggcgcctgagctggggctaaggtcccgcgtctctggttctgtcctaatagaatccgggacatccacagggattccccggggcagccttcagtgaagaccagggagaggggccgcccgggtctcacgggtgcttcccgcgctggggatggcggcgagcagccacggcctatggacgcgcaagggaaagaatgcagcgaccccggagctcgcagggccgcccgcccaggagtctgaggctgggaggacctcaccttgctgcggtcctcctcctgctgctgcagcaactcgggaaccgcggccatggcgacgcgggactcgagcaggggccgcctggctgtgcgaggaaagaagaagctgggccgccgccgccgccgcctgggcgcctctcgggggcggccacggccccgcctccgccggcctccctgcccgacggcggcaggaggcctccggactccgccaccatcccagctgccccgggagcaggcgagcagggcgccacgtgctcccccagagcagcctcccagtccccgctgccgtccatcttggagccgggcaaagacgccacgtggggcctacccttgctccgctccacgaggaggccgccaaccgcagggccgcgacacggacgggaagcaacggacactctcccagcaagacgcgtctagagaaagaccgcgtttcggtgcggggggaatttattactcagcccgagtccaagatggcagcgagcgctgacgtcaccagatctcgtgagagcagaagggcgcgatttggaggctcccgcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagtaattatctcaattctgattctatatgtttgctatgttttctataatagagagcaacggtgtcaaaagaatgaggtttggttttgtttttttaacttactagcaaggaactcccttcagatagtaattaacattaaatagcactttatgtgtattaactcacttgatcctcatggtagtcctgtggagtatagatactgttatccacattttacagatgaaactaaaatagatcaaatatttgactaaataatacataaaattcacttgttttataagctaccaacaatattagaattgcttgttttccttgattattgaaaaaagtcacctggtaacagaattctagttgtttgctagataattctgtttagaatccagtaaatacccactgtcctacttattagcgtaaactgactcgtaaatttaaagaccttgaagcagaccagaacacatgacctatatttagaccttggtaaacataatcagaggttcttcataaggatctgaggataaatacactttaaccttcaacttctaatttactaacttggacaagtgaggagaatagcttccttaaatttaatattccattcaaaaacaaagaccattggcactggtgaattagctagtcccataaattatataggggtcttttgttaaaggaaagtttcacatcaatcattcctttacccaagcttcccaaagtgcagtacatgtactcttagtagtacacaaactctttcatttttgttttaagaatagtgtactgacccttgccatagcctgggcttctatttaagtcgtcttttccctaatccagactcctaaaactatgcgtgtaacacattaaacatgtcacatgttctaaagaaaaatactaagtatatataggtggtattggatatgtaccaaatggtcaaggcctttgctccttataatattcctcagctgtgtggggcaaggattatatatgcaagagctaactgccttcctaagatagttaattagtagcaaccaccaaactattgtctgctttccaagcaagcaacataaaaatcttctaatggcatcttacagttttgtatttgtaccactaaaatttagaattgatagttttctcatgagaagttattttccttaaaccaggaatgtacagctgaaattactaataagaaatgtattattaaaaggcagaaacctgctggaacacatgggaccccagggcctgtagctcttggcacaaagtaaggaagtgcaccagagaggaatttctgtttggaatgtgaatgagccccaatagcccaggcagagagaagactggttgttttttttttcatagagtcagctttgttgatctagattagcactcagctgtgtttctcagttaactcagtagcaaccttaagaaatgagcagaatcgcttaccccagcaccccgcccagacttgaccgccgggacccaagtgattctcccatctcagcctgctgagtagctgggaccacaggcgtgcaccaccatgcctggctaatttttttattttttgtagcgacaagggtctccctatgttgcccaggctagtctccaactcctgtcttcaagtggtgctcccacctcggcctcccagaatactgagactacaggtgtgacccactgtgcccaggcagaatcactctttttagaaaataagtattagtaagcagtgggttctgaaataaataaagggacaattagtgtcatggtgaataaaagaaaaagggctcactaaattgattaacgggtctggaggatactggatcccaaacccaagaaggtggcacccaagaagaattacattttaaaaattaagaagatttttttaatgaaaaatattggatcagtaatttctacccagtcttctcaaaggtgagagcatagaaatgtgtctggcattcttccaaatacttgagcagtttcccaagcatcagttcatcttttgaagactggtgggaatgagaaagtctgacttattctgatttatattttgtgtataaatacacacaaagggatggggtttaggttttaatttttttttttttttttttgctacgctgatttaatcctgaagtattagccatcctgccagttccatcatgagaatactggagatgcatgaaggttttttttagtgcacttcatatacgaggacttgaaaacatttcactttcattactttgagtgaataagcagacttgatgctacatgcagtgaatattcttggatcattttttatttttataaattgaatcatgttgaatgttctgagccttagtgtctaaaggatcctgtaatctaggttttcatgtttgtgatcatgtgtatatgaagaacctagccaggggtaagtttgcagcgagaaatgtatggtctattggcatggcatttgctaagtttttttcttcctgtttttaacatgtttgtcttctgcttcattaacctagtgtgtagatgaatgctatacacttctttttcctaggctttaattccatcagtcataaatttcttgtaggtctttcacgtgttaataattccaattgagtcaagtaaatttggagtagaataacttagttcctaagttgaatttcatttaactctccaaataatttttcagaagggattccattttttgctaatgatagaattgacatttccagctgggcatagtggctcatgcctgtaatcctagcactttgggaggccgaagcaggcggatcacttgaggtcaggagttcaaaaccagcctggccaaaatggcgaaaccccatctctactaaaaatacaaaaaaattagccgggcgcagcgatcacttgtaatcccagctactacggaggctgaggcaggagaatcgcttgaacctgggaggtggagattgcagtgagccgagatcataccactgcactccagcctggaaaaaaaaagaattgacatttccatctttgtaaaaaatagttgaaggccgagtgcagtggctcatgcctgtaatcccagcactctgggagaccaaggtgggacgattgcttgaggccaggtgtttaagaccagcctaggcaacgtagagagattgcatctctacaaaaaaaaaatttttttgaattagccaggcgtggtggcacatgcctgtagaggaagctgagacaggaggattgcttaaggccaggtgttcaaggttacagtgagcaatgatcgagccagtacactccatcctgggtgacaagtaagaccctgtctcaaaaaaaaaaaaacttgacaaatgtaaagttgttttccgccttttctgtgggtctctctgcaagcatgttccaagcacgtgtatttcctgctctgtttctctgagtatctaattggtgatttccaagattgcttcctttgctctactgtgtggtagattggaaacagattctggtgccaggctgcctgtccagctttttgctttggggcaaattaacagcactgcctggtgggatagggcctcattcattaaaatgggggtaacttacaatccctattttgctgggttgttgggtttgaaaattaaataatgttttgaaagctccaaggccattgcttagcataacagtcccccctctttctctcctcttactaagaaacaagtgaatatatttcttgtgtttgttgagtctctttgtgtgtttttttttttttttttttttttgagattgtcttgctctgtcacccaggctggagtgcagtggcatgatcttggctcactgcaacctctgcctcctgggttcaagcaattctcctgcctcagcctccagagtagctggaattacaggcatgcgccaccacacctggctaatttttgtattttgagtagagactgggttttaccatgttggccaggctggtcttgaactcctgacctcaggtaatccgcctgccttggctgcccaaagtgctgggattataggcataagccaccatgcccggccatgttcccttttttaaaatgtgtatgaggagggggcttactatgcaagcgcttggaggccaacgagcactgaaaatgaggagagagttcaaaaatcaagttagatcctgggatacgccaacaaatccagacactacagttctttcggagaaacctggggacgaaaagtaaggctttgacctcagaaaatgaacatacaggaaaaataatgtgtcctaatgtgtcctaatgaaatttctctagtattcacatgttataaaatgttaggaagaaagaagatgtgtcctcctacaagccataaatcagaattctaataatctaaagctaattagaaaaatattacatgttaaatattaaatattagaatagaaaaatgtatgagggaaaaaaattgagacacagctgaatttttcaggctgttccagcactaaaaaaaaaatacaggagaagaatgtcacatattttcctcttcctccccctccagattccataatatcaaattcataacttttcatttgcgcatgccttattttccattccttgtttgtcactaatcctgttagtaaaaggattcccccacctatgttcataattaagttttggtctaaaaagaactacaaacagaagcacagttccctagatttctaatttttttttattttatcacagccagttaacttattacattggatacttaaacacatagtaccataaactggatgtggtcttgtagccgccagatcttcagttttgactttggcccaattctcctagaagtacttaattttaattcattttattacctaacgtcctattaataatcccgttggtttcaaagtatattcttaggtttcacaagaggctgaaatttggtcttaggggttgtcacttaaaaataactaatgtaatttttggccgggcacggtggctcatgcctgtagtctcagcactttgggaggccaaggctggcagatcacgaggtcaggagttcgagaccagcctcaccaatatggtgaaaccccatctctactaaaagtagaaaaattagccaggcacggtggcgggcgcctgtaatcccagctactcaggaggctgaggcaggagaatcacttgaccccaggaggcagaggttgcagtgagccaatatcgcccactacactccagcctgggcgacagagggagactccatccaaaaaaaaaaaaaagaaaaaaaaatgtcatttttaattgtattgtttcagggcgttttagagtatttgtttttcagtgttagctttgtttgtgtttcccccctccccttttccctgattttcttttcagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagtaagtatgagattggaggtgaattaatacagcgtaggacagatggtgcctgtcaaaggtgtgcctgtaggtactgtagcctctgtctgtttaatgtccagacctttgtgctaggtaaaagaattgggtggggcggggttgagaacaggtacaaggagaagagccacgtaacctttgtcatccagtactccaaaatcaaattgtttgctggagaaaggtatattctttgtttgtttgttttgttttgagacggagtgtcacccaagctggagtgcagtggtgcaatcttggctcactgcaacctccgtctcccaggttcaagcggttctcctgcctcagcctcctgagtagctgggactacaggcatgcaccaccgcacctggctaatttttgtatttttagtagagacagggtttcaccatgttggccaggctggtctcaaactcccgacctcaagtgatccatccaccttggtttcccaaagtgctgggattacaggcgtgagccactgcacctggccgagatttttcaatctccctaacatggcctgtttgccagcctgtccttcccctcccccaaagcaaggtacctgccataagatccaatttcattcctgcgttttctttcctgtttttctaaagatagcaccatgatctgttggttctgaaaatcaactcttcctggcttccaggcagtgcttgacatggatcagagatctgaacttactaaagcttcccatggttgttttgttttgttttgtttcgttttgttttttgagacggagttttgctcttgttgcccaggctggagtgcagtggtgcgatttcagctcactgcaacctccatctcctaggttcaagctattatcttgcctcagcctcccaagtagctgggattacaggcatgcgccaccatgtgtggctgattttgtatttttagtagagatggggtttctccatgttggtcaggctggtctcgaacttcggacctcaggtgatccgcctgcctcagcctcccaaagtgctaggattgtaggcatgagccaccacgcccggtccccatggtttttatatcgtagctgtcttactgttttactcaggtacttcagagtccaagtgttacaggaaaggggtcctgatccagaccccgagagggttcttcgatctcgggcaagaaagaatttaggttgaaggcaggcacagtggctcacgcctgtaatcccagcactttgggaggccgaggtgggcagatcacctgaggtcaggagttcaagaccagcctagccaacatggcaaaactccgtctctactaaaaatacaaaaattagccaggcgcagtggtgtgtgcctatagtcccagctactcgggagtctgaggcaggagaatcactttaacccgggaggcagaagttgcagtgaaccgagatggtgccactgcactccagcctgagcaacaggtgagactctgtctcaaaaaaaaaaaaataaaagaaagaaaagaaaaagcattcaggatgagtctgcagtgcaaagtaaaagcaggtttattaataaagtaaagtagtggaagtatagctactccatagacagagcagggcgttcctgaaagtaagaggaggaacacttccaccctaagtacagtgctcatatatataagataaaaaaagagatcttggggagatgtgctctactgcaagggtttgtgataaaggattaattttcttaattattatattttgcaagaatcgatactatctttaaagcaaaattaggaatgccttcgttctccagatatcagggtatctggacactcccaagtctgggtctgtttagtaaacattattaatttgttcccttaaccttaaacatctagaggctatgaatgcctgactttctgggaatgcagcccagcaaggcccagcctcactttcctagccctcactcaagatggagttgctctcgttcgaacgcctctgatacaaaggtggctacaacctgcaggtacccctaatccaaataaggcaagcgatcactaagaacaagatagaaaaatccgttcatgtaaaccttgaagctctagttaaaatttaagtttaaaagcttgtctattccacagcccaatacaaattcgtaaactttcttaaaacattatgagatttttttttggttatttatttatttatttttagttcatcagctattgtgtggcccaagacaattcttccaatgtgggccaggaagccgaaagagtgggcacccttgatagtctgaaaactgtttagaccacctaatggttttattttttatttatttatttttgagacggagtttcactcttgttgcccaggttggagtgcaatggcgtgatcttggctcactgtaacctctgcctcctgggttcaagcgattctcctgcctcagcctcccaagtagctgggattagaggtgcacgccaccacacccggctaatttttgtgttattagtagagatggggtttcgccatgttggccaggctggtctcgaactcctgacctcaggtgatccacccacctcagcctcccaaagtgctgagattacagacgtgagccaccgcgcctggcctagaccacctaatggttttatagcacaactgcgtcatatctgagaagagccctgtataccaagagatttaatagactttggttgccttttagataaaccaaggaagccatacagtcacctccacccaaggcctacaagaagttcctgacacccaatgcttgtcatagagatgataaaatatgtccatagcactgttgtttgttttttgctttttaagtcaacatcaaccttggtaatatgaacatttttgaaactacggtttttttttgttgtttttgtttttgtttttgagacagagtcttgctctgtcacccagactggagtgtggtggcccaatctcagttcactgcaacctctgcctcctgggttcaagcaattctcctgtgtcagcctccccaagtggctaggactacaggcacccaccaccacgcctggctaattttttgtgtttttagtagagatggggtttggacatgttgcccaggctggtctcgagctccgggccttgagtgatctgcccgcctcagcctcccaaagtgctgggattgtaagtgtgagccactgcacccagcctagaattttttttttttaagacacagttttgttcagttgcccaagctggagtgcggtggcatgatctcggctcactgcaacgtccacctcgcaggcccaagcgattctcccacctcagcctcctgagtagttgggaccacagatgcgaacaaccacgcccagctaatttttttgtatgttttgtagagatggggttttgccatgttgctcaggctgatctagaattcctgaactcaagcaagctgcctgtctccgtctcccaaagtgctgggatttacaggtgtgaggcaccgcgcccagctaagaattttttatttttgttatttttttaattttatttatttatttttttgagatggagtcttgctctgtcacccaggctggagtgcagtggcgcgatctcggctcactgcacgctccgcctcgggttcacgccattctcctacctcagcctccccagcagctgggactacaggcgcatgccaccacgcccggctaatttttttttttttgtatttttagtagagacagggtttcaccgtgttagccacaatggtctcgatctcctgacctcgtgatctgcccgcctcggcctcccaaagtgctgggattacaggtgtgagccaccgcaccgggcctaataattttttattttattttagtttatttttttgaggcagtctttcactgtcacccatgctggagtgcagtgatgcattcagggctcactgcagtctctaactccccaggctcaggctgtccttccacctcagcttcccaaatagctggaactacagggatgcaccaccacacccaactaatttttctattttttgtagatgtggggtctcaccattttgctcaggctggtcttgaactcctgggctcaagtgatccaccacctcagcctctcaaagtgttggaattacaaacgtgagcccctatgcctggccgattttgtttttgagaaggagttttgctgttgtcgcccaggctggagtacaatggcgagatcttggctcactacaacctctgcttcccgggttcaagtgattctcctgcctcagcctctctagtagctgggattacaggcgcctgctaccatacccagctcatttttgtatttttcatagagacggggtttcaccatgttggccaggctggtctcaagctcctgacctcaggagatctgcctgcctcggcctcccaaagtgctgggattacaggtgtgagccactgtgcccgaccccactgaatttttaatgggtaatatgctattaagagtaactccccacacccactctgtattgaacctctgtttaaaaagctcctgtgttcctgagatattgtatgaccatatgtacaatcatttgtccccacactcattttttaacacaagatgatataccctgcttttttccacttaaaaaaattatttaaaaaaaaatcaggctgggcgcagtggctcacacctgtaatcccagtactttgggaggccaaggcaggcagatcacgaggtcagaagattgagaccatcctggctaacacggtgaaaccccatctctactaaaaatacaaaaagttagccaggcatggtggcaggcgcctgtagtcccagctacttgggaggctgaggcaggagaatggcgtgaacccgggaggcggagctggcagtgagctgagatcacgccactgcactctagcatgggtgacagagtgagactccatctcaaaaaaaaaaaaaaaatcttttattagtttatatagatctgtaacattcttttctcatgtaataattttccaccacccacaattaacacttaacactggtgcatttgcttaaaactttttttttccttatccctgtgattacatggagatcttttttttaaagaaatataatattacagattaaccccaaattctgttgaaccacccgtggccaaaggcgattgctgttttaagtttggcactacctccttctagtctgccttctacgctcttttttgttcttttctttttttaatgaccaatgatctgtgacacagcatcaggagaacctaagaatatgtgccctctatactcttagcacacacataatgctatgtataatacacatgcataggcagcacttatgtatgatttcatgcagaactgtgacagtcataatatacagacatctctagatacacagcatcacaaagctagtaagatattgggctcaggagccagctgcttgagtttggattctggcttggcttttcatcttaaccttagattaattacttagtcgctctctgtctcaatttattcatctttaagataagacaaatggtagtacctaccttgttataaaatgagatattccctgaagagtgcttaatgcatactatgtattcagtagatgttacattattattttgatctacttctttttttacttttttatagaaataattcttgctgtgttgcccagactaatctagaactgggaaggaagtatgatcctcacctcagcctcccaaagtgctgggattacaggcgtgagccaccttgcccaatctactactcgtgtgtgtgtgtgtgtgtgtgtgtgtgtgtgtgtgtgtcagagtctcgctctattgcccaggctggagtgcagtggcacaatctggactcactataacctccgcctcccaggttccagcaattctgcctcgccctcctgagtagctgggattacaggtgcctggctaattttttttgtatttttaatagagacagggttttgccatgttggccaggcttgtttcgaactcctgacctaaggtgatccacccatctcagcctcccaaagtgctgggattacagacttgagccactgcacctggccctacttctctcttaactcgttttttgtattcttttgtatgaatgagccttacccatttccctattgggaacactcagattatttctagttttccacaattacaaacagtgctgcagcaaatgtgcctctttgtatattacagagctgttctaggcagatgcacagattcatttgtttatttattttttttcttgagacggagtttcacccttgttgcccaggctggagtgaaatggtgcggcaccgcaacttccacctcctgggttcaagcgattctcctgtcttgtactcccaagtggctgagattacaggcatgtgccaccatgctcagctaattttttgtttttagtggagacagggtttcaccatgttggccaggttggtctcgaactcctgacctcaggtgatccacccacctcagcctcccaaagtgctgggattacagacatgagccaccatgcctggcctgtttgttttagacgtgtgatatatgcagttacaatccatttagttggtctgaagtagacccggacatgactgcttcttaaatctcccaggcacttgtcacttcacttgtactcaggatatcaagccattgctatcctatactttaggaaggttgctgggtcaagggtatgcattttaaattaccaagaatatgagtgaatacatttaacaatacagtgttagtaattttgataacattgtatttttaatttgcatgtcacataagtgagactgagcatcttttcatttaagagctatttgtgaactgttactgtacttttaatttgggtttacgctactatgatgttaaaaaatgtttttgactgacaataattatatatatttataggctacagtatgatattttgatatatgtatacctaatggaaagattaaataagctaattatcatatccatcacttcacctatttatcattttttggtggtgagaatctttaaaatctactcttttagcaacttttaaatatacaatgcattattaaatatggtcaccatgctgtgcaacagatcactaaaatttattcttctgacctaactgaaacctcttaccctgggatcagcatctcccctttcctcttccccactctccatccctatcctcttgtaatcaccattctactctctctctttctgagttcgacttttttagattccacatataaatgaaatcatgcagtatttgtctttttgtgcccagcttatttcactcagcaaaatgttcaccatgttcacccatgtcacaaatgacagaatttccttctttttaaaggctatgtagtgttctattgtgtgtgtgtgtgtgtgtgtgtgtgtgtgtgtgtatccacattttctttatccatttatccatagatggacacttaggttgtttccgcatcttggcctttgtaaataatgcttcagtgaacctgggattgcaggtgtctcttcaacatactgattttaattcgtttggctatatatccaaaagtaggattcctggatcgtatagtagttctggtttcagtttttagatgttttagttttctgaggaacctccatgatgttttctcaaatggctatactaatttacatgcccaccaacagtttatcagggttctcttttctgcagtcctcaccaacacttaccttttgtctttttgataatagccattctaacaggcatgaggtaataatagcccagtgtgattttgatttgtctttcactaatgattagagatattgagcatattttcatctatctgttggtcattcatgtcttcttttaagaaatattcattgagctcctttgcccattttttaatcaagttatttgttttgttactatttagttgtttgagttccttatatactttggatattatccccttatcagataggtggtttgcaaatattttctcccattctgtggattgtgtcttcactgttgtttcctttgttatgcagaagctttttatttggatgtatatgtctgtttttgcttttgttacctgtgcttttgggcttctgagaaatcatggctcagatcagtgttggggagcttttctcctgttttttttctagtagttttacagtttcaggtcttaaattttaagttgatttttgtatgtggtatgagatagggtacaatttcattcttatgcaagtcgatacccagttttcctaacacaattgacaaaacattccccattgttcgttcttggtacctttattgaaaatcaattgactgtaaattcatggttttgtttctgggctatctgtcctgttccattggtttaaggtgtctgcttttatgctattatcatgctgtttgattataacagctttactttatacagccatgttccacataacaatatctcagtcaacgacagactacatgtaaacagtggtcccataagattataatggagctgaaaaactcctatcatctagtgatgttatgttatagtgcaacatactactcgtgttcgtggttatgctggtataaactaacctcctattcagtcatataaaaacagcacataccattatgtacactacagtatataattgataatggtaataaacaactattactggcataagctggtatataaccagcttataaacaactattactggcatattactggtatttactatgattctgaccctgtgtaggcctaggctaatgtgtatgtttgtgtcttagtttttaacaaaggtttaaggggtaaaaaataattttaataatagaaaaagcatgtagaataaagatatcaaaaaagaggccggggcatggtggctcacacctgtaatcccagcactttgggaaaccgagacaggtggaccacttgaggtcaggagttcgagaccagcctaggcaacacgatgaaactccgtctttgctacaaatgcaaaaaattacccgggtgtggtggcacatgcctgtaatcccagctagtctggaggctgaggtaggaagattgcttgaacccgggaggtgggggttgcagtgaaccaaggttgcaccactgcactccagcctgggtgacagagcaagactttgtctcaaaaaaaaaaaaaaaaaaaaagaaaaggaaaatatttctgtatagttgtacgatgtgtttgttttaagataagtattattacaagagtcaataaattaaagaagtggccgggcatggtggctcatgcctgtaatcccagcactttgggaggccaaggtgggtggatcacctgaggtcaggggtttgaaaccagcctggccaaaatggcaaaaccccatctctgctaaaaatacaaaattagccaagcgtggtggtgcatgcctgtaatcccagctatttgggaggctgaggcaggagaatcgcttgaacctgggaggtggaggttgcagtgagccaaaattgtgccattgcactccagcctgggcaacaagagtgaaacaccatctcaaaataattaaagaagtttatacagtaaaaaagttacagtaagctaaagttaatgtattattgaagaaagaaaaacgttttttataaatttagtgtagcgtaagtgtacagtgtttataaagtctatagtagtatacagtaatgtcccaggccctcacattcactcaccgctcactcactcaatcacccagagcaacttctagtcctgcaagctgcattcgtggtaggtgccctatacaagtatactgttttttatcttttataccacatttttactgtaccttttctgtgtttagatgcactaatgcttaccattgtgttatagttgccagcagtattcagtacagtaacatgctgtacaggtttgtagcctaggagcaaaggtctgggtgtgtagtaggctatcctacctaggtttgtgtaatatactctatgtttgcacaatgacaaaattgcctaaccatgcatttctcaggacatatccctgtcattaagctacacatgactgtactttgaaatcaggcagtgtgatgcctccgacttcattcttttcactcaagattgctttggctattcggagtcttttgtggttccgtgttaattttaggatttttttttttctatttctgtgaaaaatgatgttggaatttttttttctttttgagacagagtttcacccttgtcgcccaggctgcagtgcaatggcacagtctcagctcactgcaacttctgcctcccaggttcaagtaattctcctgcctcagcctcccgagtagctgggattacaggggcacatcaccacgcctggctaatttttgtatttttagtagagacgaggtttcaccatgttggccaggctggtctggagctcctgacctcaggtgatctgcccaccttggcctcccaaagtgctgggattacaggtgtaagccaccgtgcccggcagaattttttttttttcttttttcctgagacagggtctggctttgttacccacgctgttgtgcagtggtgcaatctcggctcactgcaaactccacctcctgggctcagcctcctgagtagctgggacaacaggctccagccacaacacctggctgattttttggtattttttatagagacagggtttcaccatgttgcccaggctggtctcgggctcctgagctcaagcagtccacctgccttggcctcccaaagtgctggagattacaggtgtgagccatcacacctggcctgccattggaattatgataaagattgcgtggaacctatagattgctttggatagtatggacattttaacaatattcttccagtccataaacagaggatatcttaccatttatttgtatcattttcagtttctttcatcaatattttatagttttcagaatgctattaaggtttttttttttacatttattaagttctacaattacagtacattgctgcaaacagtgttctgtggcagaaatataacatggtggctcacacctgtaatcccagcagtttgggaggccaaggcgggtggatcacttgaggttaggagttgaaaccagcctggccaatagggcgaaaccccatctctactaaaaatacaaaaattagctgggcgaggtggcgcacacatgtaatgccagctactcagggggctgaggcagaagaatagcttgaacccaggaggcggaggttgtggtaagccgagattacaccactgcactccagcctgagtgagactccatctaaaaaaaaaaaaaaaaaaagaagaaccaggaatggcatcctagagttactggggcccttttctcaactacacagattgtcaaacttggcaatattacaaaacaattctgaagacaataaaattatctctaaacctaaactgtccagtagagtagccactaacccctatagctattgagcatttgaatgtggtcaggccaaactaaggtgtgctatagcaatatacaaactacatttcaatgactttgtacaaaaaagaatgtaaaatatccctataataaaaaaaagacgtaaaatatcccattaatcatttgttagttgattacatgttgaaatgatattttggatatgttgggttaagtaaaatgttaaaatttcagctgtattttttttttcttttccgatgtggctactagaaaatttaaaatgacacatggctcacattttacttcttttagccagtgctgctctagactgagtttgcatgaggtgtaactgtctagagctatagtgacatgtaagtaatatacatgctttgtacaaaatctccctataaactgctgattttgaaattgaagtcatgaaagacagattgaaccgatagagtcctttgagagtcaccagttactggtccactctctgtatccttttgatatttgcatttggcaagtataaacccgaccaggataggggatggggggaggaatccactggttatttgatgcaaaaaaagagggagaaaaagtgggggggtgcacttatagtcccagctacttgggaggctgaggtgggaggatcacttgagcccaggagtatgcgtttagcctgggcaacatatgaaaccccatctcttttttaaaaaaggaaaaaaatggtgaataagagcaatggtcattggctgacaagtaacaaactatacataagagaactgttaacctagtagagattttcattgtgatctattacctacaaagtcttcctgtggtttctctttaggggcaagctctgtgtgattgattggaagacatcagagaaaccaaagccttttattcaaagtacatttgacaacccactgcaagttgtggcatacatgggtgccatgaaccatgataccaactacagctttcaggtcaggacactgagcctttacttaaagctttgctcaatgcttacttaaaactataactccgggccgggcgcagtggctcatgcctgtaatcctagcactttgggaggccaaggccggtggatcacttgaggtcaggagttcaagaccagcctggccaatatggtgaaaccctgtctttaccaaaaatacaaaaactagctgggcatggtggctcatgcctgtaatcccagctattctagtagctgaggcaggagaattgcttgaacccgcgaggtggaggttgtagtgagccaagattgcgccactacactccagcctgggcaagagagtgagactccatctcgaatctgtctcaaaaaaaaaaaaaaaaacttctcagtgggggggtaggaggagaaaaattgtaaaaaaaaaaaaagttaaaaaatagaactccttgaggtttttccttttttaatctctatttttatcccattgcttaacgtcttccttgttcctttcccacttaaaaaagcactttttggctgggcacagtggctcacgcactttgggaggccgaggcaggcagattgcttgtgctcaggagtttgagtccagcctgggcaacatagtgaaaccccgtatctacaaaaaaaatacaaaaattagctggacatggtggcgcacacttgtgccagctacttgggaggctgaggtgggaggattgcttgagcccaggaagtggaggttccagtgagccgagattgtaccactgcactctagcctggccgacagagcaaaaccctgtctcaaaaataaataaataggccaggtgtggtggcccaagcctataattccagcactttgggaggccgagttgggcagatcacctgatgtcaggagttcaagaccagcttggctgacatggcgaaaccctgtctctactaaaaatacaaaaattagctgggcgtggtggtgtgtgcctctagtcccacctacttgggaggctgaggcaggagaatcgcttgaacccaggaggcggaggttgcggtgagccaaggttgttccactgcactccagcctgggcaacagagcaagactgtctctctccaaataaataaataaataaataaataaataaatagcactttttggccaggggtggtggctcatgcctgtaatcccagcactttgaaggaggccgaggtgggcagattgcttgagcccaggagttcaagaccagcctgggcaacgtgacaaaactccatcattactaaaaatagaaaaatcagccggaagtggtgcccgcctcagcttcgagggtgcaacgagccgagattgtgccactgcactccagcctggacgatgggagtgggatcctgtctcaaaaaagaaaaaaaaagcacttttccaccctcttcttgggccttttttttttttcaatggctctgtaaggatcacagcccagtcttcaatgttttatctgtcatctttgtgttcttgtgtcctggtgcagtctttgatcaacctaccttagaaactgagttaggagatatcctgtagattattttatactgagtttgccctggagtaagaaggaaacgaacctaaactctggacctactgtagtgaaacgagaattgccctgtgtttcttcctaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaagctttggttttgtttactttgtgtgtttataggataattttataaacctggaaattgtttgcactttttttataattcagaattttacaagcccaatagctttggtgagagttctgtgtaagtgcataaaagaaagcgtcctcggctgggcgcagtggctcacgcctgaaatcccagcactttgggaggccgaggcgggcggatcacaaggtcaggagatcgagaccatcctgggtaacacggtgaaaccccgtctctactaaaaatacaaaaaattagctgggcgtcgtggcgggcgcctgtagtcccaggtgctccggaggctgaggcaggagaatggcgtatacccggaaggcggagcttgcagtgagccgagatcacgccactgcactccagcctgggcgacagagcgagactccgtttaaaaaaaaaaaaaaaaaaaagcctcctcactaagccctcagccacggtcacctagcaaggaaagcaatattcaggtaggagatgggaggatcaagggggacctttgtattatctctatacacttctgcattcatgtgggtttttctcaagctgcagatacatatttctgtagcctgtaaattccagtcaaaaatgaagtgaggcaattaaaagttgtgctagcagagtttgccactctgctctaataagcctcaacctagaatttaggaggctagacctaacaaaatttctttttatttttctttttttttttttttgagaccatctggctctgtcagccaggctggagtgcggtgggctcactgcagcctccgccttccgggctcaagcaattctcctgcctcagcttcccaagtagctgggattacaggcgtgcaccaccatgccctgctaatttttgtatttttagtagagacagggcttcgtcatgttgaccagggtagtctcaaactcctgacctcaggtgatccgcctgcctcagcctcccgaagtgctgggattacaggcgtgagtcactatgtccagctgcaaaatttcattttaatacaggtgttctgttatgtaaatagaaatttgtctcagacctgtgactttgtactaggagtctcccaagataatggtggcctgaaaagttctatgagggagcccctcaggagagtgtgaccaggaggatgtggttggtataagaacagagaaggtaaatccctgggcaggttttcttgacctcaagggctcaccagtttctcctgataatcatgatactcctcgggggtcacatctcctgagatgttaatgtcaacggaaaaagttattgttactacgaaagcataggaggagaaagtcaaatttgagtttctaaatgagttgcagtttttcaagaattaacatgtatgaggcagtggcttacgcctgtaatctcagcactttgggaggccgaggcgggtgaatcacttgaggtcaggagttcaggaccagcctggccaacatggtgaaaccctgcttctctactaaaaattaaactagctgggcctggtggtgcacacctgtagtcccatctgcttggggaactaagacgggagaattgtttgaacccaggaggcagaggtcgcagtgagctaaggccacgccactgcactccagcctgggcagcagagcgagtctccgtctcaaaaaaaaaaaaaaaaaaaaaggaattaacacgtatgttaggaattgttggttgccatctctttgccgaagtgaaatactgcatatgaaactccagtgaaatgaaacagcattcaaaataaggagagacgctcaaggataatttacatttttttaaaggaggtgtgtgtatattgcttttctgaggaggctttctcagaagtacagaatgttgccttccagtgtttagttttgagaaaatccgttggcttcaaagctaactgcatttccttttcctccacagttctacccattcttaccaatgcagtcagcaactgacagaagttccatgctgacacaaaagccaattttgttttttccaaaaaaaaaaaaaaaaaagtataaatatatacacatacatgtatggcctttttcctccttacacctggcctcttcctcagagcctgataatctgagaacattagcctctataaccctattataattctaggaaaactcgtcagtgtatgacctacggtttcatatgtgttgaccttggtaaatacaggaagggggttagtcataagtcagtgtgttcctaggtaaccaatttggctactggctttaaaaggaattggagaagggtactttgttttaatcactgaggctttccacccgagcaattaaatatttgattataacctaccctgtgttcctgcccacccctcaacaaaagagtgaaggaagggaatcattggagtaaaaaacattaagaaacaaaatagagaatagttgaaacttccatgtttaaagaaacaataagttgtttggagctatgtgttaaatcactcaatgctaagtaaaaagtagaactgacttttccttcctgcctcccttcccgccagcagaggcctaaaagttaagcagatatgtgcttctgctggaagtctaacctactgatccacttcagttatttatactattgaagggaactagagagaatctctggggagagaccccagaatgagcaaaaggcttgtatgttgccatgacaataacaattgtcaggttgagtaatgcatttgtgaagatccaatcataaaaagatggccaggcacagtggctcatgactgtaatctcagcactttgggacgctgaggcaggcggatcatttgagctcaggagtttgagaccagcctgggcaacatggcaaaaccccatctctaccaaaaatacaaaaaagtagccaggtgtggtggcatgcacctgtggtcctagctacttgggaggctgagggaggatcgcttgagcctgggaggtggtggttgtagtgagccaagattgcaccactgcactccagcctcagcaacagaatgagaccctgtctcaaataaataaataaataatgttttgggttcagatttgagggttttttcccattttacttaagaaatagatataaaatatgtagattgttacaggccaggtgcaggggttcacaccttgaacccaatgctttgggaggccaaggctagaagatcgcttgaggccaggagctggagaccagcttaggcaacatagaaagactcccatctctaaaaagtaaaaagtcgtgtaatcccagcactttgggaggtcgaggcaggcggatcacgaggtcaggagatcgagaccttcctggctagcacagtgaaaccctgtctctactaaaaatacaaaaaattagccaggcgtggtggtgggtgcctatagtcccagctactcgggaggctgaggcaggagaatggcatgaacccgggaggcggagcttgcagtgagccaagatcacgccactgcactccagtctgggcgacagagcgagactttgtcttgggaaaaaaaaaaaaaagtcgttgggcatgggggtcatgctgatagtcctagctacttgggaggctgagacaagaggatcacttgagtccaggtgtccaaggctgcagagagctatgatcacaccactacactccagcctgggtgagaccttgtctctaaaacaaacaacaacaacaacaaaaaatagaccaggccagcgcggtgtctcatgcctgtaatcccagcactttgggagactgagacgggtggatcttctgaggtcaggagatcgagaccagcctggccaacatggtgaaaccccgtctctactaaaaatataaaaattagtcgggcgtggtggtgggcacctgtaattccagccatttgggaggctgaggcacgagaattgcttgaacccaggagacagaggttgcagtgagccaagaccatgccactccactccagcctgggcaacagagcgagcaagactcagtcttctaaaaaaaaaaaaaaaaaaaaaagcattacagataaaagctgttgccttgttttcttaatcccatttccctctcccctgagacaaatgccgtcataaatttgatgtgggtttttttgtatagttttactgtgtgtactggtttccatgtataatatagttttgctttctgtgtttttagatttacttgctttatctcaactttgtttttgagatgtctccaggttcaccaattctagatctttcataactgcttttaactcctctgcagttctccctcctgttttattgtcatgctaatggactgttcggttaacagtgttttgctactccagacgatgcagcagtgaacacctttgcacgtgttttctggtacacacaatacacatgcaatatagtggaaagtgcagtatggattgtgactctgccacttactagctctgtgaccttggactagttacttgacctttttttttttttttttttgagagggagtctcactctgtcgcccaggctggagtgcagtggcacgatctcggctcactgcaagctcggcctccagcgttcacgccattctcgtgcctcagcctcctgagtagctgggactataggcacccgccaccacgcccggctaattttttttgtatttttagtagagacggggtttcaccttgttagccaggatggtctcgatctcctgacctcgtgatccacccacctcggcctcccaaagtgctgggattacaggcgtgggccaccgcacccggcctgttacttgacctttttgtgcttgatttcctcatctgtaatttgggggaaaataatagtatctgcttcttgaaattgtgaggattgaatgagcgaagcattcagaaaagtgcctgacacatggtgggaacaaaatgttagccatcctcctatcaaatgatcagacctggatgtgtctctgctgggtcaaagcttgaacattaccaccaaatttcctctccaaaacagtgacatcgacttaatgtcccaccagtggtgtctgaaatttcctgatttctcgcatattctctaacacaagagttgtgagcccctcttctgacggtatgaaaaccattttttttttggaacagcattaacgcgtgaataaaatctgctttaaaacgcgactgtcatctagtggtgagagaagtacactgcaattatggggcagaagccaaaaatgggcggacctacatctatctccgggtaatttgggcattttagtcaccaacacaggtctgttttgaataaaatcaactacatgagtgttcttcctttacctctgtattttcaggcagcttgtacttctcactttttctactacaataatatagaagcctggctacacagcccagtgaggccccttgctaccaaatgcatctgggtcaccggttcggaaaagtggagtgagataaagtagaaatgaggctatttaccaaactggtaggaaactgcagctccaaccagggcgggcttcccacaggcagcactgattttccagcaggagagatggcaattcccacgttggtgcaggtcatacaggcactgcaggggactcagctcagtcggctcaccagagccccagttaatgcgtcccaatcagcctcagccattctctgcgaggacttctaaaaggattgaaaagtgtatgaaagtgttagatattaatcatcagagacatagatatagttttaaagatctgttagataacaaatattatctaacaggttaggtaacatgctacaattttgtgatgaacaaaaatgttcattaaaggtaatagtgtaaaaaagcaatgttgctgaaatgtaacctaatgtgtctttaagtaatagtatcactaaactaatggcatattaaaagttttttaaaaaaagaagccgtgtgcggtggcttgtgcatgtaatcccgacattttcggaggctgaggctggcagattgcttgagcccaggagttcaagaccagcttgggcaacatggcaaaatcctgtctctacaaaaaatacaaaaattagccaggcatggtggtgcacacctgtagtcaggcccagctactcaggaggctgaggtgggaagaccacttgtgcctgggaggcagaggctacagtgagccaagatcacaccacttcactccagcctgggggacagagggagaccctgtctcaaaaaaaaaaaaaagttaaaaaagaaaacaaattctaaagaacagcaagctaaggtcaactgtgattagaagcattcatttaggcaagtctagactgtcctactgcaccagtctcactcatttctaagctgttgtttgtgctgacacctttgcataaaataacttcccttcctccctttgttcagccatatcttgcctgagagcttgggcctgaaccgcaatcccactgatgatctgctcaagtcttacctgctccacaggaaacaaaatggtatagggcaggaagcaggagcctcagaattgggcagaggtgggttcaaatcctgctgtgcaatgctaagtcacttcagctctccatgcctttttcctcactagtaatttggggaagagtattaacctcagtgttcctggaaagattaacataggaaatgtgtgacaaatgctgaacgtggaataggcactgggcaaagatcaactacttcctccgtggaaccgactctacccttcactgaactcttgtggtgcctttgtttttaccacccactttgattcttgttcatattctacctttttctgttacttcactatttcagatgtacatgtaacaaacacagtgaaaccccgtctctactaaaaatacaaaaaattagccgggagtggtggcacatcctgtagtcccagctactcaggaggctgaggcaggagaatcgcttgaaccctggagggggaggttgcagggagcagagattgcaccactgcattccagccagggcggcagaacgagactccgtctcaaaacaaaaacaaacaaacaaacaaaaagacaaaaaaaactacttattttatatctatttcttaagtaaaatgaaaaacaaaaagaaaaaaactctcaaatctgaacccaaaacatctttttatttatttatttttttgagacagggtctcattctgtcgccaaggctggagtgcagtggcacaatcttggctcactacaacctctgcctcctggattcaagcgattctcttgcctcagcctcccgagtagctgggattacaggtcattaccaccgcacctggctaattttttgtatttttagtagagacggggttttttcatgttggctggctggtctcgaactcctgacctcaggtgatccatccaccttggcctcccaaagtgctgcgattataggcgtgagccaccatgtctggcccagaatagtgttttaagagagagatgagtaaagagacaaacaacagaggaaactgccatttcctagagcagcagaaaaagagctgggtatcagaatggctcaccagagaaatttggttagtgctggtcacccctttgataagaggctgtgggttgacttgtgagctcagtgatttgaaagttttgagtatatgaagaaaaaaaaaagaaatgaaagctttgtgtagaactaggggagtctcgcagtgaaacaagacttgcaaaataggattaatgaggcagtacagataaggatgcgatgctgaagaaagtcatgggattgtagttagacggtgtataaatcagagagctaaaaccaatagggcttgtagatataggtatatgacaggggatttattaggggaatgggctcacacaattatgggggctgagaagtcctacggtctgctgtctgcaggctggaaaaccagggaagctggtagcatggctccgtccaagttcaaaagcctcagaaccagagaacctgatagcactcagtctcaggccgaaagcctgagaatccaggaggccactggtgtcccagagtccaaaagctggagaagctggagttctgatgtccaagggcaggagaagaagggtgttccagctccagaaaacagagcaaatcctcctttcctttgcctttttgttatcctggccctcagctgatggacggtgccccctgacattgagtgaggatggatcttccttactcagtccactgattcaaatgccagtttcttccagaaacacctcacagacacctcaaaataatgcttcgccagctgtctgggtgtcattaatccagttacgctgacacctaagattgaccatcataggtggtaattcattcctttacccgacaaatgtcttattgaatattcatgtctgccttgtgctagttttttgcaaaatgcatggagctgacagtctagagaaagggcaaacaattaataagtgagaaagttagtatgaaaattacagattgacagtgccatgaagaaacagaggatcactgagccaggaggagaattgcaactttggattgtgtggtcagagagggctcctctgaggggcgacacataacatgatacttgaaggaggaaaggaggaaacgtggccagcactgcagagagccacaggaagaatattccagcagaaggatcagcatgttcaaaggccccagggtaggaaagaacagcatgttacaggagctataagaacacaggggtggccagaaggcagtggggaaaggaaaggaattgcaggctgcagaagtgggcgggggagccagatgatgtcaaactcaatatgccatggtaaggagtttagattttactctaagatggaaagacagggataagcaggggaataaagccattccattgccttttaagaagagcggggccaagtgcagtggctctcaccggtaatcccagcactttgggaggccaaggcaggagatcacttgagcccaggagttcgaaaccagcctgggcaacatagtgagacctccacctctatttttttttattttatcttatctattttattttatttattttgagatggagttttgctcttgtcgcctaggctggaatgcaatggcgccacttcgactcaccgcaacatctgcctcccaggttcgagtgattctcctgcctcagcctcccgagtagctgggattacaggtgcatgccaacgccaccatgcctggctaatttttgtatttttagtagagatggggtttcaccaggctggtctcgaactcctgacctcaaacgatccacctgcctcggcctcccaaagtgctgggattacaggcatgagccaccgtacctggcctaatttaattaaaattatttaaaagacgaagaagaagaaaaagaagaagaagaggaggaggaggaggcggcggcggcagcagcagcagcagaagcagatcagcattgtttggagagcagaatgcaggaggcaagtgctgaagcacagcctggctggactattatagacagagctattataataggagtcagcacactggctcatccaccaaatccggcttgctgcctgatacagtctttatacggtctgtgagcatagagttgtttttacatttttaaatgtttggaaaaaaaatcaaaagtagagtctttttatggcatatataatttttataaaattgtaaagattcgaattccagtgtctgtaagtcaaggtttcctggaacacagcatcacccatttgcttttgactctggctgctttccttctgtagctgcaggttaagtcggtaacagaggctgtatggcctgcaaagcctcaagtatttactatctggacttctatagagtaagtctgccgactctcagtctagatgatagaagaggtaggctggcctagagaaatggcagaggaggtgctgggaaggaagattcgagatgtattttgggagccttgcctgagggtttgaatgagatgagtgatgaagaagtataaatggaaggtaagttgtaggtttagggcatgtgtgttatttgctgacatgggaaaggctggagggagaaaatccaggtccagccccatcttttctcctcactaacactatcagttagctttgctgtgcaataaatcacccagcctgggcaacatggtgagactcgcttctagaaaaaacggaaaaaaacaaaataaaacaaactagctggttgtggtggcacatgcctgtggtcccagctacttgggaggctgagttgggaggatcgcttgagcctgggagatagaggttgcagtgagtcatgtttgtgccacagcactccagtctgggtgacagagtgagaccttgtctcaaaaacaagtaaataaaaatcacccccaaattcagtggtttacgacttatttctcatgattctgaggtcaagctgagcatttctggtctgtgctggctcaagtagggctagatgatttaggatgtcatcacttagatgtctgagggttggcctggtgtcagctggggccatggagatgcctgggcctggtgactctcatcctccagagggctaacctgggctctcattcacgcagcagtagcagaaggattccggacagcagcagaacaagccccagcacacagcatttcacaagcctcggcttgggccgtgctgactaatgtctcgtttgccaaagcaggtcatgtggccaaggcaagaccaaaggatagagaaataaattccacctcttgcagagaggagccaaaaactcacatggcaaagggctgtggaacaggaaagggaacaatgggcccatttttacaacccaccatgctaacagcatgacccaggcaagttatctaaagcttttgagcctcagtgtcctcgtctgtaaatgggtaaaataataactacttcatagggtattcataaagactagaaatagctggcacataacatagtagtagctgttttattgttatcatcataatgaaaaagttcagtccctgctgggcaaactcatatttcccaaactccagtcactcctgtgccacaaaaaaactttgtttttgccatatctgagcaccacttaagactattaaacaggttcacttttttttttttttttttttttttagacagagtctcgctctgttgccaggctggagtgcagtggcacaatctcggctcactgcaacctctgcctcccggtttcaagtgattctcctgcctcagcctcctaagtagctgggactacaggcgcacaccaccatgtcctgctaatttttttgtatttctaatagagatggggttttaccatgttagccaggatggtctcgatctcatgacctcatgatctgcctgcctcagcctcccaaagtgctgagattacaggagtgagccaccgtgcccagccccactctttttatttaaagaaattaatttcaggctgggtgtggtggctcacgcctgtaatcctagcacttcgggaggccgaggcaggcagatcacctgaggtcgggagttcgagaccagcctgaccaacatggacaaacctcatctctactaaaaatacaaaattagccaggagtggtggcacatgcctgtaatcccagctactcggggggctgaggcagaagaattgcttgaacctgggaggtggaggttgctatgggctgagatagcaccattgaactccagcctgggcaacaagagtgaaactctgtctcaaaaaaaaaaaaaaaaaaaaaaaagaaattaatttcaaaaggaagcatgaagcatgttaactactacaatgggaagtgactatcacctgtcctaaatagaaggcaataaatacatttatttattgtaaaataaatacagtaaacacaaagcagtggccgagcatgatggctcacacctgtaatcccagcacgctgggagcccaaggcaagggaatcacttgagctcaaggcaagggactcacttgagctcaggaggttgagaccagcctgggcaacatggggaaaccctgtctctccaaaaaaaaaaaaaacggctgggcacggtggctcatgcctgtaatcctagcactttgggagctgaggcaggtggatgacctgaggttaagagttcgagaccagcgtggccaacatggtgaaacccccgtctctactaaaaatacaaaaatcagccaggtgtggtggcacacacctgtaatcccagctactcaggaggctgaggcaggagaatcgtttgaacccaggaggtggaagttgcagtgagccgagatcacgccactgcactccagcttgggcaatggagtgagactccatctcaaaaacaaacaaacaaacaaacaaacaaacaaagctggatgtggtgactcacacctgtaatcccagcactttgggaggccgaggtgggtggatcacttgaggtcaggagttcgagaccagcctggccaacatagtctctactaaaaatacaaaaattagtcgggcatggtggcacatacctgtaatcccagctactcgggaggctgaggcacaagaattgcttaaacccaggaggtggaggttgcagtgagctgagatcgcaccactgcattccagcctgggcaacagagtgagactctgtttcaaaaacaaccacaaaccagggctagtaattctaactcacttctgctttccaaaagcagaatctgagggctgctctctcttttataaaaggaagatattcgaacaaaaggccagtgacaaaggctgtgttatctacagagattttcttccaaacagaatcagaaatatagaaaatggatacacttttttgcggtgtactccaatgttatttagagcagcacagcacagtacataaaattgtctcaagtcgtttaggaaatgctgaggctagaccagaaacaagagggagaaaatcgcccgtttaacaactttccccttcatgaagctcgagacacatataggacatggggcaaagacctggtgtggctcagggactttccacctcctagctgtgtaaccttgaactcacctgtcgacatttggaggcctggggattctcaagaaaaatgcagttaatgacagcttgcctgcctcacagggtcccttaagaaccaattgtgagcctacatgtcacaagccctcatagtctgtaaaatgctgaataaatagagcagattgtaaggctattccctgaggctaggcatgaggaggtgagctgtgaggaagggagaaccagctcattaaccaggggaacaaatgacagtgtgatggcatccctcccacatccatgggggcctctaaaatcaaggagccagccagtggtagggcctagagatgagaggactggtggcctctccaactgctttccagttccaggacctccagcttgtcaccaggacaaccaggcagccctcactccctgcacggcagctcaggtgtcaccccaggacatggaattgatcgagaggcctctgccccttcctttggtaggtttctttgctgaatgctcaagaagcagctccctggttaggaattccaagaacttctaactgacagggagtcccagctgtcccatcatggaaggcagccaccatatgtgtggagagactgtgaactgtgaactacacttacgtaaccctgaactcgagtcttgctcacaagacccagctcatgttccctgcgctgcgaagcttcccaggaatggtccgtggttgttctgtctactgttgcatttgacacagggctctgccaaggtattcaccacatctgcttgtatatccatctccccactagactctgggcaagcctccaactttcaaattattattatttttttgagacagtgacttgctctgttgcccaggctggagtgcaacactggtgccaacatggctcactgcagcctcgaactcctggactctagtgatcctcccacctcagcctcttatgtagctgggactgtaggcatgtgctactatgcctggctgattttaacagtttttgtagagacaggggtcttgcaattttgcctaggctggtctcgaacttttgacctcaagtgatccacccaactcagccttccaaagtgctgagattacatgcatgagccaccgtgcccggcctaaacctcccattttatgtttcctctgcccctggtctaactcagtgcctggtatgtggcagacacacaggtcagtgttacaaatgaccataccctcacactcgctgttccaaatgatggcttcttactaagaacctgagaatttctgcctgcgggttttgtctgggtgcggatcaggccaaagttccatggagttaacaccctggggcaacacttaagcaatgaaaaccagcagttagtggatgaatagcccagcacgggacaaccctggggcaggttctgcacagtcacctggccagacccagcagcactgagccctggctgtccacagcagtgactgctcataaccactctgccttctctttcagtctcacttcccctctaccatctcacgctttctgggtcaaagaaactactatcttggggtctgcttctgctggagctcaaaccaagacaactggctagttggctgattggctgtgtgaatgggcacgattagcagcaaagaaagaaatggaagcccgcgcgccggctgggccctggcacatgcgctgcccccacagtgtgtctagactacgtcggggcacgtgcacagccaacagatccgacacaggaaaaagcacttctcagctgtccccaccatcctgctatttgtcattccatccatctgctgtccccacgaaacgctcacccacgtcagctaaaatggtacactgggcttggaatcggctggggaaatgtcaggctgacagaacaggggggacaactgaaatagcaactgtgtggacggtggtggtgacacaaatctgcccctttgcgtagaaggcaggactcccagagctcaggaggcctcttgcggaggaattggtatgtggcgaaggctgcagggagggggccctgggactcaggggcagctagagcagggccctctgccctgagagctcttcaccccttcctcccagaatagaggagattgtccaaacatagaactcagtttgtttaaagtcattgtttatttttaaatgttcagttcgttttccaatcaatcttccacggtgcagttcaagaaaaatgtgtggattttcatgcctgaggtcagttgcaggatgtacctcgcagaacagcgtgtgcccctgcaagctggggattgagtgttttgttctgttttgttttctcagggtaaaggggtcattctaaaagcaggactgtttggatcttagaagattggatatttatttattatttaaatttttttcttttctttttttttttttttttgagatgaagtctcgctctgtcacccaggctggagtgcaatgggatgatctcagctcactgcaacctccgcctccccagttcaagcgattctcccgtctcagcctccccaaccagccgggattacaggcgtgcaccaccatgcctggctaatttttttgtatatttagtatagatggggtttcattttgttggccaggctggtctcgaacgtttgacctcaagtgatccactcacctcggcctcccaaagtgctaggattacaggcatgacccaccgtgccgggcctattttttttttaatttattttagagagaaggtctccctatgttgcccaggccgttctcatactcctgggctcaaatgatctgcccacgttggcctccaaaagtgctaagattacaggtgtgagccaccgcgcctggccatggatacttatacattctttctacaaatatttattgagtgcctgtgttgatctaggcactgtcttgagctccaggaagaaagcagtgagcaaattcaacaaaattccccacctcttcgagattacagacctgtgggagggctggacagtaaacaaatatatgtacaaatgtcaggagattttaagtgtgaagaaaagcacaggggccaggtgtagtggctcacacctgtaatcatagcactttgggaggccaaggcgggtggatcacctgaggtcaggagttcaagaccagcctggccaacatggcaaaaccctgtctctaccaaaaaatataaaaattagctgggcatggtggcggacgcctgtagtcccaactacttgggagagtgaggcaggagaatggtttgaacctgggaggcggaggttgcagtgagccaagattgcaccatcgcactccagcctgggcgacagagccagactctgtcaaaaaaaaaaaaaaaaaaaaaaaagggaagaagaaaagcaaaggaaagaaaatgcaatttgagtatttgagtttgggtggccagggaaggtgttccagtcatctcactgcatgctaagccacctcaagactaagtgacttgaaacaacaatcatttgcttatctctcatgattctgtggactaactgggctcagctcggcagtacttttgttctatgcagattttctctgcagctacagtccactggcgcttggccaggctggaacggccgggatgcctcacttacatgtttggtgtcctggcagggatggctggggggatgggctcagtgggggtgtttggtcaactgggctccccttccaggtagtctcagcacctttccctctccacaaggcctgtctatgtggcctctcacgtggtctctccatttggcctttccagcaaagcagccagacttctttacatgacagcttggggctcctgcaattcagaagcagaagctgccaggctgtgtcaaggcttaggcctggaattggcagggcatcacgcctgccacgtcctgtttagttgaagccaggaccggctgagatcccatgtgggaggaggccacacaagggaaggggtgctgggaggcctggctccttgcgggctggccacccatgcctccctgaccgtgcgctggctaagcagagaccaggacagaggaaggagtgggccctgcagcgctgaggggacacgcaaagtccccgagtcagggctgtgctgcaggagcagcaaggaaagaaacaggccactgtggcgggagctgaacagcagagaggaaagataaacgacgaggtcaggaggcagccagggaccagactgtcccggccacaggccacagagagggattcaggagttattcctagtgggatgagaagcaccggacctgccttgatccataactggtgggttctgaagctggggacatctccgccccatccccactgctgggttcgcatgctgcccagaacggccctgtttcaactgcagcccctgctcccagcaccctccggctgcctctctgcctgatggtctctctgtggcactcagcaccactgcatgcctgatattttactgatgtccctattgtcttgtttaccttctcactctagaatgtaaacctgaaacagacagggatgtctgtctgtttcatccgtaggcccacaaccattaaatagtatttgttgtaccaatgaactaaccagcccatctctgtaaccccagttggtgctaacactatattgggcctctagcaaaaactgcatgactgaattaatgcaacaacaacaacaacaaatacatatatatatatatatattttttttttttttttaagagacggagtctctctttgtcgcccaggctggagtgcagtggcgtgatcttggctcaccgcaagctccacctcctggattcacgccattctgctgcctcagcctcccgagtagctgggactacaggtgcctgctaccacacctggctaatttttgtatttttagtagagacagggtttcaccatgttagccaggatggtctcgatctcctgacctcgtggtctgcccccctcagcctcccaaagtgctgagattacaggtgtgagccaccgtgcccagccaaaaaaataatttttatagttccagtcaacttatctaaaagttgctttcaaataagcaattatccagggaaaatgaagaagaaaaaaaaagccttcaaagtagcccatgccatgaccgacagtcacaggacagcctctcattcacctatgatcctggtgtacttggtaagtcagttaccaagcagtcatagcctggcgagccctggattaaaggaggagaggcctggaacaagaaggaaaatgccagctgtcagtgaggggaggacagaaaactcaaaacacaaatgtggtcgggtcagcagggcgatgtttcagagcaaagcaatctagggctgcatggcagggacaagctggcccgtgggcctcagcagctctccaagctgtgccagcaaaccacctgacaacaggcgatatctgtaacaatccttacaacacttttcttttttttttttttttcaagaaacagggtctcatatgctgcccaggctagactcgaactccagggctcaagtgatcctacagcctcagcctcccaagtagctgggattacaggttagtgacaggtgcctggctaatttttttttttttttttaatttttattttttttattgatcattcttgggtgtttctcgcagagggggatttggcagggtcataggacaatagtggagggaaggtcagcagataaacaagtgaacaaaggtctctggttttcctaggcagaggaccctgcggccttcagcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcgacaggatcccaaggcagaagaatttatcttagtacagaacaaaatgaaaagtctcccatgtctatttctttctacacagacacggcaaccatccgatttctcaatcttttccccacctttcccccctttctattccacaaagccgccattgtcatcccggcccgttctcaatgagctgttgggtacacctcccagacggggtggtggccgggcagaggggctcctcacttcccagtaggggcggccgggcagaggcgcccctcaactcccggacggggcggctggacgggcagggggctgacccccccacctccctcccggacggagcggctggccgggcagcggggcgcctcacttcctagtaggggcggccgggcagaggcgcccctcacctcccggaccgggcggctggccgggcggggggctgacccccccacctccctcccggacggggcggctggccgggcggggggctgagccccccacctccctcccggacggggtggctggcccggcagaggggctcctcacttcccagtaggggtggctgggcagaggcgcccctcacctcccggacggggcggctggccgggcggggggctgacccccccacctccctcccggacggggcggctggccgggcggggggctgaccccccccacctccctcccggacggggggctgacccccccacctccctcctggacagggcggctggccgggcgggaggctgatccccccacctccctcccggtcggggcggctgccgggcggagacgctcctcacttcccagacggggtggctgccgggcagaggggctcctcacttctcagacggggcggctgccgggcggaggggctcctcacttctcagacggggcggctgggcagagacgctcctcacctcccagacggggtcgcggcctggcagaggcgctcctcacatcccagacggggcggcggggcagaggcgctccccacatctcagacgatgggcggccgggcagagacgctcctcacttcccagatgggatggctgccgggaagaggcgctcctcactttccagactgggcagccggtgcctggctaattttaaaactattttgtagagacagggtcttgctatattgcccaggccggtctcaaattcttggcctcaagcaatcctcctgtcttggcctcccaaagtgctgggattactggtgtgaaccaccatgccggtctggagtcattcttggctcctctctttttctcagtactagggtgactgtataattcattatataaacctgaacttccccagacaaataagttgtatggtctatccattaacccactccaatccatcagcaaatccagttagctctattataagagacatatccagcatccggccatttctcacctcctccactatcatcctggtccaagcattcatcgtgtcctgcctttatctttgcaatggcctcctagttgatcccccacttctagacttgccttttacccccaaatctgttttcacagcagccagagtaagcccgttaaaaataagtgagatcatgttactcctctgctgaaaatactcggcagttcagaggaaaatcaaaagtctttaaaatggcctacagcagcagtccgtttcctgcaaccgctctgacctcattcacatgttccccatctcttctcactccacgtaagctacaccagttctcgcgctctccaggtaagtcaagcacactcccacttcagcctggccttcgactttgctcttccccctgcctggaatgcttcccacataaggacagggcttcttctttcattcctttctggtcacaggtccctgactcctgtataaaaaaatgacatcacccactggctgctctgaaaagccatctttgcattgttccttgtccggctccttgctcgccgcagccgcctttaccgctgcggactccggacacttcatcaccacagtccctgaactctcgctttctttttaatcccctgcatcggatcactggtgtgccggaccatgtcagacgcagccgtagacaccagctccgaaatcaccaccaaggacttaaagaagaaggaagctgtggaggaagcggaaaatggaagagacacccctgctaatgggaaggctaatgaggaaaatggggagcaggaagctgacaatgaagtagatgaagaagaggaagaaggtggggaggaagacgaggaggaagaagaaggcgatggtgaggaagaggatggtgatgaagacgaggaagctgagtccgctaggtcaagcgggcagctgaagatgatgagaatgatgatgcctataccaagaagcagaagaccaacaaggatgactagacagcaaaaaaggaaatgttaggagggtgacctattcaccctccacttcctgtctcagaatctacatgtggtcacctttgagtattgaggcccgctaacccacccactgcgggcagtgccacccgcagatgacacggcccacccgcccaccgagggcagtgccacccgcagatgacacggcccacccgcccaccgagggcaatgccacccgcagatgacatgcgctctccaccacccaacccaaaccatgagaatttgcaacaggggaggaaaaaagaaccaaaacttcccaaggccctgcttttttccttaaaaatactttaaaaaggaagtttgtttgcattttttaatttacattttatatttttggacatattgttagggtcagccatttttaatgatctcagatgaccaaaccagccttcagagcgttctctgtcctgcttctaacgtcacttgtgatgtgaccatgttcgttataatctcaaaggagaaaaaaaccttgtaagacaagcaaaaacgacaacagaaaaacaatcttattctgagcattccagtaacttttttgtgtgtgcgtacttagctgtactataagtagttggtttgtatgagatggttaaaagggccaaagataaaaggtttcttttttttccttttctgtctatgaagttgctgtttatttatttatttattttttgcctatttgaggtatgtgtgaaacaatgttgtccaacaataaacaggaattttattttcctgagttgttctaacaacaacaaaaatgacatcagctgggcgcggtagctcatgcctgtaatcacagcactttgtgaggctgtggcaagaggattgcctgaggccaagaattcaagaccagtctggacaacatatcaagaccccatctctccaaaaaatacatacaaattagctgggcatgggagccacttgggaggctgaggcaggaggatcctttgagcccaggagttcaaagctgcagtgagctatgtttgcaccactgcactccagcctgggcaacagaccaagaccctgtctcaaaaaaatcaaaacaaaatgacaccaatctctatcaacatcacctccacctcatcccagctctccttctcttacatggtaaattaaattttctaacaatggctacagttatgtatgttcccacaagttcttctagaaccattcctcccgtcaagagagttttcttttttttttctttttttgagacagggtctcactctgtcacccaggctggagtgcaatggtgcaatctcatttcactgcaacctctatcttccggttcaatcaattctcatgcctcagccttctgagtagctgggactacaggcacgtaccaccacacccagctaagttttgtatttttggtagagatggggtttcaccatgttggccaggctggtctcgaatcctggcctcaagccatccacctgccttggcctcccaaagtgctgggattacaggcatgagccaccacacctggccaggagagttttctttctctcgccttgaatatgaaccagcctttagtaactggcttctaataagcaaactgtgacagaagcaacgctgcaggacttttgaggcccgctcttaatttgtgacacagcctccacctgactcttcctcttaggaccttctcctttggaacctaccacgtccttggagcccaaaccagcccacacagagaggagaccataaggagaggtccatgtggagaggaattgaggcccctagccaaccaccagcatgaactaccaggttcacgagagaatgggccttcagatgaagcccaggccccagcctttgagtctttcagctgaggtcccagccatggtggggcagggaaagctgctcctgttcccctatgctaggccctgtccaaatctttgacccacagaatccataagtttgggcccatctagttgcacggtcatagtaaccagaacacctcatttaatttttctctatagagtctaacataatgtgtatttacttgcttctctattgtctacccacacccccctccaagagaacgtgagttccttgaaggcagaaacttttgtctattttttctagcctcagtatctagaaaagtacctagcacacagtgagcacttgaaaaatatttgttgaacaaatgaattaaagaaaactgctaattaaagaaaactgctccttactataattcgcaacaccttctgctgaggcatgcgaccttttcctgaagaaagtgttctctggtgtgttttggaccagctccctgctaaaaaatatctcttgtcagccatctggaaaatgataaagttggatccatacctcccactatacaccaggaaatagtccaagcggatcaaagatttatacatggtaaaatgaagccattcaagtcctagaaaaaagccccgtagcattctgatgtcgccttggagtaggaaagcctttctagctacgactcagtctccagcagccattaaagaaaaagatgggctgggtgcagtggctcacacctgtcaccccagccctttgggaggccgaggcaggccgattgcttgagctcaggagttcgagaccaacctgggcaacatagcaagacatctctactcaaagaaaaaaaaaaaaagaaaggaagaaagaaagaaaaagatggatcaactcaaagtacataaaaataaaaaacttctgcttggtcacaacaacaacaaaacagaatgagcaaaatcaggccgggcgcggtggctcacgcctgtaatcccagcactttgggaggccgaggcgggcggatcacgaggtcaggagtttgagaccagcctggccaacagggtgaaactccatctctactaaaaatacaaaaattagccaagcgtggtggcgggcacctgtaatcctagctacttgggagactgaggcaggagaattgcttgaacctgggaggcggaggttgcagtgagccgagaccacgccattgcactccagcctgggcgacagaacaagactccatctcaaaaaaaaaaaaaacaaaaacaaaaacagaaaaaccaaagaaacaaaaaacttctggagattaggcagaaaaaaaagaccaagctaggcagaaacccagtgggaaaatggacattcaggcaggcagttcacagaaaaggggactataaagtcagccctctgtatccaagagttctacattgtggattcaaccaacgacaggttgaaaatatttggggtcaggagcagtggctcatgcctgtaatcctagcactttgggaggctgaggtcggagaactgcttgagaccagcctgggtaacatagtgagaccctgtctctacaaaatattaactgggcgtaatggcacatgcttgtagtcccaacttctcaggaggctgaggtaggaggatcacctgagcctgggaggtcaaggctgcagtgagccaagattatgccactacactccagcctggacaacagaatgagatcctgtctcaaaaaaaaaaaaaaaaaaaaaaaaaaaaaaaaaaaaaaaaaaaaaggaaaaacctaataaaaataatataaataaaaaacaacaaagcataactactatttatatagcatttacatagtattagctattataagtaatgtagaaatgatttaaagtatatggaatggctggaagtggtggcttatgcctgtaatcctagcactttgggaggccggggcgagaggatcacttgagttcaggagtttgagacaagcctggaccacatagtgagacctcatctttaaaaatacacatatatgtgtgtgtgtgtgtgtgtgtgtatctatgtatgtctatatatctatatctatatctatatctatctatctataattaggccatatctatcaacattataaaaaccagcaacttacatcataatgtgccaaacttcctgatatattttgaaaagatccccaaaactcctagaagttttatatctatatctatatatatatatatatatatatatctccatatatatatatatatatctccatatatatatatatatatatatctccatatatatatatatatatatatatatatggacgtatatatatacacacacacacacatatatatatatggaaggatgtgcgtagtttatatgcaaatactatacctttttttttttttttgagatggggtctcactctgtcacccaggttggagtacagtggagcaatcttggctcactgcaacctctgcctcccaggctcaagcgatcctcccacctcagcctcccgagtagctgggactacaggcctgtgccaccagcctggaaaattttttgtatttttggtagaggtagggttttcccatgttgcccaggctggtcttgaactcctgagctcaagtgatctgcccgccttggcctcccaaagtgcggggattacaggtgtgagccacggtgcccagccagtactacaccattttacatcagggacttgaacatctgtggattttggtatctgtagcggtcctggaaccaatcccacgcacatagactgtacaaatggcccttaatcatatgaaaaaacattaactctctctcaaatataacaaaaatataaaattataccgaaaacctatttcttccatatcagattggcagacatcccaaaccatagcaagacaacactggcagggtggtgaggtcacaggcactctcacacatcacaaacaatacaacctctgggtagggtaattaggctgtatctatcaacattataaaaaccagtagcttacatcataatgggccaaacttcctgatatattttgaaaaaaacccaaaactcctagaagttaggcagagaaaaagaccaacaccccagtggaaaaaggggcgttaaagcagttcacagaagaaggaactacaaatgacccttaattgtatgaaattgttagctctaaccattgcatttctgggaatttatcccacagatatatttgcacctatatgaaatgacatatgtatattactcattgtagcattctccatagtagcaaaatattggaaataacgttactgcctatcaatagaagactgatagcctaaattatggcacatccatataatacaataccagatagctgtaaagaagaatgaaaacacttttttttttttttttgcgatggagtccactctgttgcccaggctggagtgcagtgtcacagtcttggctcactccaacccctgcctcccagtttcaagcgattctcttgcctcagcctcccaagtagctgggattacaggtacacaccaccatgcccggctaatttttttgtatgagaacacttttttgtactattttggaaagaaccactagatgtactattaaaagaaaaatgcatatacacctactatgtacccacaacacttaaaatttaaaattaaaaaaaagaaaaatgcaaagttccaaacagtatgtataatatgctatctgctaattaaaatgctaaaagaagaagaaacagtggacagcaagaatacacacattcatgtttgcttatatatgggtaaagaaactcaggaaagttacaggaggagctaataacagtggttaattacaatggtagaggagaggcttggcagataagggactcgtttgcagatatgactttcctttgtgtacatttctatatattattttacttcttctgaaaatgccacataatttgcaataaatgattcactccttagctccaaaagcaagtcctttatcaaaatgcaaatgttccagagggatgtagccagattctgtggaccgccgtctttttcacccttaagaatccgtcgctatgatttctcttcctctgcttggagacctttagagagccagcctgcagctgctcagagcattgactactaaacagctcacagttgctattgctgaaaatgcccggtggttatgccttgcctgaccaggggtagcccacagctgatgacaggcccccttgcctcaaggtgggacaacttcggtggtgccattcatatccagagctgcctggaatcaggccgaggctggacatcagccgaccccgcatctttgctgagtttattcctctgctgtacttccctcgcttccctcacctccttcttggtttctcctgagagcctccctcaataaatcacttaccccagaatccttgtctcagactccgcttctaggacccaacttaagacattcacaaaataaatcacattgatggaaaacagatcccattctccaaaatgaataaccagtaggcacttgtgactagcacaagcatcagcatatccacatggtgctaaactaacaccaacccaaagcagatagtgctgggtggactcggtacaagttaatagctcatgggtctccatccccaacaccttcagacccaaggctccagggctgccagcctgagaaccctaagtcatgattttgggcactttggctggatttcctagcaactggctgagagcaggacaggtaaacagagttgggaggaggaagcaaaaaaggctagagtggacatcagttgactttgcctgccatggtagagactttcagtcatccaccataatccatccccattctgctgcacagaagtattgtggctgagacacctgcttttctccacccctctagttaatgtgactaaattctccctatggaatgggaatggaagggccatacccaggccagtgtcttcaggtaggggctgtgacccttccacacctgtaccagacacaatcatcatctcactgggttttgccagctttcaggtctatgtgctgaaagctgcttacagctaacctctgcagattttcctggcacaggaggcatgcttggccagtgcacagggcaagttggaagggccctaatgtcagcagccttcaaccaatgatggatggaaagttgcagacagtgtcctatgcatctgcagtgggataactctgagacgtgtgctgtactgcctcctagagggcccagggtgattaagcaccagttacccacagcagtaacttccttgattctgttccccacatgggcacttttcttcctgtcacacctccccaatcccctgcagatactttctgggattgcttcctaaacaatccacttgaactttttttttttttcttttttttgacatggagtattgctcttgttgcccaggttggagtgcaatggcacgatcttggctcactgcaacttccgcttcctgggttcaagcaattctcctgcctcagcctcctgagtagctgggattacaggcgcctgccatcacgcctggctaatttttgtattttcagtagagacggggtttcgccatgttggccacgctggtctcaaactcctgacctcgtgatctgcccgcctcggcctcccaaagtgctgggattaccggcgtgagccaccgtgcccagccccacttgaactttaatccttgcctcggaattggcttctggggaaaccaaaaatatattaaaaaaagagagaccaggaccttaaaaagagcccaagttgttgagctccctgccaagtcacccccaggtatctctgcccaccagcttgcatgagccagatcctcagtgcaggtttttccaatcagtcatttgttcttccacccaacgctcaagatttgcttcttcaagacaactctctgatcagctgagacccatagacacccagcttctaccacacatatgatggcattatcctagggcatggcagagcaacgcaagggaaaactctgggcccccaagtgatgtcatggaggagaactctcaacccagaactactacgtgagaaacaacgctctctcttctttaagccataggtgtgttgggaatctttgttacagcagcacgcctgatcttttgttttgttttgttttgttttagagatggagtcttgctctttcgccaggctggagtgcagtggtgcgatcttggctcaccatgttggtcaggctggtttcaaatccctgacctcaagtgatcctcccaccttggcctcccaaagtgctgggattacaggtgtgagccaccgcacccggcccagccatgccttgtcttaactagcatagccgcccaacgtccacttcttttggccatgttgtcctgattctgctggagaatccctttcccactgctcccagaccagtggtgtagctgacctgcgctctctccactcaattcaggggagggaggggtttaggcctgggctaagagagctgcacatttcccagggcacagtgattagttgagggtgggtcccagagccaaatctgcccaagatcttagcctgaaagagaaaccctcctgctgagtgactgcactgtgaggcagaagtccagagctgtgggtggccatccagcctccatttgcgcctgcctgagaaagaagccaccatgggggaaatcgagctaaaagacggagagggaggtaagagaggatgacatcacataagcaccagatctggccacccctgaaactggaacaaccctaagctttacagctactacattcccttttctgctgaagttgttttacactgggtttctgtctcttgcaaccaagagctctgttaaataaaaacctgaccctaaggagaacgttagctggttcacaattccctgtgcaaaacaggcacaggtcagctgccccagcctgtcgtttggatattcctttctaagaacgctcacttttgttgtctacatgacccagataaccaaggagaaagcaaatcaaccgccttccagcggcgccttccttggcagcaagtgctaagagagaacacaatgtgagtactctgccctctggagtcagggttgatcctcagcacttgctgtcctgggaggctgcacctgtgacacttgagtgccaggttcaacccctactgctgctgctgctgcctgaatggggccatttagactgttgagtgctacagcctcagcccaggaacccggagcttcacatgaggcagagcagggccccagggtccctgaaacttgccagttcaaacagcagaggggtgaggactccccagtcagccctggtctcatacctgcctctgcatggtcccagtccagcctgaggcctttgctttcttttttgaagggaaggtgaggagagagggggaaaatagaggtgttctgactagacttaggattcctggcctctgcctctgaccgccagaggacagcctctgcagttgcctcatctactcatgaaaacaggcctgtgaccccaggggtgctctgaggattcttccagaaaacatctgcccagctaggactacctagctcactgcccaaaaagggttcatttcctttccttctgaaacaaaagcgcttaattggaagagaagcattgactcaagctataggatatgccacttaaaatgtccagatcttggcacaaggcctggcgcacagtgtgggagagaaggagagaagaaggtggaaggaaaggagggaggggaaagaggaagcagggagggagaaaataagacaagggcctcctcatctggatgcttccctagaccaagaagtggcccaggtggtgcccaggggacagggagtgggcaataaaagacaatggggtgtaggtgatagggtgtagatgatcagggtataggtgatcaggatgtaggtgatggggtgtagatgactggggtatagatgattgaagtgtaggtgatggggtatagatgatcgaggtgtaggtgatggggtatagatgattgaggtgtaggtgatggggtgtaggtgatgggggtcaaggtgatcaaggtgtaggtgatggggtgttggtgattggggtgtaggtgatcagggtgtaagtgatggggtataggtggtggggtgtagatgatcggggtgtaggtgatgggtataggtgatggggtatagatgatcaggttgtaggtgatcggggtataggtgatcaggttgtaggtgatggggtgtagatgattgggatatagatgatcgagatgtaggtgatggggtatagatgatcaaggtgtaggtgatggggtatagatgattgaggtgtaggtgatggggtatagatgatcgaggtgtaggtgatggggtatagatgattgaggtgtaggtgatggggtgtaggtgatgggggtcaaggtgatcaaggtgttggtgatggggtgttggtgatcggggtgtaagtgatgaggtataggtggtggggtgtagatgattggggtgtaggtgatggggtgtaggtgacgggtataggtgatggggtatagatgatcagggtgtaggtgattggggtataggtgagcagggtgtaagtgaaggggtataggtggtggggtatagatgatcaggtgtaggtgactggggtttgggtgatggggtgtaggtgatggggtatagatgattgaggtatcggtgatgggggtcaaggtgatcaaggtgtaggtgatggggtgttggtgattggggtgtaggtgatcagggtgtaagtgatgaggtataggtgatgcagtgtaggtgatcagggtataggtgatgaggtgtaggtgatggagtgtagatgattgaggtgtaggtgatggggtataggtgattggggtgtaggcaatggggtgtaggtgatcggggtcaaggtgatagaggtgtaggtgatggggtgttggtgattggggtgtaggtgatcagggtgtaggtgatggggtataggtgattggggtgtaggcaatggggtgtaggtgattggggtcaaggagatagaggtgtaggtgatggggtgttggtgattggggtgtaggtgatcagggtgtaggtgattggggtgtaggtgatcggggtgtaggtgaccagggtataggtgatcagggtgtaggtgatgggatgtaggtgatcagggtcaaggtgattgaggtgtaggtgatgggatgttggcaaccagggtgtaggtgatcaggatgtaggtgatggggtgtagacgatcagggtgtaggtgatgggctgttgctgaccagggtgtaggtgatcagggtgtaggtgatccgaacttcctactcaattcaggcaacagctcccagcctgaggcaaataccccccgaggcagtcagggtctcacctcccatggctctgacgcaggcctccaaggtgaggagatggaggtagcagaggtcacttcactcagctgtcacacaccctgagggaactcctgtcactgttatcccacctgcaagtgaggagccagcatttctcatgctccagggttggccacagagcccattcaagggagggagaagagccttcggccagcgcatcctaaccgcagaaagccaagacctctgcagaaaaagagaccaggcccataaaaagagatccatgagttgagttccctgccatgccacccccaggcatctctgcccaccagcctgcatgagccagcccctcagtgcaggtttttccaattggccgtttgttcttccacccaacactcaagatttgcttctcagcctggacaacatagcaaaaccccatctctacaaaaaatacaaaaattagctgggcatagtggcacacacctatagtcccagctactcgggaggctgaagtgggaagattacctgagcctgggaggtcaaggttgcagtgagccatgatcatgccactgtactccagcctgggtgacagagtgagaacttgtctcaaaaacaaaaaaagagaggaagatctgcttcttcaaacccacacaactaatataaagtaatcaacctccccacctcaataacctgaagttaaacatcacacaataagccctgaacagagagctgtaggtcaatgttccattttgcttttaaaagcttcacaagaacatttcatttattaaaatagtttctgtaaactctttcagaataacaaaattcacttgccttgcttaaacagcatttcaagtagaagtatttttatttcaaggcaccataaaatgatgatctctctaagaaatacctctccttccgtgtgtgaaaatccttgggggaaaaaaaaatcccacacggtgttcttggccatcaggatcatgaaaacaaactttggtgaatgtgagcaactgcgccagacaggacacaggttacagggcctgacgtcactaacggcaactgacaatcttggaatggaccctactgctgatgtttcaaaaggacacagaggtgaactggtcacttctaattaagaagagccagtggggtgggggaagctgaaaaccaaaaatccacgtagacatacgtggcagtgtgaacgtctgtcctccccttccttctcctcacttcctctcctcctcctcactcaggctggtattctcctggtgtgcggatgtcagcttgccctgcagaagggctgccagttttttagatgtctttttgagaaacgagctgcccggatgggcactgttcacgtgcaggtacaggtcctcctgggtggggcccgtgtagccgcaatcctcgcagacgtagagcttgtcccgccgctgcttataggcatactgctgctgcaccccatggattttcttcaggtgggactccagagagcagcgctgggtgaaggctttattgcagacgttgcatttgtagggacgaatgcctgaaaggatgagggacagacacagcatcggttggtcatggccaagccagaaccacccaactatgaagccagtaaaagtcatgccatgaccaaggattcatggcagcatgaggacaatggttacagcaggagagaaaactgtctacaaaaaatcatagcatccacctgagtaaacctaacacaaacagatgccaacatagaaaacaaacaaacaaacaaacaaacaaaaccaccacctgctttagggaggaagatttttattcttccaactcacataccttaatgttttcatattattgtgagcaaagtaaacttttaaaaaaaattaattcgggccaggtgcagtggctcacgcctgtaatcccagcactttgggaggccgaggcaggcggatgacttgaggtcaggagttcgagaccagcctggccaacatggtgaaaccccgtctctactgaaaatacaaaaaactagccaggcatggtggcgcgcacccatagtcccagcaactcgggaggctgaggaaggagaatcactggaacccaggaggtggaggttgtagcgagctgagatcgagccactgcactccagtctgggcaacagagtgagactccattaaaaaaaaattaatttgggtattcccagaaacagagcctgggacaaagattccagtacaagtagtttatttgagaggtgatcctgggaagaacctatagggcaacgaagatgtgaggcagggaggggtaggatccagtagaggggaagctacccagccagttacacggtggacaaccagggtccagtcctctgtgcaacgcagggagacagtgtggcacacaccttggcgtcatcccacccctccaggagctgaggtcagtcactggctgccggctgctcctgggtggttttgattctccatccccagcacttctgcctgccttgtgcagacagactgggctccagcagggaacccctcaggcagaggtgcaggggtggacagttgccacttggacaggtgtgcccagaaatggcagatgcccaggccattggcaggacactaaggcatttgtggcagttatgaaaatcatttccaaacaagatctcatgctggcattagaactgggctaacactggacctgccttctagctgagatatcacaggtacaatatagagcagggagctcagcctcatcaaagcattgccgctcctacctccatgattggtactcaccctgatgtgtatggcagaatgtcagataaagaatataaacatggactctgtgtgtgtgcaacagactatttagatgagcttggacagtacagtattttacatacttgccagagcctcagaatcacctggagaacttttgaaaatcttaactcacttctcctaagaccaactcagtgggtctggggtaggaatcaggaatccatttttttttttttttttgagacggagtctggctctgtcacccaggttggagtgcagtggcgcaatctcagctcactgcaagctccacctctcaggttcacgccattctcctgcctcagcctcccgagtacctggaactacaggcacccgccaccacgcccagctaattttttgtatctttagtagagacggggtttcaccatgttagccagaatggtctcgatctcctgaccttgtgatctgcccccctcggcctcccaaggtgctgggattacaggcgtgagccaccgcgccgggcccaggaatctatttttaacaaacgtcgctggatattccagtgttcaacttggctttcaagagccacaggttagggtctttaagattctggttgtggtcttgcctgaggtcaggtaaggtagtggcagggcagagacctcagagcacacccagctcagcaccctacactggcgaaggtcaccccttgagccagtggctgaataggaggctcacactcaaaaagaaggatgggacttaaaggtggaacaacagacgctggggactaccagagggcggacagagggaggggccaagggctgagaaactccccattgggtactacgcgcactacctgggtgacgggatcatctggacctcaaatctcagcatcatgcaatgtacccatataaacaaacctgcacatgcaccccctgaatctaaaatcaaagttgaatttttttttttaaggttgagactggtatgtgacagaagcaagcacactaagcagaatctcacatgacagattctaggaaattcccgtaggccatatcagcaagttttattgggctttaagaaacgaattggctgggtgcttcacagtgactcacacctgtgatcccagcactttgggaggctgacgtgggcggatcacctgaggtcaggagtttgagaccagcctggccaacatggcgaaaccccgtctctactaaagatacaaaaattagctgggcatcatggcacatgcctgtaatcccagctactggagaggctgaggcaggagaattgcttgaacccaggaggcagaagttgcagtgagtcgagattgtgccactgcactctagcctgcgcaacagagcgcgactccgtctccaaaaaaaaaaaaaataagtaaataaataaataaataaatgaaattaagaaatcaccatagtaaggtttttttgttttttgtttttgagactgagactcgctctgtcgcccaggctggaatgcagtggcaccatctcggctcactgcaagctccgcctcctgggttcacatcattctccggcctcagcctcccgagtagctgggactacaggcgctcaccaccacgcccagctaatattttgtatttttagtagagacggggtttcaccgtgttagccaggatggtctcgatctcccgacctcgtgatcctcccatctcggcctcccaaagtactgggattacaggcgtgagccactgcgcccggctgtaaggtctaacttaggctctcaaagagaggttatggctgtgaaggagacacacgtcacaaaagcatggaagttgagagagggtgaatatggtactgggggtgcatggagcatgaagaggccactgccacagccacgagaccatcctagagcctagagacaggagggatgccacctggagaaacccgcagaccctgtacagattcccgggcctgcctcagggaccccaggcactaggtcaggggctgggactaggaagctgtagttttatttttaatattttattttattttatttttttgagactgagtcttgctctatcactcaggctgaagtgcagtggcataatcttggctcactgcaacctccgcttccctagttcaagcaattctcctgcctcagcctcccaagtagctgcgactacaggtgcccgccacaacagccatctaatttttttatttttagtagagaaggggtttcactgtgttggccaggctggtgtcaaactcccgatctcaggtgatccacctgccttggcctctcaaagtgctgggattacaggcatgaaccaccgtgcctggccctaatagttaccttttattaaaatataaaaaataggctgggtgcggtggctcacgcttgtaatcctagcattttgggaggccgggctgggtggatcgcctgaggtcgggagttcgagacctgcctggccaatacagtgaaaccccgtctctagtaaaaatacaaaaattagcctggtgtggtggcccacatctgtaatctcagctacctgggagaatgaggcacgaaaattgcttgaacccagcaggcagaggttgcagtgagctgagatagtgccaccgcactccagcctgggcaatagagcgagaccctgtctcaaataaatacataaataaataaacaaaataaataacaaaaggttactattaatagttgtttaaatttaaaagtaatataccccccagttttatggtgaaaaacagcagtaaattaaaaaaaataaaacagaaaagatccctttgtcaccccatgcacctctccttccctagtcctaactcgcaagtttcttgtgatccttcacattttctacaaattatatatatgtacatttttattttattttattttttgagaaggagtctcactctgtctcccaggctgcagtgcagtggcacaatgtcggctcactgcaacctctgcctcctgggttcaagcgagtatcctgcctcagcctccctagtagctgggaccacaggtgcctgctacaatgtccagctaacttttgtatttttttagtagagaccgggtttcaccatgttgaccaggctgatcttgaactcctgacctcaggagatccacctgcctcggcctcccaaagtgctgggattacaggcatgagccaccacgcccggcctacatatgtattttaagattaataaatatatgtcatctctgggtgttgcctgagcaggagaatttgttaaagcttccccaggaggctctagtgtgcagccaagtatgaaaacgagagttctaaataaatgcacattcacattggcatatgcacggatgtacatgtttccgaaacataaacctggggttctggagagacggtctggagggtggtgaaggcttacacttgccattgcgtccctgtctgtactacttcccatctccaaccacctgccagtattaataataataattttcgtactaactgtggttccttctgggcagtgtaatgacaatgaatctcccaccttttctcttaaaactattctaggatgggtgcatggctcacacctgtaatcccagcactttgggaggccaaggcaggaggatctcttgagtccaggagttcgagactagcctggcgaacatggggagatccctgtctttacaaaaaagtaaaaaattagctgggcatggtggcatgcccctgtggtcccagctactcaggaggctaaggtgggagagatcactggaacccaggaattcaaggctacagtgagccatgatcgcaccactgcactccagcctgggcgagagtgagaccctgtctcagaaaaacagaaaacaaacaaaccaaccctcaccaatcaaggttaagaaagttttaaggcaatattttaaaaatcaaaatatcgaatgaatggatgaactctgttggttccaggaaagaaaggccacatctttgggactagttttccacataggcaaggactacagactcctctcctaaggaatgcgcccgctctagctttcatgtttgcactgtaatgcagactttgtgttttcccggccttctgggcccatgcagcagcgagcagctggctcccactacccagtagatcaagcggcaaacccgatttccaaccttcagctcatcagagcagaaatccacccagagattagttgctcctttcactagttagtagaaataaccgactactgttttaaaacatccaaactaaaaatatggggaagctggcacacttaacatcaggctttaacctggatgcaacaaactcctggaggttcccatcctcaaaggtgatctgcccccgaggagaggccagccaggccaccactcagccccatgtgcacagggccacatctccttcctctcttcagtcaacacagcctctgagcatcttctatgagcagagtacccagcaaggcctggatagcaaacgctagaagattccaaagccctgcatcatgcaaacaagagagatgatggcagtgggggctttttttccagggagtgggtagaattagagcctggcttggaagaggagtgactcgcagacagagatggaaaggagacataggcccagaaagctccagttatggcacttctgacttttgccaaatgcactgctctgtgccccagcacttctgcttccccatttgctagtgtaaacgccaccattcacccctcattcactggtgcgggcactgccatgcggcagccccttggtgaccctttctaggcttgggaacaagcacctccctcccagagcacccccatcacccacacattcagggggacgtgggtggccagagaggagccctgggcaagacggactgatgccaaggcccctcccaccactgaggctcacccatcttggtgctctcacgcaaaggccaaccgtgcctgtgtctaaagcaggacatgggaactgaagagcaccacccatgcgctagacgtcattaacctactgacacccacacgactgtgagtccaaggccaccgaagagccaggctgcggatctgctgcttattaactgaaacgggggcggctgctccagcccgaaaggccgtttcctcacctgtcacaggggtgtcatagctcttgcatggctgctgtgaggattagccgagatagactaagttctcaatgggatacagctcaacataatgcagataagcctcattcgtaagctggctgctgaccagcctggccaatatggtgaaaccccacctctactaaaaaatacaaaaaaaatttagccgggcatggtggcgagtgcctgtaatcccagctactcgggaggccagggcaggagaatcgctggaatctgggaggcagaggttgcagtgagctgagatggcgccactgcactccaacctgggtaacggagcgagactctatctcagaaaaaaaacaaaacaaaaacataagctggctgctgggtacatgagtatttcgcagatttgtctttaaactgtacctatatgtatacttttgtacgtgttacttatttcacaacaaaaggaaaggataattttttaaaatgtggctggtggaggagaggggggactgctttcgccgtctgcccttttgaattttgtaccatcagcctgtcctacctagtccgaaaaatattgtttattgggttatcaaaaagggtttgttgttttccatttttttacccctaatagcaaatcaagcttcgtgccatacatcctcaaggaaaattctacactttggaactttctagttgctttccttgctatagctcaactgctcctttactgaactttatccgaaggtgaacttcagcgagaagatttttacaggcatgcttgtgggagtggacatttacggcagcctccccggaaggcaatttggcaatggccataaaaaaaaatcacactgtatctaccctttggcccagcaatttcacatcagggaaattatcctacaggaagactcacacagggaggcgaaggatatacaagatatactcatggtaggattgcctgaaatgaaagaaaggaaagaaggaaggaaagaagaaaggaaggaagcgaggaagaagggaaggaaagaagagagggaaagaaagagaaagaaagaaaggaaaggaaaggaaggaaggaaggagagagagagagaaagaaagagagaaagaaagaaaggaaagaaaagaaaagaaaaaagaaggaagggaaggaggaaggaaggaaggaagggaggaaggaaggaaggaaatctgcaaatggaaacaaatgtcatcaattgaggaataggaaaagtacagtccctcgatactggaaattttgtcatgatttcttttattattattattattattattttgagatggagtctcactctgttgcccaggctggggtgcagtggcaccatctcagctcactgcagcctctgcctctcgagttcaagcgattctcctacctcagcctcctgagtagctgggattacaggcgccagccaccatgcccagctaatttttgtgtttttagtagagacagggtttcaccatgctggccaggccggtctcaaactcctgacctcaagtgatcagcccgcctcggcctcccaaagtgcggggattacaggtgtgagccaccgcacctagctccaagatatatattatgtgaaaaagcaatatacattaaaaacttttgggaaaaaaattaaatggtggaactggggcttggcatgtgaagggagtttacatttttttctttccttttatctcctaatgaacatattacctttttagctaaaaagtaaattaagataaaatacaaattaaaaataaaacaatgaagcgagggtttgttaactggaccaggcaattccgcatgacagcattcaggccactaggggtggaggtgacttgactctttcttctccatctggcccactccaaacatctcccaatctgcatttttcccaatctagtcaatccttccctttgggctccaaacaaagacaccattgttttctcttctttaatcaagatgggatttgtgtgccttctcctccctctgaatgtaggccccgatggaagataaggacagaaggcgccctagagggtggggccggtgccccctccccacctccctgacctcagaattggaattccgcggatc

SEQ ID NO: 498 - DNA, 4431 bp, Homo sapiens
gagtcgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatgta

SEQ ID NO: 499 - DNA, 1801 bp, Homo sapiens
gctaggtcggctttaaaatcgatgcagagtaattgcagtacatgggtagttggatgacattaacatgagaaatgtgctgtagtcgtcatccttggaacaaacacgtccaattacagtgaaattctgtgccccttacccggctaatttgaacacagctcaccgccaaggcctcctccagcatggccagccctgggcagagatcgtcacgaatggatttgacgggaatggggctggggactgtcatgttgaagcccggtggagatgtgggacagggacctcgtttgttccagagcctgttccaaccctccctggcttttgtggcatgttttctatgccgtttgctgcaaggatgcgttgggcatggagtaacattcccgagaccgtcctgcagtactgcacgtgtgcgtgtctgtgctttggtttgtctgtgtgtctaccttgttttagagtaaaaaagtgaatctgaggccagatcatcagtctgcacctgcctctcctcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgccatggtcctagattgtggatatagggaaagcctggtgttacccatatatgaaggaatcccagttctaaattgttggggagcactacccctaggaggaaaagctcttcacaaagagttggaaactcaactattggaacaatgtactgttgacacaagtgttgctaaagaacagagccttccctcagtgatggcgcgtacttgctttgtaagtgatctgaagcgaggactaaaaatccaagcagcaaaatttaatattgatgggaataatgagcgtccctccccacccccaaatgttgactatccattagatggagagaagattttacatatccttggatcaatcagagattcagttgtggaaattctttttgaacaagataatgaagagcaatcagttgccactttaatattggattcccttatacagtgtccgatagacaccaggaagcaactagcagagaatttggtagtcataggtggcacttctatgttgccaggatttctccacagattgcttgcagaaataaggtatttggtagaaaaaccaaaatataaaaaagcacttggcactaagacatttcgaattcatactccacctgcaaaagctaattgtgtggcctggttgggaggggctatttttggagcattacaagatatacttgggagccgttctgtttcaaaggaatattataatcagacgggccgtatacctgattggtgttctctcaataacccacctttggaaatgatgtttgatgtcgggaaaactcaaccacctctgatgaagagagcattttccactgagaaatagaagtttgattaaaaatcaaccttgcttcatatcaaatatttaaccaattataagcaaattgtacaaagtatgtaggatgttttgttatagaggactatagtggaagtgaaagcattctgtgtttactctttgcattaatatataattcttttgactttgtttctcttgtgtagtggtaaaatggtagctggtgcttattgagatttgctgtatttatatcaataaagtatagtaaagcagtttgattttg

SEQ ID NO: 500 - DNA, 728 bp, Homo sapiens
ccttccggctggccccgctcggtcacccgcagcaggcgtgcagtttcccggctctctgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtcaaaaaaaaaaaaaaaaa

SEQ ID NO: 501 - DNA, 1659 bp, Homo sapiens
  misc_feature 1532: n = A,T,C or G
cgaggcgaggcgaggagggggagccgagacgcagcggccgaggcgggggcgcgggcgcaccgaggcgagggaggcggggaagccccgccgccgccgcggcgcccgccccttcccccgccgcccgcgccctctccccccgccgcgctcgccgccttcctccctcgcttccttccccacggccggccgcctcctcgcccgcccgcccgcagccgaggagccgaggccgccggggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacggnaagcatcttccagaagtgtgattgggaataaatatgcctctcctttgtatattatttctaggaagaattttaaaaatgaatcctacacacctaagggacatgttttgataaagtagtaaaaaaaaaa

SEQ ID NO: 502 - DNA, 1153 bp, Homo sapiens
ggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgca

SEQ ID NO: 503 - DNA, 3226 bp, Homo sapiens
aggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaaaaaaaaaaaaa

SEQ ID NO: 504 - DNA, 1575 bp, Homo sapiens
gagagaggaagcttgaagccaatatggagtccgtcagttgctccgctgctgctgtcaggaccggagacatggagtcccagcgggacctgagcctggtgcctgagcggcttcagagacgcgaacaagaacggcagctggaagttgaaaggcggaaacaaaagcggcagaaccaggaggtagagaaggagaacagccactttttcgtcgccacctttgctcgggagcgagcggccgtggaagagcttctggagcgcgcggagtcggtcgagcggctggaggaggcggcctctcggctccaggggctgcagaaactaatcaacgactcagtttttttcctagccgcttacgacctgcggcagggacaagaggcgctggcgcggctgcaggcggccttggccgagcggcgccgggggctgcagcccaagaagcgtttcgctttcaagacccggggaaaggatgctgcttcgtctaccaaagtagacgcggctcctggcatccccccggcagttgaaagcatacaggactccccgctgcccaagaaggcggaaggagacctcggccccagctgggtctgcggtttctccaacctggagtcccaagtcttggagaagagagccagcgagttgcaccagcgcgacgttcttttgaccgaactgagcaactgcacggtcagactgtatggaaatcccaacaccctgcggctaaccaaggcccacagctgcaagctgctctgcggtccggtgtctacctctgttttcctggaggactgcagtgactgcgtgctggcagtggcctgccaacagctccgcatacacagtacgaaagacacccgcatcttcctgcaggtgaccagcagggccatcgtggaggactgcagtgggatccagttcgccccttacacctggagctacccggagatcgacaaggacttcgagagctctggtttagataggagcaaaaataactggaacgatgttgacgattttaactggctggcccgggatatggcctccccaaactggagtattcttcctgaagaggagcgaaatatccagtgggactaagcagttgtcactctgttcttcactcctaccaaatactttccacgttggactttcccccttattgggtctcgaagtttacttattgtcacactgtgtatgttttcagcattttaaggctagagattgtaatgggctcctacttgtaatttccattaaattcgtaacaggtataacactaaagcatttttgctattttcgtcatgcctttgagactgagtcttactccgtcccccagcgtggtggcgcgctgggattacaggcgcgcgccaccacgcgaactcgtatttttagtagagacggggtttcgccatgttgtccgggctgctctcgaactcctgacctcaggtgatccacccgcttcagcttcccaaagtgctggcattacaggcgtgagccaccacgccagggctttatttatttatttttaccacaatagtttgaagcagtaagggggaaggagggtgattatattgctttgtaatggtttgtgatacttgaaacatcacggtgc

SEQ ID NO: 505 - DNA, 1498 bp, Homo sapiens
gggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttaaaaaaaaaaaaaaaaaaaaaaaaaaaaaaaaaaaaaaaa

SEQ ID NO: 506 - DNA, 3493 bp, Homo sapiens
ggccgagctggagctggaagaggacgaggaggagggggaggaagcggagctggacggagacctgctggaggaggaggagctggaggaagcagaggaggaggaccggtcgtcgctgctgctgctgtcgccgcccgcggccaccgcctctcagacccagcagatcccaggcgggtccctggggtctgtgctgctgccagccgccaggttcgatgcccgggaggcggcggccgcggcggcggcggcgggggtgctgtacggaggggacgatgcccagggcatgatggcggcgatgctgtcccacgcctacggccccggcggttgtggggcggcggcggccgccctgaacggggagcaggcggccctgctccggagaaagagcgtcaacaccaccgagtgcgtcccggtgcccagctccgagcacgtcgccgagatcgtcggccgccagggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaaactaagaatgataaattatcaatatagtttagtatttgctaattttactacactcttttgttatgtatatgtagggaagtcatagggattataaattcaatttgagtaaaatttaaaaccatatattttatgataaagggcctttaacttaagatggccaaagcactgatattatatatttgctgtaaagagaattataagagttttatttttctgatattaaaagttacttgataaagacttgtttccattaacttgaaaaaaaaaaaaaaaaaaaaaa

SEQ ID NO: 507 - DNA, 798 bp, Homo sapiens
gggctatggtggtggtggaccaggatatggaaaccaaggtggtggatatggtggaggtggaggatatgatggttacaatgaaggaggaaattttggcggtggtaactatggtggtggtgggaactataatgatttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttacttttgagaaagtcgtcccaaatgcattagaggaactgtaaaaatctgccacagaaggaacgatgatccatagtcagaaaagttactgcagcttaaacaggaaacccttcttgttcaggactgtcatagccacagtttgcaaacagtgcagctattgattaatggaatgtagtgtcaatcagatgtacattcctgaggtctttgtatctgttgtaggctttgtcttttcttttacttttcattacatcaggtatattggcctgtaattggggtagtggtaccaggaataaaaattaaggagttttaactttgtcatattgtgtagttcaggtttcctacatttagtacaagaaaatttacaaaatgcagtttcgaagtgtttccttgtgaggtaacagttaaagaggatcaggggaataaaattgatgattggtcaaggtactgtaagaaca

SEQ ID NO: 508 - DNA, 3063 bp, Homo sapiens
cttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaaaaaaaaaaaaaaaaaa

SEQ ID NO: 509 - DNA, 1499 bp, Homo sapiens
cctctgcgggcgctccgcggtgctgtccctgggcgcctccgtgctctcagccaaccgcctctgagagcgcccactcgagcgccccgggagccagaggcgagggtcctcgccgggacctcctgtgggcccaggggacaaaagtggctctcaatccagcacatgcacattgaagcaagttaaaggatttaatatgaagcacagaagcagatagtgccaaatagcaagcagtagttgttacacatttctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctctgtggcacagatcagattctgccccaagaaataaaatttcaaggttccaggcaccgatttctgcaccggagtacactgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttcaaaaaaaaaaaaaaaaaaaaaa

SEQ ID NO: 510 - DNA, 233 bp, Homo sapiens
tttttttttttttttttgttttttttgaggtcaggaacgtgttcaattcacctcttcatctgagccttgtgtctgtcatgtggtagcagctcagaaatataatcagcaaatgaatgggctcaacacacctttgtggcaacaagcaatcaaccagaacaactttaaacagacctttagtgactgaggtgtggtttaggacttcaaggttggatggcccaggcgggaaacagagt

SEQ ID NO: 511 - DNA, 1972 bp, Homo sapiens
gaattcggcacgagggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaaaaaaaaaaaaaaa

SEQ ID NO: 512 - DNA, 3566 bp, Homo sapiens
gccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaattaaatttatggggaaaagtttatttttaatattacttatagctgagtcagaattaaaggagggaattgtattgatactccaatacctaaatttcacaataccacttaggaaagctatttcaacaaattacagttttattgttaaaacagagtcttatttgagatgtattgctttatttttcaattaaaagtggttttctcctaaaaaaaaaaaaaaaa

SEQ ID NO: 513 - DNA, 928 bp, Homo sapiens
tcaatagacaggttgaggacatctgcctggagcaaggatatcaatgcttacaatgtgaagagcccacagaaaagttaccttttcccatcatcgatgataggaatcgggagcttgccatcctgtgggcatgctggatccagcagagaaggatgaaaagggcatgcctgtgacagctcgtgtggtgttgttttggtcctgataagaagctgaagctgtctatcctctacccagctaccactggcaggaacttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaatgtgttttcctgcagcaattccataaacacatcctggtgtcatcacagccaaggtttttaggttgctataccaatggttattaaatgaaaatggcactaaaagtttcttgagattcttttatagtctctggcttcagcaatcaatgccattcatacattcagcactctgtggtgctgttgacatatgtctgtatttcaaactcaaatctggtggactctgcgggtgtgacatgagtctatgttgaggtgacaaaggtgttcctccatcgagatgattcattttttacggcaacgtctcccgtccattgaaagggatgagtcactcctgtaattcagtagccgattaaaacagagtatttaagtggcgaagcaaaccacgtcttctaactgccgggaggtttccgcaaaggagattaagaggagggg

SEQ ID NO: 514 - DNA, 588 bp, Homo sapiens
  misc_feature 382, 392, 409, 493, 509, 512, 517, 531, 538, 543, 544, 583: n = A,T,C or G
gaacctttatgagccggctgccatctagtttgacgcggattctcttgcccacaatttcgcttgggaagaccaagtcctcaaggatggcatcgtgcacagctgtcagagtacggctcctgggacgcttttgcttattttttgtacggctttttcgagttggcttaggcagaattctcctctgagcgataaagacgacatgcttcccactgaactttttctccaattcgcgtactagccggacttgattttctggaaagattcagttgaggaacgggaacaaagattatgatagctttccgaccaccaccaacttcaatttcctttagctgcgtaatattcagctcccttgactgagcccctgaggtcgagtcatctccagctncagaagagcnccctgagatgcgactcnggactcgccggcttctcgcatttggcgtttacgatctgcctcgaaatgacccatgcttctcccctgagaactgcgagcggccgnctttagagagaccatnttnggagnaaccgtaaatccgncccacgntccgnngacgcctgggggtaatttcccgatccggaccgccaaccntcctt

SEQ ID NO: 515 - DNA, 896 bp, Homo sapiens
gtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtaaggacatgaagacagttcctgtcataccttttaaaggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagggcctttgaagcttactacagctcaaacttctgggctcaagtgatcctcagcctcccagtggtcttgtagactgctgatggagtctcatggcacaagaagattaaaacagtgtctccaattttaataaattttgcaatccaaaaaaaaagaaccatacgcaaacgacacaaacaacaccgacggaggccccatctgggggggggcggaacaaggctatgcaaagggggcaggggatataagtgtcactgacccgaattctggctcacagggggaaatgcgggccccaaggggcgaaatggaagcgggcaccgctatttctctcacaagggcaccagacaacaaggagagaccgcacacactgacgcacaggtggacatgcgcacaactcacggacagcgacatcggacgccacgcaggagaaa

SEQ ID NO: 516 - DNA, 433 bp, Homo sapiens
agaggagtcaaccctgaggaggaaaaagtagtatgatttgctggcgtcacccctctgctccgtgcgggcgcggcgaatggcaggtcccgaggtcgcagcttccactggcgcgggttgagttccctgttgcccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaaaaaaaaaaaaaaa

SEQ ID NO: 517 - DNA, 880 bp, Homo sapiens
  misc_feature 750: n = A,T,C or G
ggtcgactcctgtgaggtatggtgctgggtgcagatgcagtgtggctctggatagcaccttatggacagttgtgtccccaaggaaggatgagaatagctactgaagtcctaaagagcaagcctaactcaagccattggcacacaggcattagacagaaagctggaagttgaaatggtggagtccaacttgcctggaccagcttaatggttctgctcctggtaacgtttttatccatggatgacttgcttgggtatggagagtcggcttgactacactgtgtggagcaagttttaaagaagcaaaggactcagaattcatgattgaagaaatgcaggcagacctgttatcctaaactagggtttttaatgaccacaacaagcaagcatgcagcttactgcttgaaagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccaaaaaaaaaaaaaaaaaaaaaacgggggttttattgggggggggacaaacaggggtacgccacgggccatggccaatggcggtccgagcgcagctccttgtaccggggaaaccgcggccccatgaggagcgataatccggaagcggtagcggctagccgccgcgcaacangaagacagaaaggagcaagagaaggacaagggacaacaaaggcacaaagaggcgaacagacaaggcagcgagacacgcgagacagacggaagagacagaagagaagaaagaaggctgccaccacgcgcct

SEQ ID NO: 518 - DNA, 872 bp, Homo sapiens
gacttctcctagttgcagtcaggcttcatacgctattgtcctgcccgttagagcagccagcgggtacagaatggatttggaagagggagtcaccactggacctccaaggaagccacgtgcagacatctacaaccttcgatctcctgacgagtttatgttggccaaaaccaggctttgattgaaccaggatgaatgcgggtgtggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcatgttagactttgaaatttctaactgcctacctgcataaagaaaataagatcttgttaaatcaaaccaaaaaaaaaaaaactctcgaaacagagtctctccgggacctcggaaaacacccgggggggttcccgtgtgtggcgccagggccgacaaccggattagggggggcacgtcctaggtgcagacgacggactccaacagaaaagcgagttctcacaagtggcgggagagggcttcacctaaacaggaactctgccaaatcactgcgggcgtacatcgagagttacagctgcagcaacaggggcactgacttctggtttgaaccaaggaaatcactttaaacacccagtggttcttctcccgagggacaggcacagaagctggaagtgcacacaggggctcaaggggatgggctaatcccaaaggtgcctgatcgggcagaatcgaagtaacatgcacggtcacaaaacgtgtctaccagtcggt

SEQ ID NO: 519 - DNA, 764 bp, Homo sapiens
  misc_feature 9, 691: n = A,T,C or G
cttcgaacnccctttctcgggaagcgcgccattgtgttggtacccgggaattcggccattatggccgggaaccaggatgaatgcggttgttggaagtagaatatatatatacatataaaattggttgggagccacgtgtaccagtgtgtgttgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaaaaaaaaaccaaaaaaaatatctataaacacaaagaaaaacaaattcaaacttacacattatccaatcattctattattataaatatatgaaaaaaaaaaaaacttgggggcccgcttggcccagggggttttaaatctggaccaatttattcttggggcccaatttggggctcattttggccaattgcccctttaggggaggcgtttacaattcatgggccggtttttcaaacggtggtatttggaaaacccctggggttacccaatttttaaacccttgggaaaaaatncccttttttcacagtggggggaaattccgaaggccccgccccgtgaggccttttccatttggcccctctttgg

SEQ ID NO: 520 - DNA, 1035 bp, Homo sapiens
ggcccttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactaaaaa

SEQ ID NO: 521 - DNA, 711 bp, Homo sapiens
cttttttttttttttgcgaagtgggctcgtgggttggcagtatgagagttgtaatggcccgactgttgagtgagggggagcaggggatcccaacggcttgcgctgcctttgcgcagcagccggcgggcgagccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggaatttgctgacacaatatcttccgcctggtgctgggcatatcctaagaacttacaactttcctgtattatcctgtgtgagcagctgtcaccttattgggggaaaaatgcctgaaaattagggggcacttcaagtagatagcttctatttcctatatttgtcttatatacaagtatttgcttttatcaaaataattccaataaagcattttaaagt

SEQ ID NO: 522 - DNA, 829 bp, Homo sapiens
tgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgatttggtgtttgggttaattgcttctaagaaaagtttcatagtggactgtttagaagaagaaatgaacagatccagtttggattatgaaataaacacaaattaaaatttttgtttaaactgtcaacaaaacaaaagacccaacaacacaacaggggggcggaaaaataccctcgagggcccatttcgcgtcccgttttttgtcaaaggggccaaaaggagcgttaaaagaagcggggcgtaaactcggcgggaacacgccctgggtttgggagaactcttctgtgggggccttcgggcacccccgatttc

SEQ ID NO: 523 - DNA, 1970 bp, Homo sapiens
ccgagtggggctgaacttccggcctcaggacgcaggcgcgggccgctcatttcgctctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaaaaaaaaaaaa

SEQ ID NO: 524 - DNA, 719 bp, Homo sapiens
gctttcgcgtctgcggtgctcggagtgtggtacttctcctagttgcagtcaggcttcatacgctatgtcctgcccgttagagcagccagcgggtacagaatggatttggaagagggagtcaccactggacctccaaggaagccacgtgcagacatctacaaccttcgatctcctgacgagtttatgttggccaaaaccaggcttgattgaaccaggatgaatgcgggtgtggaagtagaatatatatatacatataaaatggttgggagccacgtgtaccagtgtgtgtgatcttggcttgattcagtctgccttgtaacagaaactggcgatggaatatgagaggagccctctggaaagaaaaggacagaccctgtgctttcatgaaagtgaagatctggctgaaccagttccacaaggttactgtatacatagcctgagtttaaaaggctgtgccacttcaagaatgtcattgttagactttgaaatttctaactgctacctgcataaagaacataaaatcttttacatctaaaaaaggaaaaagaaaagaaaaacttgtgggggggtggcctggaaaatttttaaacccttgtgtggggggggcccaagggagggaaaggggcaagggtcagaggaccggcgggaaggggggtttccaataaaagggggggacgggttggacacgaggttggggtcgggttaaagggcgggcgtaa

SEQ ID NO: 525 - DNA, 2334 bp, Homo sapiens
cagggccgagttgtctcggcggcgctgccgaggcctccacccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaaaaaaaaaaaaaaaaaa

SEQ ID NO: 526 - DNA, 1274 bp, Homo sapiens
atttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaaaaaaaaaaaaaaaaaaaa

SEQ ID NO: 527 - DNA, 418 bp, Homo sapiens
cttgcccgccgatatctctgccgggtgactagctgcttcctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaa

SEQ ID NO: 528 - DNA, 603 bp, Homo sapiens
gaaaagcggccagggtggcccctagctttccttttccggttgcggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaaaaaaaaaaaaaaa

SEQ ID NO: 529 - DNA, 922 bp, Homo sapiens
gcttgctgtggttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgttggaaacggggagcttcgtcgatttgtgtttacatcatcgactatgccaggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatatcaatgccaaagaaaaaaaaagactcggactaattctctcatcgagagttccctgggcccggcaggtattggcggggatcgaagccaccggggtcccgggtcccagtacttgagcatagaagaaccgatatcggataaaagtatgacaccgttctttgagggacaagggttgtgtcttacccgaggggaggctcaaaaggttgggaaatcacatgtaaacacccgggtgcctggttgtcaactctgggggcacacgttgcgttatcgcttggaagaccaattgtggttaaac

SEQ ID NO: 530 - DNA, 755 bp, Homo sapiens
ctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaaaaaaaaaaaaa

SEQ ID NO: 531 - DNA, 399 bp, Homo sapiens
gaaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaaaaaaaaaaaaaa

SEQ ID NO: 532 - DNA, 572 bp, Homo sapiens
cacgaggccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgccggagtgta

SEQ ID NO: 533 - DNA, 2110 bp, Homo sapiens
ctgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgactggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagccagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctgg

SEQ ID NO: 534 - DNA, 1410 bp, Homo sapiens
  misc_feature 4, 27, 29, 44, 57, 68, 98, 118, 146, 157, 177, 1248, 1350,1365, 1396, 1404, 1409: n = A,T,C or G
actnatccccccttttttgatccaggntntgttttaaaatggtncccttattttggnggatctgtttngtttccactctgtttactttttggcccatnaaaacgacatgctttcctgnccctgggctcccacgctgaactagttantccagttaagnaaactgacaaagagctctcntcccccgaccccagatgccaaaggaaagaggcctaggggaagaaggtggctccaacccctgctgttgtgaagaagccaggaggccaagaaagtggtgaatttcctgtttgagaaaaggcctaagaattgtggcactgggcaggacatccagcccaaaagggacctcacccgaaatggccccactatatcaggttgcagcagcaaagagccatcctctataggcggctgaaagtgtttttctgtgattaaccagttcacccagggcctggaccaccaaacagctactcagctgcttaagctagcctacaagtacagaccagagacaaagcaagaggagaagcagaggctgttggcccgggccgagaagaaagctgctgacaaaggggacatccttattaagagaccacgtgtccttcgagcaggaattaacactgtcaccaccttggtggagaaaaagaaagttcagctggtggtgattgcgcatgatgtggatcccatcaagctggttgtcttcttgcctgccctgtgtcataaaaggggagtcccttactgcattatcaaggggaaggtaagactaggacgtctagtccacaggaagacctgcaccactgtcgtcttcacacaggttaactcagaagacaaaggtgctttggctaagctgggggaagctatcaggaccaattacaatgacaggatgagatccgccatcactggggagggaaggccctgggtctcaagtctgtggctcagatcgccaagctcaaaaaggcaaagactaaagaacttgccactaaactgggttaaatgtacactgttgagttttctatacataaaaataattaaaataatacaaactttccttcaaaaaaaaagaaagaaattgacaaagaaaaacctttacaacttactggaatcttctgtctttgtattttacatgtgttgtgtgtgtggatatggaaagaactctggataattggtttaaaaatagtaagagcgtaaatccaatatttgtcagaaaagttaaaagtggtacaccttttagttccagtggaccagtatctttggggaatnaaaacagtttaaagatccttggggaaataaaagcctccaaatataacatttgaccaagttatataggccctattagattacccatatttaggccaaattggnccttggctttaaatngtccattaccacctggagccagagtcctaanaggcctgngcctng

SEQ ID NO: 535 - DNA, 624 bp, Homo sapiens
tttgacacccaagaccatcctttattgtagtattagttcatggtaactgcatgaaaaaacatttcaggaggaatttacaatttccagcttaaagaacttgcccaccaacataaccaatttatgaaagtcaattcattaaaaggtatagaacctcttgttgggcatgatggcaagggacaaagctacaacttggcctgtgcctttggaagctgaggcaggaggaccatctgagcccaggagcctgagaccagcctgggcaacatagagaatccgtctcaacaaaaaaaaaattttagccaggtgtgctgtgagctgtagtcccagctacaaggtgggaggattgcttaggcctgggtgattgaggatgcaatgagctgtgattgtgccaccacactccagcctgggcaatacagcaagactgtctcaaaaaaaaaaaaaaaaacccaaaaaaactcaaaaatgtaatgaatgatacccaatgtgccttttctagaaaaagttgccaaatatatctcttggatctgctgagcatgtcctctgatacataaggcaagcatgtttctacacccagtgttgatgccagttagttttcagaatccaaactgatggcagctactggtcctt

SEQ ID NO: 536 - DNA, 2546 bp, Homo sapiens
ttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcaaaaaaaaaaaaaaaaaaaaaaaaaaaaaaaaaaaa

SEQ ID NO: 537 - DNA, 1423 bp, Homo sapiens
ggtcgcggctgtggccgggggaagtgaatggttttacccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccttgtactcccagagtacctcatccacgctttcttctgtgtcatgtttctttgtgcagcagagtggcttacactgggtctcaatatgcccctcttggcatatcatatttggaggtatatgagtagaccagtgatgagtggcccaggactctatgaccctacaaccatcatgaatgcagatattctagcatattgtcagaaggaaggatggtgcaaattagctttttatcttctagcatttttttactacctatatggcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaattacttgtgaagaatgcatttaaagctattttaaatgtgtttttatttgtaagacattacttattaagaaattggttattatgcttactgttctaatctggtggtaaaggtattcttaagaatttgcaggtactacagattttcaaaactgaatgagagaaaattgtataaccatcctgctgttcctttagtgcaatacaataaaactctgaaattaagactc

SEQ ID NO: 538 - DNA, 570 bp, Homo sapiens
agcagtgacgtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaaaaaaaa

SEQ ID NO: 539 - DNA, 1685 bp, Homo sapiens
gtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtatatacttacaaaaaaaa

SEQ ID NO: 540 - DNA, 166069 bp, Homo sapiens
aagctttgaaaaatggactgggcacaggaggcggaggttgcggtgagccaagatcgtgccattgtactccagcctgggtgacaaagagtgaaactccatcttaaaaataaaataagctttgaaaaatgactgcatttgataatctttaagtttcttccctagtctaaaaccctaggttttatcccaaaccagctagatcctgccttagataaaggtccaggaaggaggcctctttgttttgttttgttaacacataccctttccctctgaaaagcagcttaattctaggcatcgggcacgagaggactgggcttttggcgtgcccaggttgagcattagatatacaccaagaagcaaggacagaggagatgggcaggaagtctctttggaagaacagaccaaggttatgataaggagatgtttgcttggcctgcaggccagttgcaagagcgtggttttagcctgttatcttgccggacttgttgggaggatgataataagggtgaccatatggtgaatggaccctagggccaaccgccaagtgcagctgtagacatttattttctggttcaggatagagatgttttatccagggtattcagttgtgtgagcggttctcagcttgttctcccaattctgattgatggtgactcaccatgtctttgtaggcctgatttgacgttgctttatattttagagatatttctgaaaagctggagcaaagcacaccttttacagcaagatctcacttccagtgacttccatcattatttcagagatacatttgcagggaaaaaagtttcctccttgaaataagaaaagtcttaatctatacgtctgtttctggaactaagaaggctttgggtctttgattctgctcacacaactcttgtaataaaacctagtcaatcgcacctgttatcggaggccgaggcaggcggatcatctgaggtcaggagtttgagaccagcctcaccaacatagtgaaatcctgtctctactaaaaatacaaaacaattagccaggcatggtaccatgtgcctgtaatctcagctactcgggaggctaaggcacgagaatcacttgaacccaggaggcagaggttgcagtaagctgagatcacgccactgcactccagcctgggtgacaaagcaagactccgtctcaaaaaacaaacaaaacaaacaaaaatcctagtcaaatggactaaatgtgaatggaattagcaattagcaacttctttacacataggttggactcatttttcttgtagagtgttattcctagttatgtccagaagttattcttttttttttttttttttttgtgagacggagtctcgctctgttgcccaggctggagtgcagtggcgcgatcttggctcactgcaagctccgcctcccaggttcacgccattctcctgcctcagcttcccaagtagctgggactacaggcacccgccaccacgcccggctagttttctttgtattttcagtagagatggggtttcactgtgttagccaggatggtcttgatctcctgacctcgtgatctgcctgtctcggcctcccaaagttctgggattacaggcatgagccactgcgcccggctcagaagttattcttataattgtgggagagttattcctataagatttaaggatcttgctgggtaccgtggcccacattttgtaatcccagcacttcgggaggccaaggtaggatgactgcttaaggccaggaatttaagaccggtctgggcaacacagtgagaacccatctctgcaaaaacagaaaaaattagctgggcatagtggtacacgtctgtaatcccagctacttgggaggctgaggcaggaggattgttgacactgatggaggaggattgctggagcttaggagttcaagactgcagtaagctatgattgtaccactgcactccagcccgggtaacagagctagacccttatctctaaaaaaaaaacaaaaaaactcaaaaaaattaaaaaaaagatttaagcgtcttcggccccaagttcatgcttgtttgtatattctctcattggaccccagcttgtggggaaatttttagattattgcaaatcctccctgatttcatgagagcttggagtcccttggggctttatgtgatgatattgttcaaagagctcatcagggctcaggcatctggtatgcggtttaagagactacaagtttcaccagtttatttgcaactcatcatactcagctaccaatgctgaaagcagaacttctgagcaaatcttgcagcgaatttctatttgttcctttaacaaaaacccaagtcatcaactatttcacggtgacccatcacgtaaaagcacatttatttatttttgaagctcagcttccttgaagttttgttttgttgcctacaaaagatttagtacaaaatccatgaaaataacgcatcagtgtaggctacgggtattgctgccacaaaaatttatacagtccctaagtgtgaaaagagctaaatgaaaaatgcccagtctgaggttgaagtgcgtgtcttgaaggtattttgcaaatttcacgttgccaatgagtaaacttctcaggtaccaggttctggttatggatggaatgactgcatttaattgtccttagtggggccttttgagctgttctgttaagaaaaaaaaaaaaaagattctaattatatccttccttcctcgcttctgtaactgggaatcctccagagattcgagcctacctaattaagtttctctttggtgtggaacatgtggaatggcagtgatgtttattaggttgatgcaaaagtaatcacaccaaactagtatgtggatgatgccaaaaaaaaaaaaaaaaaaaaggagtgtttggggcaaagcttaggattcttcgctgtaggatgaccatgcctcctggtccgtacaccccagtatctgggcaggcaggatggcagtggtgcctccatccgtcccatctggctgtgattagaagcaggtctggcccacacaccagtcttctttctctggggtccctgccgctttgcccgacagtgaggtcataccttcggcacgaggcccggctggaattcgcctgggtttgtctgtgcaactcaagttgacacatgaggttttcattaggtggctcactgggagcgggggtgccttgccggctacacatggaacagtcatctccctggattagggatctcgcctggatttcctggacacggatccatccagacattcccaggggacagaatggaaggcaggcaggagggtctgggattgctcacctggcctggagccagtttgccctcagtggtgggactggctgtgtgtgtgtgtgtgtgtgtgtgtgtgtgtgtgtgtgcgcgccaaatgggctgaactgctcagagttattttattttattttattttttatagaggcagggtcttactgtgttacccaagctggagtgcagtagtatgcaatcattgatcagtgcagcctcaaaatcctggtttcaagctatcctcccacctcagcctcccaaatggctgggactacaggtgtgtgcaaccccacccagctaagtttttttattattctttgcagagatgaagtctcactctattacccaggttggtctcaagttcctggcctcaagggattctccagccttagcctcgctaagtggtgggattacagatgtgagccactgggcacagcctgaactattcagagttaaataaacaaaaagcccaaacttctgcccagtgcctggggtctcctccttggctcatcactgcaaaagttatttcttggaactttaactcagttctttgttctcttgtggtcactcttccatttctctttcatcagcctctgcagctaaagtgacttttaccaagcaccagttggggaccaagattcacctttcctggatgccttttttgggggccaggatccctccatcagccctgattctggaagcctgcagctcttttccaccaggctccttgagacctttaagcccaattcccaaggtgtcctttgcatgtcaggaatcgacttccatcccctgcatcgtattagttctgtatcatccttggattcgttgacaaaatagtcacttaaaggccgggcgtggtggctcacgcctgtaatcccagcactttgtgaggccgaggcgggtggatcacttgaggtcaggagtttgagaccggcctggccaatatggtgaaaccccatctctaataaaaatacaaaaattagctgggcatggtggcaggcacctgtaatcccagctgctcagcaggttgaggcaggagaattgcttgaacctgggagtcagaggttgcggtgagccgagattgtgccattgcactccagcctgggtgtcctagtgagactctgtctcaaaaaatatatatataaaagaaaaaaaaatagtcaaaaaattgtctccaaagctgtattctgtttaatttttttttttttttttgggtagacatagggggtctcactttgttgctcaggctgtcttgaacttctggcttcaagtgattctcccacctccgcttcccaaagtgctgggattacaggcttgagccaccacacccagccacagctgaattatagaagcaggttgagaagaatggcttcttgaagtcactgtgggctgtgctacaccctgtgtgttccccttagctctgtggtccccacagcagctgtttgggtgatctcagagcttcctgcatcattcactggggaataaaggcttgatatcctcaagacctaagggatgtatttgactgatttctgcattttcagtgttcttttttttacactttaagttctagggtacatgtgcacaacgtgcaggtttgttatgtatgtgtacacgtgccatgttggtgtgctgcacctattaattcgtcatttacattaggtatatctcctaatgctatccctcccctctccccccaccccacgacaggccccggtgtgtgatattccccttcctgtgtccaggtgttctcattgttcaattcccacctatgagtgagaacatacggtgtttgattttctgtcgttgtgatagtttgctgagaatgatggtttccagcttcatccatgtccctacgaaggatatgaactcatccttttttatggctgcatagtattccgtggtgtatgtgtgccacatgttcttaatccagtctatcattgatggacatttgggttggttccaggtctttgctattgtgaatagtgccacaataaacatatgtgtgcatgtgtctttatagcagcatgatttataatcctttgggtatatacccagtaatgggattgctgggtcaaatggtatttctggttctagatccttgaggaatcgccacactgtcttccacaatggttgaactagtttacagtcccaccatcagtgtaaaacttttcctgtttctccacaaccacactactaggtcatctggagtgaatccagctagctttgcaaatgctttcctgaaacagtcgaaccaggaagcgttcttggcagctcaggggccctcctcggtctcccaaagggctgggattacaggtgtgagccatcatgcccggccatgagcctgatcctttaacaatcacatcaggttattgtgcagcaatctgtccattgacacaattgggtgggggcggggggacccttggttaaaagaaaactctttggctacagagaagtcattgagcttgtggatatttgcaggagcaagaaggtctgagtggaagatacatgtgagatgatgaggagtttttcccttgaaaacctgatgaaggaagtaaagtctgtccttaggggttcagtcacccctgtctgaatgcaggtggccctcaaagtgcttgcatgtgcagagacctggtgtcctctctcctccatgtgtggtccagggacaggcagagtcagcatcacttggaagcatgtttaagatgctccaactcaggccctacccctgacttgctgaatcagaattttccttctatctatctatctatctttatctatctatctatctatctatctatctatctatctatctatctatcttttagagacaaggtctcgctctgttgcccaggctggaatgcagtggtgtcatcatagctcactgcagccttgccccctgggctcaagccatccgcctgcctcagcttcccgagttgctgggactacaggcatgcgtcgtcaccatgcctggctaatttttattttttattatttgtagcaatgaagttttgctatgttgcccaggctggtgtagaactcctggcctcaagcagtctcccaccttggcctcccaaagtgcttgggttactggcgtgagctaccaggcttggcccagaattttccttttaccaagattcccagatgtttcatatacacattgaagttggagataccctagtctgaggcacactttgacaaatggaaagcaaacccaattatgtttccttctttgagagtctctctagggagtgaagcccctccctagtctcctgcagggagctcagtgcctggagatttgtaagtttacaaacgatataattcacaaagccactagtgttggtgaagaacaactaaagaaaaatgtctctgcaaatgcctgcatttgtgaataagcataattagcattaaactcttttgtatttcactctgtgttagtgaattatggcttgtgtgcttttgatctttactgtggcaagttttaactgggtaattaatgataaataacacttgtgtaatgctcaccaggaccccaataataaccctggataacaataatactagctaatgcatgcagagttttcatcatgggccaaagactgttctaagcactttatttattaacttacttagtcctcacaaaagccataggtgctaactattatgattctcattttgtggatgagaaaaatgaagtaccgaggtttctagaaacttgcacaggtcatgccactagtaagagccatatgactctaagatcttaaccagatagcttttagatatagtattctttttgcaattttagtggatataggtcactgagggtgacaacaggacattgaaactctgaaaaacacacacacacgcccctgagtcataaataccttggtatttcaaacctatatgtgaatgttttggcttccaattgctttccaaaatagtctctagaaacatggggttctcatgaggttacctttggttgggcgaaagaccctagccactccccaaaatatccttgtatgagagcagaggatgtgaattgaagacagtctttaggtttctcattgttttggtgaagggagaattcttcagacttgcttgggacatggaatggtagtggatgatcatggcagttcctctccaacattcctatctccctaagcaagtctgtcttctacagtatgcccaggaaggtatgccatctccatcttattaacactgaccgtgttgaattcaagtttcagccaatgactaactagactatttgagtcccttctagctattcaagccaatatattaaaaaaaaattctgggccaggcatggtggctcacgcctgtaatcccagcactttgggaggctgaggcaggcagatcacctgaggtcaggagttcgagaccagcctgaccaacagggaaaaacctcatctctactaaaaatacagaattagctgggtgttgtggtgtgcgcctgtattcccagctactcgggaggtggcggcaggagaatcacttgaacccaggaggcagaggttgcagtgagctgagattgtgccattgcactcccacctgggcaacaagagttaaaaaaaaaattctggtatgtgcacctatttcaataagagcagcctcatccaatattacagtgtatcttctttgatttaacacctagagtccattgttacacctattccccagatgtaagctgattgcaattctctgttcattcacatcagacctagaatgtttcctcttgggatatgccaatctgattctagccatgggcttagagacaaacctggtaggggtagaccttgaagaaataggcatcccctatcaaggcaactgccttagttgtgtttattacaggccttcatggtcttcaagttgatcttgtctgagctgtaagagaggacgtaagggagactttgggaatcagttttctaaatccacctaaaaattcctgttctgaatctcaggtcccactccttttccatcaggacctgaaatttcacataagagatttgatgagtctgtgatttcaactgataattctacagagcacacagttaaatttggcatcttccctgcagggttataagaaataagtgattattttagaaccaccgcagaagcaatctagttctctgtgacttgagctgagagtttaaaggtctgagcttgtttgttcttacaagggtgttcagaagcagccatcccagctggcagtcctggtagtcatcatcgttaccataaaggtcaaaccttggagccacttaggtcttccaaagccttactttaaataattattgtatcccaagaaaccacagatgacagttaattaatcataatgctaatgcatgcagtagatactagtatccccttttcagtgggcaaggaggtcagcacttcatttaaggttagaggcaagcaaaccaatctcagaatcccacttgggaagtttgttttctccctggtacgagtgtacggtgccatcttcaatgcagaaaccgtgctggattcctagaagtgagattctatgtgaaatataggaaattgctaaaattcttcatgctaagtaacattttcttaggcagggtttaccaaaaggaatgtatgagaatgcctgtcttagaacattttgaccaatattaagtattataatttttaaaaatcataagtaacatgatggtgaaaagtggcaattcattttgctttaactagtatgtgagaggaagaattttttaaatatattgattggttacccatttttttcccctttgcaggctgcgtactttgttttcagagctgtttcagtaaggataggctaagttatgctgcagcaataaatatacccccaaatagcagtggcttaaaaccacaaaattaaagctgtcactcagactgtgtgtcatcgcgagttggttgggtcttttctctgtgacatcctcactcaagagttgtggcagaaagagactccagcccgtctctccttccatgttagctaaggcaggggaaagagacccggggaatcacacagtgattcttaagggttttgtcacttctattcacatttcactggctaaagcaagtcacatggccatgattattatcaaagggtgttgaggagtacaacccaactatatgcccagaagggaacaaagtagaaatacttggtgaacaacactaatgataactttagaattttaggcttctcctttttttttttttttttttttttttactagaatacaatattcattgcaaaagttttattgcagggcaagttcttagaagtaccatgaagaagggcgaaacacaattattatgggagactctacacattcctttccatttgatcaagtggataaagcaaagtaacagaatttgaatgacacggaatgtgtgtatatatgtgtgtgtgggtgtgtgtgtgtgttataaattttgtacccttaaaaagagaacagcttactttttaagtgattctggaacattaaataaaacatgactatgtattaggctacaaagacaacctaattaaatcgtaaagaacaagtaatataggcacattctttgactacaatacaataaacgagaaattaataacaaaagtttgaataagaatcccacccacttggaaatttaaaaattaaaaaccaaaaacctttcaatctcatgaacagatccaagcactgattctgtggaaaagaaaagcaacaaattcacaaagatagcatatttaattaagaaggaaagcattaccactaaaataaactagatatgaaaagtaaatatgggagatttttaaaaagaatacttgatacagtttcatattaatgcacttgaatatctacatgaaatggaaatttttctggaaaaatgtaaattattgaaattggttcaagctgaagtcaatagtctaaatcagaagttgcatacttgcagcctaccagccaaatacagctcatagccatgttatatttggccgtacaccattttataaagcagaaaatctcacattaaaaatatacatttctcctgttaaaatattggagaatttggcaagactagacctgcattccttcattgcaataatttggtggagttgagtggccatcccctctgggtacggcatctgccacagtctccactgttcattagtgttctatgcctgcctactgatggactggcttggtctctataggctttagagtttgcaaccctacctatacagaccagcaataagggaatattttaccattctattttcattcctcatttcccttaattatagggaattaatttttctagtttttaatttttattttttatggatataagttatacatatttatggggtacatgtgatattttgatacaagcatatgatgtgtgatgatcaaatcagggtgattgaggtatccatcgcctaaagtgctcacaatttctttgtgttaggaacatagcagttgcactcttttagttattttgaaatatacaataaattactggggtgtttgtttgtttgtctgtttgagacggagtctcactctgtcacccagactggagtgcaatggtgagatcttgactcactgctacctttgcctaccagttccagcgattctcctgcctcagcctcccaagtagctaggattacaggtgtgcaccaccaggcctggctaattttttttgtatttttagtagaaagggagtctcaccatgttggccagtctggcctcaaattccaaacctcaggtgatccgcccaccctctgcctcccaaaatgctgggattacaggcatgagccaccgcgccctgccagtaaattactgttaataataatcaccctattgtgctcctgaacactaggtctcattccttctcaataactgtatttttatacccattagccatctcttcttaccccacacccactacccatccttgcccctataatcatcgttctactctctttctccacgagttcaatattttttttaagctaccatagatcagtgagaacatgagatatttgtctttctgcacttggcttgtttcacttaacatagtgtcttccagttcaacccatgtggttgcaagtaaaaggatttccttccttttatggctaatattccactgtgtaaatgtgccacattttaaaaaatccattcatccattgatggacacttggatagatttcatatcttagctattgtgaataatgctgttgtaaacacgaaagtgcagataagggaattgatgtttttgtgggtttttgttgtgtatttgttaccatttctagctacttcaatagattacttatttaaattctttattatttaataattaaggcaactaggatgggaaattggacactgagaaaagtctcagtaatatctctcaaattttaatagacggttttgatgttttcattataatattttattgtatttttaaaattccctctgctacttcataaattttatagaaaaccatcttacaatttaatttccgagtcactgggatttttaagtttctagtttacattttacttttctcctttctttttcggatggagctctgtcacccaggctggagtgcagtggcgcgatctcagctcactgcaatctctgcctcccaggttcaagcaattctcctgcctcagcctcccaagtggctgggactacaggcatgcgccaccaggtctggctaatttttgtacttttttttagtagacatggggtttcaccatgttggccgggctagtctcgaactcctgacctccagcgatctgcccaccttggcctcccaaagtgctgggattacaggcgtgagccaattttctattttcattgcattatgcaaagtaagtataacctgatatttgctaagatttttctctgtaaccaagaataagatgaactttcatgaaggtactggctctatgctacaaggctttttgtatgtgcatagaagttatcttcacattacccatgtgccttgtagccctatttttggttgttttgtccaagataaattattgtgatgtattgatgttatgttacttcctggatttacttccaacagtttgtattttaattttcaatgctctgtcctcatagtggatttcaccttttatcagtgcaaatgttctttaaatgcttttgagtcctgttgatttttgccacataacctttttgcttgtgtttgcataacatttatctttatgcgcagtggtcactgggaccgttcacaattattcagtttcttttccttccaggaatacggtacacgatgccctacctttttctgtgattttgttaggggtgaaacttttacccaatatgtgtgattatgttgtcatttttaattattctgagagcccttttattggtacacttagccttttatatttatttcacattaaggctgagtcttaattccgtcattttgttttgtgggggttctcctgtgtacctagtatgaagttattattttgtgactacggttgtgtttttcttttttatattatccacccaactgtgtggaaggtagatatcttacttttaccctctttagtgatggccgtaaaattttttgtgagattatctctaacagctaatatcagttacaaatgattaataccttttttatggaagataagaaattaaatgttatctctttctcttttctgttctttgttaattttaatgtaaggtggttataaatatgttcctcccattttttacaacttttattattttcaatttaaaaaatatcagttttataataatattagaaacacttatcttgtctctatatctgtctttagtgcttactctcagctatacttaactcgttttctgtttcttatttttaattaatatatatttgttctgacataaagtttcccaaatttcattttatttttcaggaagtctacttcaagcattaatcctcttagtattaaatctgagaatatctttcacacatattcatacagatctgagaatatcttaacacacataaacaaatgggttagataaaaaattcttgggccgtaacctccttccttccttcccttccttctcttacttctcttccttctcttccttccttcccttccttccttcttctttcttctttctttttttttttttttttcttgagatggagtctcactctgtctcccaggctggagtgcagtggtatgatcttggttcactgcaaactccacctcctgggttcaagtgattcttgtgcctcagcctcccgagtaggtcggattacaggcacgcgtcaccatgcctggctaatttttgtattcttagtacagatggggtttcaacatgttggccaggctggtctccaactcctgacctcaggtgatccacctgcctgggcctctctaagtgctgggattacaggtgtgagccactgcgcccggcccataacccttttcttttgaaggtctacgagtgctccttcattattgttagggtttaatattgttaagtttgtgataacctgcttttccttccttgtgaataatctaatttggcttaggatgtaatcattatccaggaagtttgaaaatgtcaccagttcatattcatctgtgtgttctagtagtggtggtgcctggtgttatgttgttgttgtggttccttggaatatgattcacactctcagtttttagagacagggtctgactctgtgtcccaggctggagcgcagtggtgcaatcaaagctcactgtaacctcaaactcctgggctcaagcgatcttcctgcctcagcctctagagtagctgggactacagacgcgtgcaaccacacctggcaaattttttcaatttctttttggtagaggcggggtcttactgtgttttccaggctgtttccaaactcctggtttcaagtgatcctcctgtctctgcttcccaaagtgctgggattacaggcgtgcaccatcacgcccagcgtacactctcaatttttagaccgagttttctttctggaaaacatttgttcaacccttttttgttttttgcttttgctccacatatttcaatctctcttactagccttatccacagcttagatcctgggctatggccttccaatacccctcatagctgttctttctctatgtttttcctcagccttttatattctcatacatatatttcctgcttcactacttggaggttttccagtgagtagtctactgatcactggatttcatttttgtaacaatgctttctcctctctgtggaattatctcttgtcgcttttctaatctggctgatgtgacatcttttagttagttgtcgaggacataaactagatacttttctaacactctttggtggatctgttttagagctgggcagttgctgagtcagacgattgattggtggtggctgcctcagcctcccaagtagctgggattataggagcacaccagcgtgcccggctaatttttgtacgtttagtagagacagggtttcaccatgttggccaggctggtctcaaacccctgacctcgtgatccacccgccttggcctcccaaaggcatttcttgtagtaacaaaatgctccctgaggttctgggtctgtgctatgagaggtacttcttatttttcatttctggcctatttcagtgggtgaaacatttagatcaaaacaatagtaattgttatttcagacgctcttttgtttctgactttaatagtactgttccccagagttctgagtttaaacttgaaaattacatcgattgttgtctgagatggacattatttattatggttagggtaatatcttacttgtagtttaccctttttttctttttaagtcagtaacaactttgagtaactttttgacgtctattgagataatcatgtaatttttattatttgacttcatgatgaagtcaggtcttttcattatttgacttttattatttgacccttatttaattgaatttacgataattgaaaaactgctacagttcatggattacttctctttagctgagcttctctctctatatcctgttaagtttgactatttttttattttttaatttaggttttgcaaatatatccataaaaataattgggccaggtgcagtggctcacgcctgtgtaaaaatcccagcactttgggaggctgaggcaggtggatcacttgaggtcaggagtttgagacaagcctgaccaacatgctgaaacctcatctctaccaaaaaaatacaatgtagccaggcatggtggcacgggccggtagtcccagctacttgggaggcagaggtgggagaatcgcttgaactccagaggcagaggttgctgtgagccaagatcatgccattgcactccagcctgggcaacagagcaagactcctctctaataataacaataataataataataacaactacaataattgatccatttcattttctttccattttcaggtttttaataccagggttaggcgaaatgtatagggtatttgggacttttccatcttttttgcactggaagagattacataataaccattttcgagtatttgaacacatatttctgtgaaatcacatgaaacttaaaacagtttaggacagttctttaacaatatttagtttatgtcacgttcattaatgtacacaagtgatcattttctttagtggatccaatgatctattcatttcagaaatcactgatttcttttggatttcatatgtattaacataaatgtatacttgccattcttttatattttaatgttctttaattctgtaaatatatcatctttgagatctctaactttatatatttttttatctcttttttcgtaacctgactttcagatgattttccttatacatctatttttacccagagaattatatcactgtcttgattaatagtggtgttaggtcaatttttggagggaagatttgcattgtggattttaattctgctaggagttattctagtttgttgtattttttctttgttttcttcagcctctttttcatctcagcctgtaccacctgattttttactttttaagtgagacataattcaaataccgtaaaatgtaaagctcttgagttcagtttgatgaattttgacaattataaacagcagtaaaacacttattccaatacaaagtataaaacatttctattaccccaagtagtcccttgacaaataatttttcccactctgtggcttacatttcatgtcttaatataataacccctccttatccaaggggcatatgccctatgagcttcattagatgccttaaactgtgcataataccaaaccctgtatatactatgctttttcctatacataaatagttataataaagttaaatttatagatcaggtgcagtaagagattacaataactaatgataaaatagaacaatcttaacaatatactgtaaaaaaaggatgtgaatgtgatttccctttctgtcaacatatcttattatactgtactcccctttttaaaatatttttaaaaaatttgtagagatggggtcttgcagtgttgcccaggctggtctgaaactcctggtctcaagcaatccttgcacctcagcctcccaaaatgctgggatcacaggcttgagctgccatgttcttcttgtgataatgtcagatgataaagtgcctttgtgatgagatggaggtgaatggcgtgggcataatgacatagcgtttggctgctattgaccttctgaccgtaagtcagaaagaggatcatgtgcttcggtgatcctggtcatcatggagccatgacaatgtcaaaagtagatggcagcagtgactaacgggcaggtagtatagacagcttggatatgctggacaaaggagtgattcacgtctctggcaagttggagtgggatggcatgagattttatcacgctactcagaacagtgtgcagttgaagacttatgaattgtttatatctggaattttccatttaatattttccaaccgcagttgaccagttaaccaaggggtaactgaagccgcagaaagtgaatccacaggtgagggggaactactgtagtatcttttgatgagcagacatttgaaactttgattaaatccagtttatcacttttttctttcatgttcagtactctttggttcctgttgaaaaaaatctctgcctgcatcaatgttacaaaagtatcgtaatcccagcacattgggaggccgaggcgggtggatcacatgaggtcagaagtttgagaccagcctggccaacatggtgaaaccccatctctactaaaaatacaaaaaaatgagctgggcatggtggtgggtgcctgtaatcccagctacttgggaggccgaggcaggagaattgcttgaacccgggaggcgcaggttgcagtgtgagccaagatcagcccactgcatgccagaaaaaaaaaaaaaaaattttactacattttctgctggaagatttatggttttagcttttacttttaggtctgtgagccattagaaattagttttcatatgtggagtgtggtagaagttgaggtttggtttcccctgtacaaagttttagttattctaagtgtaatctgttttgttttgttttgttttgctttttgagatggagtcttactctgttacccaggctggagtgcaatggcgtgatcttggctcactgcaacctctgcctcccaggttcaagcgattctcctgcctcagcctcctgagtagctgggactacaggtgcacaccaccatgcccagctaatttttgtatttttagtagagacagggtttcactatgttagccaggctggtcttgagctccagaccttaagtgatccacccaccttggtctctcaaagtactgggattacaggcgtgagccaccacacccagcgattgttatgtagtatgtctttcccattgactgtctttaaggttttttttgcaagtttttggcagtctgtgctgtacttagatatggttcaagcgattctcctgcctcagcctcccaagtagctgggactacaggcatatgccaccatgcccagctaatttttgtatttttagtagagagggggtttcaccatgttggccaggatggtctcgatctcttaacctcgtgaactgcctgcctcggcctcccaaagtgctgggattacaggtgtgagccactgtgcctggcctatatgtattttttattccttgcattttcatttatttttatttttattttttttatagatgaggtcttgctcagccacccaggctgaagtgcagtggcatgatcatagctcgatgcagcctcaagctcctgggctcaagtgatcctcctgtctcggccttacaaagcactaggattacaggcacatgccacctcacctggctgatttttaaacacaatttttgtagagatgggggtctcactatttctttttaaataatttccatatctctgctcaaacccccaatttgttcacattttgtatttcaccatgagatctttggcacatttatcatacttattttaaattctgatccttacaacatctggaccatcttttaagtctgcttctgtgaaattttctcttgcatatcagtcacactttcttgcatctttttttgagacagagtctctgtctgtttctcaggctggagtgcagtggtgcgatctcggctcactgcatcctccgcctcccaggctcaagcgattctcccacctcagtctcccgagtagctgggattacaggcgcccgccaccacacctggctaatttttgtatttttaatagagacagggtttcgccaagttggccaggctggtctcgaactcctgacctcaggtgactgccctcctcagcctcccaaagtgctgggattacaggcatgagccaccacacctggcctgctttcttgcatcttctcataattcctgattgaatgccagatactgcatgtaagaaaaccctgcaagtctaaaataaataaaatctacgcaccaaagaatggcagaaccctcctgccaggcactggagtcaggctttcacgcaatgtaatccgtagttgagttggataggagttctgttacagctttagttgaagttggttcacagcaacttcaaagatttcgagggtaacatcaggactttctgttttgcagagcttgtgatgcgagcaatgagaaaactctgcagatgtctttatgctttatagtggagctgccaagctttctgaaccatgctgacattttgctcactgtctttttctgtccagttccaccatggttttctgggttttcaggaggtctccttccattctgtttctagtcctcaaagagcaggtgcaggagggacctcagccatggagggagggtctcagagggatttccctcagctctcctgccctatccaaccttcaccgtactaactgcctgcacccagttaaggtctaaggactaaagtagtggtgggtacagcatgctgttccgctgcggcattttggaatgtgactctgtcacagcagctgttaaaagtttgttccggcggagcgaggtggctcacacctgtaatcccaacactttgggagggtgaggtgggcagatcacctgaggtcaggagttcgagataagcctgaccaacgtggtgaaaccctgtctctactaaaaatacaaaaattagccggcccggtggcacatgcctgtaatcccagctactcgggaggctgaggctggagaatcgcttgaacccaggaggcagaggttgcagtgagccgagactgcaccactgcactccagcctgggcaacagagcaagactctgtctcaaaagaaaaaaaaaggtttgttccaggttaggcagcctcctcttgaagcccatgtctaccatgaatgaaaacctctgggagcctcttctctgctaggaaggactcatcactttgcagaatttatcttttttagatttctttatttcttagctctttgatggattagaaagataaatcaggctcagcagaggtatctggggtaggagagatgcccgctccaattaagaagccatctggatgagttctggctagtccagggaggagctaatggctgttctcagtaggtttcttagcagggctcatacctgtaatcccagcactttaggaggctgagacaggaggatcacgtgagcctaggaatttgaaaccagcctgggcaacctggtgagacctcgtctctacaaaaagataaaaactagctcggcatggtggtgcacacctgtagtcccagctactcaggaggttgaggagggaggattgcttgatcccaggagttggaggctgtagtgagctatgattgcatttgggcaacagagcaagattctgtctcaaagaaaaaaaacacacacaccaaaaacaaacacacacacacacacaccctatgattttgcatcttatgccaactgttctcattgttggggtgagggagatagggtcttgtgacttcctgcaattctaaccgtaattgaatttcccctagtttcttttggcttgtctttcacagttcatgttttctagaagtttctgctaacataacctagaccctttctactatgtttcttttggtttctgtggtacagtttgtgtcaagagtatgctgtttctgaagatggttttttccatagcaaaatccttcacacaccctgcagatagaatgctctcactgctgtacatcagtccttaaatgaggaacaaatgtccaggcctgacatgatcaattgcgaaaagtgagcgtgggtgcattgtcctcagctatccctcggaaagttctcatttgcaaatctgaaaccaattccagattaggcgaagggagctttaagaaggtcactggattgggcccggatactagaccagcaacaaacagggacaagctgaaaatgcacctaagtgtctccagtatcctttctctgtaatacgcacactaacacgatctcaaacctgttgagaacagccatcagcttcccctgggctagtaaaagagtggtttgctgatcttagcaggcgtctttcccattccaggtacctctgcccagttctctgacctatcagagcatacagggtgcgtggtgccttcctgcctggagtctgtgtggaaacccacccctcctagcacaccttgttcagcaggcacttcctcattcttgtgctgacagctttccttttctgtcaaataccccagggcacagtacactagggactgtcttatcctgcttctaccctctacaccccacattcacaattaacaaccagcttgttcattccacagacattagttgaacaccctctatgtgccatcccaggcacttggcatagatccacaaatgaaacaaacaaaatccctccctctgtgtgttacctgccaggtccgggtctgttctgcctgcacgcagtaaatcaatccctgtgacacgggttttgcaaaagagaaaagatttatttgcaagggcacggagtgaggaggcaggagaacagctgccaaatccacttccccaaagataaggctaaaggattatttgtgagttaggcaagtggggtggttttaaggcatagggaaaagtgattagtggtggggaaaaaaatgaagtaacaggttcgttctgcacaggtgtagttgggttcatggcatttcataggacatgtttacagtaaacgtggcattagtatgatctgaaggtggggtttttcacccactgatgtcaaaaggcaacctcttgggccaggtgcggtggcttacgcctgtaatcccagcacttcgggaggccgaggcgagcagaacacctgaggttaggagttcgagaccagcctggccaacatggcaaaaccccatctctactaaaaatacaaaaattagctgggcatcgtggcagatgcctgtaatcccagctactcgggaggctgaggcaggagaatcatttgaacccaggaggtggaggctgcagtgagccgagatcacgccacagcactccagcctgggcgacggagtgaggccttgtctccaaaaaaaaaaaaaaaaaaaaaaaaaaggaaaaaggcaacctcttgggcatttgcacaggcctagttgaagggccagtggtttcagtgagtctgaactggtcaggagctggcccaagttcctaaaaaacaacagaagcgactacgaccatggtgacccagaaatgtaggaatgacctgtacagtagccagtcttcacttaaccttcattaagtttcagcatttattaggttggtgcgagagtaattgcggtttttgccattactttcaaaatggcaaacaccaattactctcgtaccaacttaatagctgtgtggccgtgagctacgtggcaaaaggaaaagtaacaaaaataataaaaagcaagtggccaaaagcaagcaggtcaggaagacctggtcaaattaacaccttggttttatatggagtttatattctagtgggaatagactcctcttacatatcttaactcgatgttatccacacagtaaccctaggaagtaggttcttttattgttctcatttccagatgagaacacggaagcacagagaaattaagtcgattgcccgaggtctcccagtatgatctgaacaatgatgtctttgctttactcggctttgcatccttgaaggtcctcagccattgtgagctttgcatccttgaagaattcactgagcttggttctctattagcctagaatagagcctggcatttcgtaaggacctcatttcaaaatgcgaaactgcagcagccgagtaaagcaagtgctcaacaggactgacttccagtacagacgggcagcttcctttctcatctttgtctccctggctgttttttgtttgtttgtttgttttgttttttgagacggaatctcactctatcacccaggctgtagttcaatggcgtgatcacggcaacctccatctcccaggttcaggcgattctcctgcctcagcctcccaagtagctgggattacaggtgcctgccaccacgcccaactaatttttgtatttttagtagaggtggggtttcaccatgttggccaggctggtcttcatctcctgacctcaggtggtctgcccgccttggtgacctcccaaagtgcagagattacaggcacaagccactgcgcccgaccctccctgacagtgttcttactcagaaggcggaggggcccttctcggttcctctcctgggcagtagagttgctcgacaatctgggaatctgggcttcagtgtttggttgtctccagtatcagttactgttgccagtttttgtctgtttatggattttcatgggcattttaattaggaatcaggggaggagaagtcagatactgctcatctgctgccagggacagcttgcgagtctctgaggccttacttaagactcccaactacccaagaggaccaaaaacccactgcttgtgataaaagtgatggctgcagttttcccagagggacccagagtacaggtgggatcgtcgtatgtgtttttggttaatcctcattcccttctcggggtagctgcagagtaaaccactctatgaggataccacccaaaataatcatttctcatggggagctctgaaagcaaacatttattcaaaaattttaccaaacatatgcttttctaacacaccactcctcgctcccctaagcttccaaaagggcaagcacttggaacaactggcaaatgatgaatagattcttccctcatttacatacctagtcattagccgggattgctatggcaactgtaccttccagacatagacctgtgggcctagcacaacttcattttggaaactgtctagaagccttgtgctcctctctcagcgtttgacaggtgaggagaatttcagggggcaggaggagcctcgatgtttccaacagtctgtaagtgacaattatcaggtacctggcatagaaaggaaggaaagcatcttgctggaaaatagtctgcaaagtgatggctttggtttgctgactgcctctcttgtccctgggagcacgatgatcaaatgcaagcacaatgggtgtggtcttatttcaccagtgtcatttgtccccttggacacacacctatctgtgtgagatcctggtttgcaaacacatatacacacattcctatagattttgtccagggaaaacaagactcctttgaagagagacaggggttgggaaaaggaagagaataaaaaagagagaaaagagctgggcacagtggctcatgcctgtaatcttagcactttgggaggccgaggcgggcagatcacttgaggtcagaagttcgagaccagcctggctaacatggagaaaccctgtctctactaaaaatacaaaaattagctgggcgtgatggtgtacgcctgtaatcccagctactcaggaggctgaggcaggagaatcgcttgaacccaggaggcagagattcaagtgagccaagattgtgccactgcactccagcctgggcgacagagcgagactccgtctcaaaataaataaaataaaataaaataaatattccttctttgccccagctagtgtcctcctgtttgatttcagaactgtgaattccaattttattttttatggatacataatatttgcaaatacgtatggagtcctggtgatgttttgttacatgcatagaaggtgtaacggtcagaactaccataccacccaccaatgccactactactaggtatttatccaaaggaaagaaatttgtgtatcaaagaaatacttctcccttggttttgattcttggttttgctgtagcaagaggcagagaaagaggtaccactgcactccagccagggtgacagagcaagactctgtctcaaaaaaaataaaaaataaaaaacaaaacaaataaataaaagagagagaaaggatactggagacacttagaacgatgtgttttcaacttgtttctgttccttgctggtctagtatcctggcccaatccagtaaccttctcaaagttcccttcacccaacctggaattggttttagatttgcaaaagaattttccaaaggataggagatagtctctgaggagtggctgcccactactgttttcattctggagaagtgggtgtcaactggacagacagcaggagggcatgtctttgcttttttttttttttttttttttttttttttttttttgcttttttttttctagacggagtttcactcttgttccccaggccagagtgcagtggcgtgatctcggctgactgtaacctccgcctctcgggttcaagcgattctcctgcctcagcctcccaagtagctgggattacaggcatgcgccaccacacctggctaattttgtatttttagtagagacggggtttctccatgttggtcaggctggtctcgaactcccgacctcaagtgatctgctcgcctcggcctcccaaagtgctgagattacaggagtgagccaccgcacctggcctgctttttttttttaatttttaattttttaagttccggggtacatgtgcaggatgtgcaggtttgttacctaggtgaacgtgtgccatggtggtttgctgtacctatcaacccatgatctaggtattaagtccagcatgcattagctctttttggctgttgcagtttcacattttgaaatgaggtccttggccactgtgagctttgcacccctgaagattttcactgagcttgcttctctattagcctaggacagagcttggcatttcataggtgctcaagaagtatttatggaataaatgaattggcctcatctgtcctgggctttatccttcctctcctcctgacaccccctctcccccatgcccatgagtgcctatgccctgtgccccagagagacatccactctcagatccttgagaacttttacccttcctccccagcacatttgttctctctgctgtttagcttcccctgacacccagatgtctctatttgttgaaacctaacctcccatggcctgagggctttgaagatagggcagggggccagatgcagctatcagacaaaaggagcaaacttgacagtgagaagccaccagtgtcacagggaatctgaatacgctggtgcagggatggagctgagcagggccagggttgggcttgagcattgtcacccaggccaagacagggacaaagctggtcaacacaggctggaagaggagcattaatttcccacaaagtgtttactgagcactttctctgtggccgtcacccttcagggtaggctgtagagtaaggcacaggttcaaccggtagacagaaaactacagtaaactaggtaagttccaaaattctctaaagatagagactttgtttcagctgaactaaaaggtgagatgttccagcctatgcattttaactttcagcctgattgtctttattcctgcttgaggtggttaatcttatgtgtcaacttgactgggccaccgggttcccagatatttggtcaaacattattctagatgttgctgtgagggtgctttaggatgagattaacagttaaataggtagactgtgtaaagcagattatcttcccactagtgggtgggcctcatcttaccagttgaagttctgaactgaacaaagggctgaccgtcccctgacttagagagagctcctcctgcctgactgcttcagctgggacctcagtcttttcttgactttggactcaagctgaaatcttggcttttcttgggcctcagccctcctgagacttttggactggaatgacaccatcagctctcctgggtctccaatgtggctagaagtaatgcttccattctttgttttcataccatttaattaataagtttttgacttctgtttatttatagatcttatctcatgagactattaacttcttcgaagtgtgatctactccgatttatgtttggttccccaggttcccagcctaaatgtcctacacatggtagacatctcatgagtatttgttgattagtggagtaagtgaatgtttgtgggcttggcaagtaggttgtcagggcactgaatctgatgccaggtttcctgtaaaaggggtagatttggggccaggtgcagtggcttaagcctgtaatcccaacactttgggaggccaaggtgggcggatcatctgaggtcaggagttcgagaccagcctggccaacacggcaaaaccccatctctactaaaaatacaaaaattagtctggagtggtggtgggtgcctgtaatcccagctactcaggaggctgaggcaggagaatcgcttgaacgtgggaggcagaggttgcagtgagccaagattgcaccactgtactctagcctggttgacagagcgagaccctgtctcaaaaaaacaaggtatatttgctcatctgttaatggcagaggggaactggtcacaaagagtcattgaggtggccctgagaggtcctgccgctatgactagggcactgtgtttcctctgagacctatatcagactgtgtcttctctctggaaacattttcgttcatgggtccaatatgatatttttcttctctgaacccaaaacatgatcttttatatctcctcactggttcgctttctcaattaatcaaccgaaggctggttttgactgtctgatctagaaagactaatacagtagttttgttcatgttttaacctgctatacgatggttagtttcttcagggcagagacctgacacttgattctccccagttcttatccgactccttgcacctaataggtgctgatcaaatatttattgaaagagggaccaggccaggcatggtggcttttccctgcaatcccaacactctgtgaggccaaggcaggaggattgcttgagctggggaattcaagactgacctggacaacatggtaagacctcatttctagaaaacaattaaaaaattagccagtcatggtggcatacacaggtagtcccagctactcaggaggttgaggtgacaggatcacttgagtccagaaagttgaaactgcagtgagccatgtttgtgctgctgcactccagcctgggtgacagaatgagatcctgtcccgaaaaggaaggaaaggagaggagaggagaggagaagggaggggaggggaggggagaaggaagacaggaaggaaaaagacagagagaaagaaagaaagaaaggactaaatgcagccctaattccacacagataaacacttttattattcccctcccctttttctccaggctggtgtttaatcaccacacttgtagtctgaaattgtaggtttttgaagccacagaaaagcaaaaggaaagcagatcttactggaggcactacaactgtttttgttttccatttgtttattgtgtaaaataaacataatataaattttaccattgtaaccatttcgaagtatatagttcagtggaaataagcaagtaaatattgtttaataagcatcactactgtccatcttcataacgtttttcttcttggaaaattgaaactgtactcattaagcaataaccccattctcccttccccccagttcctgtcaaccatagacactttctgtctctatgcatttgactactctgtaagtatctcatataaatggaatcatgcaatatttgtctttttatgagtggcttatttcacttatcataaaatcctcaagtttctcccatattgtagcacatgtcagaatttccttccttttttagattgactgataagtaggtaattacttctgtcattcacctatttgtttcccatgtgtcttaaagctttttgtccatcatttcctgaattgctgtcttcttttgtgtgtagtgatctttttgtagtgaaatatttaaattattttctcatttctcttttgtatatattttatgtctattttctttgtagttaccatggggattatatttaacatactaaagttatacattctaatttggatttataccagcttaactccaatagcatataaaaaatgctgctttataacttcatccccacttttacatgttgatgtcacaaaattacctctttatacattatatgggcaaaactataaattgataatttcttttaaaaaattattaacctcttaaattgtgtagaaaacaaaatgtagagttacaaaccaatgttacaataatactagattttataattgcccacataattgcaccatttttttgtgatctttatttcttcatatcgcttcaagttactgtctagtgtccttaaatttcaccctgaaggactccctttagtatctgttgcagggcaagtctagtgataacaaactgcctcagcttttgtttaggaatgtcttaatttctccctcacttttgaaggacagttttgctggatattggattcttggttgacaggctttttttcttatagcacattggctatatcagcccactgccttctggcctctaaagtttttggtgagaaatctgctcatactcatgttggggaatttgtgtggaaatatgcttctctctcaccactttcaagattttctctttgtcttttgaaagtttgactatagtatgtcttgatgtgggtctctttgagttcatcttagatgaagttcattgagcttcttggatgttgatattaatatctttcatcagattgggggagtttccagccactatatcttcagatattcccctacccttttctctttctcaggtttccataatgtatatgttggtccacttgatgatgtctcacacatactttatgttctgtttgcttttcttcagtctttttttccttctgctctgaagaagtgataatttcctttaagctagcttcaagttcactgatctttttttccttctgcctgctcaaatcacccatcttctttataacattgttttcttgactttctctatgtcttccttctttgagcatgtttaagacggttgttttaaagtatttgtctattaattccaccagtaggtctttttgaaagacagtttttgttgatttattattttttcctttgaatggaccatactttcctgtttctttgtatgtcttgtgacgttttgttagaaaactaaacatttgaagctaataatggagtacctctggaaattgaattctccccattctccagcatttgttgttgtttttgtttgttttttaattgtcataggctgtctttgggccaacgatcagtttgaggtgtaaatgtaaggtcttctcaggtcttttctgagcctgcaccttttcatggatatgcatgatttttttttcttatttctcctgtatgtgtgattgcttttaaatatcttagtctttgatgtctgacttccaaaagatggaaagagaaaaatgaaacgggggaaaatagtgctgcctctaaatcctctggaaatcatttcagctgcagggcagggttgggggtggggtggagcttatacaatgggcagaggtgtagcaacagtggcccctgcctctttgtctgcacctctctggtcagagcacggaacccctatatttggaggacagggtgcttttttgcccaacctgattcctgctggctgcatgcaagctgctccaggaacatgtgcacatctccctgccatgggattgggagtaggggatgggtagcggctactgtgctaagagctgaaattgatggaaattaactgcaatttaccaaccaagcctttccctggaagttgcaagccttcaatagcctggaatttcaaaatagtcacacaggacaaattctgccagcatgattgttgtccaggtggggaaacagattcctagtgctctctgctttgccatcttctccatccagttttgttttgactttctgggtgaactcaattaagcctttgcattggaagctcttctatgttatttcacagcaggcctcatgaaccaaatgtccaataggacttaagaaattgaattatagacaggggaggagaccttataaaaactgcaaagtttggtcccttcagactgaagtggcaaagtctaacagggggacgagattaaaatctataatgttgtaagtacagagcattcgcccagaatcatatgtcagatttggaaattaataccttgtggtcccttttgccttgaatgagaagttttggatacaaaattaaatcctaattcataaagccacaataaagtcagggaactcttcatatcccttgaagaagaacgaagtgggagaaataaataaattctaaaagggcccaagcagattcatgaatcaccaataattatgaagagcaggtggaatatatttaatatttgaggttgccatcaggaaggagaacctagctgagtctctgaggtttccgtaaacaacagaatgctgggccaggcagagcctcatggacctgcagcagttggacacattctctgactcaggacatacctcatatattctgccttgctcctgaggaagcaatgtaaaagcgaggacctagtgcaacttttcttttagtgcaagtttttacgttttgggagagagaaagatgggaatgccataatgattctgcattcccaaaggcatttcaccttcctctgccctcccttttcatatgtgttgttatagttgactgaccaaactagttttgacagagaggctgttttctttgcagtgacaaggatttttcctaaagcaattagaaaatattaggtagaatagagaataggatggatcaaggctagagggagttgcctggagactgtcaggctctgggaatctctctcttctgtgccccatagagtttggggacagatgttgttcttgggaagggacactcctggtgaggacctcaggacatccccaagaggtcatagttgggctctccctcccttttctgactgcttttgcactcattatgccacttatgtaacactttactttattcgtaccaaatactgttgcttatgcataaaccatagaatcctagtatctcaagatagagggagattgggtaggggtatggtaggctgaaaaatggcctcccaaagatatcaagctctccctctttgaacttgtaaatgttaccttatttggaaaagaggtctttgcaatcctttttaagttaaggatttggggggagattatcctggataatcagggtgggttctaattgccatcctgtatccctctgcaagggaggcacagggagatttgacacacagagaaaagaaggccttgtgaagatggagcagagattggagtggtgtagccagaaaccaaaggatactggagacaccacaagctggaagaggcaaagaatttatgctccctagagcctccagagggagtgctttagatttggccccagtgatactgatttcagacttctggcctccagaactgtgagatcattcatttaggtcatgttttgtttttttaaagccaccaggtgggtgatacttggctacaactgcctcaggaaactagtccaagatgtcacctcattacacccatccaccaaggccagtgtcccattaggttggtgtctgcctgagcagcggggacccattacctggctgtgacatctcatcctgaggtcagagttctgacagttgcagtggttctcctgaagtctgcgattccgcacggacgtctccagccactttgcagtgtcacttgccctctctgtgtgcactggcatctgctcctctggatggccatccaaattgttcttgatgggaaagcaattttcattgtactcaaaagcagttctgaactctcctgcaacttagaatcagtctatatctacttccaagtgttttcagtgtacctatttcctccagtttttccaccgtcctcaatcaataagataatcacaataataaaaatggcattattttacatctatgtgatggtttaaccatttgggagattttttctttaatcatcttgtgtcaggtagctaagtgagtattattaatccaacaaaaaatatgcaaaatgaggcccggcccagtgcggtggctcatgcctgtaatcccagcactttgggaggccgaggcaggcagatcacttgaggccaggagttcgagaccagcctcgctagcctggtgaaaccccatgtctgctaaaaataatttaaaaattagctgggcatggtggcgggcgtctgttatcctagctacttgagaggctgagacaggagaattgcttgaacccatgaagtggaggttgcagtgagctgagatctcgccactgcactccagcttgggtaacagagtaagactccgtctcaaacaaacaaacaaaacaggaggcccaaagaggaggaatgacttggtttaggtcaataagccatgattacaatccaggatttgtttaacttcatcatggttgataccactgggattcaaagtggtgtgcgtgtagttaaagggttgtgggaaaaatccattggggtataaaaagaaaatattagaaccttctcgtatctatttctcatctaaaattaagaatagatctctgttaatatttgatgagtaaatagtgtatgtatataatttgcgaataaatgaatgtcatgtatattttaaaatcttttgctggtggaggtgcttgcatttaaaaagtagggaaattgctctcccctcaccctgccccatcgttgttcattttagccaagattgactatttaagctttaattgaggatgatatttatgcattaacacgtgggcacaaattggttggtgataatgagattgctgaattagtttagtttacctcattatctggtagccaagccagacttgtaaataatgactaagatacaaagcacacagaagcagatacagagggaataactttgaaaaattaaaacattctgcaaagttgcaaggccgtgtagaatcagctgactttccttgcctgtgactccttcctggtctgtatctgccaccaaatgcagatgaagaggacagcagaaggtggtctgaggtcagcccttgctggacctggggcccaagcataccaagtgccgctgcccaggtacatgagagaggcatgccattcggtggatcagcagtcagctcactggactcctccttagcatagcgattggttgtaacttattgacagattcccctataactttttattgagagatagctgatttttttaaatttttctttataagatactgctttccagagtgctctggaggcttgagagagtcatagaaaaattatggagtggctgagagtggttgctcatgcctgtaattccaacacttccggaggctgaggcaggaggatcatttgaggccaggagtttgagaccagcctgggcaacatagcaaaacctcgtctgtattaaaaataataatagaaaaaattggctgggcatggtaatatagcatctgtagtcccagttgctctggaggctgatgcaggaggatagcttgagcctggaaggtggaggctgcagtgagccatgatcacaccactgcactccagcctgggtgacagagagagaccttgtgtctaagaaaaggtatggagaaacctattttggctctgtagatgtcaggctctacctaaatttctgcctctattttcccatctctgcgtcacttgaccaaaacatggaagaagcctttcctttgatttcagacccatcctacttggggagtaagtacttaagaattatagttccagctgggcgtggtggctcacacctgtaatcccagcactttgggaggccgaggtgggtggattgcctgagctcaggagttcaaaaccaccctgggcaacatggtaaaaccccatctctactaaaatacaaaaaaaaaaaaattagctgggcatggtggcacgtgcctgtaatcccagctgctggggaggctgaggcgagagaatatcttgagcccaggaggcagaagttgcagtgagccaaggtcgtgccactgtattctagcttgggcaacagagtgagactctgtctcaaaaaaaaaaaataaaataaaatagctgggcctggtggtgcatgcctgcagtctcagctactcagaggctgaggcaggaggattacttgagccaaggagttcaaggctgcagtgagccgtgatggcgccactgtactccagcctgattgacagaaagagaccctgtctcttaaaaaagagtcatacatatagtagctgtctacaaaggcagatcgaagcaggtacggttgcatttggttgtaaagcagtaagcagaaagggacagttggttcctggaaacattcacttttatcaaaaaaaaaaagtactgaaaaaaaggaaaatgagtgccttagacagagtgaatctggatttcaccaaagcatttgacaagtttacattgacgaatttggtatgtgtgtggttaagatagaaaaatatgagctggatgctactgcaattaggtagaagtaggactgggtgaataattatgcccaaaggaagactcccagtaacgtgccccagggctctgtcccccactttattgtgttgaaaagttttagcagtgcttccctgaagccagtgcctgatggaattaagatccaaaaaggtcttgacaggctgagacaattaggccgaatccaacacgatgagatttagcagaaacaattgtaaggtcctgcatttgcatccaaacaatcaactatacaaaaacaagagaagaaaagtgtgacaagagcaggaccagtttccagcacaggtgcaggtgacagacttgagcttggatgtggatccacagaatgatgggactatcaataatgcgaattttacttggaggctgcactgttagaggtattgcatcatatcaaaataagtaattatcctcctatccttgctgtttctttttttcttttcttttctttttttgagatggagttttgctcttgttgcccaggctggagtgcaatggtgtgatcttggctcactgcaacctctgcctcccaggttcaagtgattctcctgcctcagcctcctgagtagctgggattacaggcacccgcctccacgcctggctaattttttgtatttttagtggagatggggtttcaccacattggccaggctggtcttgaactcctgacttccacacagatgaagcgtggggttcggtcctgctttcctcaccttgagatcccacagaggacatttggaggcaagaaccgggatctcaatgggactccagaatacatactgtaatgaatccgagatgggattggggatgcttgctttatagagaagaataggtgaagatatggtagttgtctttaagcagtttaggttgccacttggtatttgaagggttgtcatgcaaaagaagaatgagtctgtttctggggtggctctcaagactataacaaggaccagctggggcaggggcaggggggcggggaggccactgctgtgaaggcaagagtttgatggaaagtagagttatgtggctactaaaacttgcagcagtcaacagattgggctgtagtatgaacaaacagtacaactaatagttgagattgctggccatgatgcattgttgatttaaaggtagcccatgttttgttggatttcaaatgtctaggtgataaaggtcattaaaatattaatattttaatattaatattttaaaatataaatatattttacatatattaacataaatatattttacatatattaatattaacatataaatatattttacatatattaacatataaatatattttacatgtatatcactatttcagaatattaatatattttacaaatagcctgatgtctgtttgtgcccaagtgcactgcagctatgtttctgcacagaagtggtcctagagccacataataacagagctcagattttttttttttaaaaagatcagcctaggatcagcttaaatgcctgagcaagcaccaatacatccataaaagctatgcaagttgagtgtcccttatctgaaatgcctgggaccagaagtattatggatttttgaggggggatggattttggaatatatgtattatacttactggttgtgcatccctaatcaaaaaatccaaaatcagaaatctggaaggctaggagtcttgcatcatggatcatgaaagagatgaccttgagttagaagattctatgtcaggatttaacaaccatccctgtctatgttaaaataatagttgttgcaaaatatatgatttttactggggttatatcaggatagcttgtcaggatttgctggctacaaaacccttccccacctaactggatcagttacccaatctaatagagctgtttagaattgtccatctggctgacaaagagcacctgccaaaagtgattagttttgccttaccttaattgattttgagtaattttctcctcagaaagttcacttgcaccttgagggggtcatagaatcttcatagagaaaaacgagttttcatttttatttttacttatttttaattaattattttttttttttttgagatggagtctcactctgtcacccaggctggagtgcagtggcacgatctcagctcactgcaacctctgcctcctgggttcaagtgattctcctgcctcagcctcctgagtagctgggattacaggagtgtaccaccatgaccagctaatttttgtatttgtagtagagacgtagagacggggtttcaccatgttggacaggctggtctcgaactcctaacctcaggtgatctgcctgccttggcctcccaaagtgctgggattacaggcatgagccaccgtgcctggccagaaaaagaagtttttaaatttgctattacaagaaggcatatgtccaattcatccataaaagctatgcaggttgagtattccttatctgaaattcctgggaccagaagtgtttggattttggattttattttgggggtgggggtgtggatttgagaatatttgtattatacttactgattgggcatccacaatcccaaaatccaaaatctgaaatgccccaatgagcatttcctttccacgtcaggttgtcactcaaaatgtttcagattgtttagcatttctgatttcagattttaggattagggatactcaacctgtataaagtaattcaaatagatattcagttatactatccaagttttgcttttttcagctgccagtacatggaatgatttggttttgttggctctcatggcaagtctggagataagatgagctcttggctggtgaatgcagccactcaagatgccaggcctctatctagctcagcaactctgcagttctcttggcttctccctgtggatacaggatggctgctatatattgcatcttcacaggacaatatgcaaagccagggctgtccccttttaagagagaggaaaactttcccaagagacttatggcattgcatgtcataccattttgaaagattattgtatggctttgcagatgttgaaactggcttcttaatgcaatctgagagttatggccctaaaacatttttagatttaaaatttaaattttgaattaacatacaattgacatttgagggtgtaccgttctgtgaattttaacacgtgtaaattcatatacatgtacaggtcagcacattcaagatacagctcaagaacagcttgatccttttttttgatcaggttttgacaccaaagaaaaccttatgtctttgtgtctaagttcatgagaggtattagactctaggtgtttttttgtttgttttttcttgtaatgtctttggttttggtatcaggacaatgttaaccttatcaaataaactgagatgtgttccttcctcttttattttctggaagagattgtgtaaaattggcattatttatccataaagaaaaaaattctttaaatgttttggtagaatttgccaaggaagccatctgggcctcaagatttcttttttggaaagttttaaactgtgaatgcaatttctttaataggactatttaggatgtgtctttcttcgttggtgagttttgtattatctgaagaatcaatccatttcctttgtcattctagttaaaggtttagatgttatatcaacctacattgaaaaccacatgagacaatgttataatttttgttttcaaccatagaacatttttaaagaaccaaacagggtaagaataatcttatatttacccatatatttggcatttcttatgttctaagttcccttctggtatcattttatttatttattttttttctttttttttttttttttttgagatagagtctcactctgtcgtccaggcttgagtgcagtggcatgatcttggctcactgcaacctccacttccctggttcaagagattctcctgcctcagcctcccaagtagctgggactacaggcatacaccaccacatccagctaattttcgtattttttagtagagatgaggcttcaccatgttggccagactggtctcaaactcctaacctcaagtgatccacccaccttggccaaagtgctgggatcacaggcgtgagccactgtgcccagccctggtatcattttatttctttctggagaacatcctttaaaattttttttagagcaggtgtgctgacaatgaatttctttacttttcttcattggaaaatgtcttcattttgactgcattcctgaaggatgtttccactggatgtagaattctgggttgacagttttttatctcttggctctttaacaatgttgttccacttccttctggtctcagtgttttatgatgagaaatctatagtcattggaatcattgctttctgttggtaatgcgtcatttatttctgtctgattgtaagatgtttttctttgtctttattcttcagcaatttgattgtgatatgtttgaggatgtattattttaggttcatcccatttggggctttaggggcttggtgaatctgttggtttatttcttttttttttttttttttttttgagacagagtcttgctctgtcgcccaggccgttttatttctattgagaaatttagaaagtttttggctattatttctttaaatattttttcttctctgcagcctttctcatctccttttatgcctctgatagtaggaacattaatcatagaagaagaggagaaagactcacattttttattgacctatcttcaaattcactagctcttctatcacctccatttctacattgagcccctctatagagcttctttgctgttactgtttttttttttttagttctgaaattttcattgtagtcttgtttatatcatttatttctttgtctagactttctattttcccattcctctcgagaggatttgcaaatgagaggagtggaaagatagaaaaagataaaaacctctcaacaaagaaataagtgatataaataagaacacagtgttaatggtttcattaacatctttttcagataattccaacaactgtgtctgtagcgtctggtgattgtgttttcttatacaggtcaaattttcctgcttcttcatatgctgattaattttgtattatcgtctggacattttgaatattacgttatgagatcccggctcttctttaaatcctccagagaatgttgatatttttgtttgagcaggcagattgagttggttgggtgtaggctgaaaattctgaccagctttctttggattgtggtctgttcagttttccaaggctttgcaacactattcagatctgttctgctcgtgctccacccgttggccattctgggagctgtgtagtattttgtcccattgagttagttgttgctatggaggagtttgccttggtatggagaaatacctgaaactgagtaatttataaagaaaacaggtttatttggctcacagttctgtaggctatacaagaagcgtgacacccacatctgctcagcttctggtgaggcctcaggaagctttcagtcatggcagaagggaagtagagctggtgtgtcacaaagcatgagagacgggggagatcccagactcttctaaacagccagatcttgcgtgaactcactaccatgcatcacggtggggagagcaccaagccatttatgaaggatctatcaccatgatccaacatctcccacaggccccaagttcaacattggggctcacattccaacatgagatttgaaggggacaaatatccaaaccatctcacatgttttccagttttcagagtctagggcagactgtttagggttagacaggcatgaacaacttacaggtgagcccaggatttcatacacaaaatggcggggtagctttgccaacctcttcactctccaagacctccttggtactaccatttatttaggactctatttttcattcctatgtccagcaagctgaggctttatttgtcctactcttatgcatactttccttggctgtatcagcttcctgatccaagctacaagagaagagaaagagaaaaaggcatcaggcatttgttcctactcgagacaatggttccactgatcagaaggaaaggttctccttcagagcatgtaagcacctgcaggttaccatgggttgaggcatgaagaaatggtgaaatgaaaagacaggaagtatttcccccactctctctgaatgttagagacccttttcctacccctcaagccaaaactagaggcttcctggagctctcaccacccacaccaatgcccactgcccggggtctttagcattgcatctagctgggggtactcgaggaaaaactgtagcaaactctttgctggtttggtggtactttaaattcaggtcttctccaaatcacctgctactacaacttacttctcagaatccccaaatagctgttccatgcgttctctgcatgttccacagctgccagcagtggaaagaagcagggtagagtgttgcttcctctacccatcatcagaacctctcagaaatttttcacagttttttttcaacctaagtggttaattgaatgtttcatcataaatgaggtcactataactaagttatgggaaattacaggaggactgggattataaaatactgagtgaatgctgtaaggattcaccaaaatatagggagatcagctgtcatgagtcttttgctgtgggtaccctgagttcacaattgacggtcatttgcaaccttgaaagctaagctctgaaacctattatagttcaatttctttttggaaatattatgcttctaacaagatttcagagcaaggtaatttccaagtagtttcctttaaatttagcctgaagtattgacttactggctttttttttcagaaaacttttgccaaggcaagaatgagggttgggagttcctaagtatgagggattgtcagggtttgcttcaatctgcccatattttcttgacatgggttattgaagaaatcttcatccctactgttgtcatttgagcattcctttaatataccatccctatcataccattgctaatgaagaccaggtaagtggcaggaaaaagtaatccctctgacctacttttaggaggtctagatcttggaaagatggagacagattttgaagaccatagatggaatgacattcctaagagtggtttgttaattttccttgataaaggtttctgaaactgacgatttaaaaggaatatattctgtacatctcttgtgaatcccagaagttttcaactgcttaatccatttctaaagttttagtttaaaaatataaatgaaattggatgttcacaatccaggaagcataacatttaggtttaagtccaagtttaaaaccttgaatcttcaacgaaacggaaacatgtcaaaatgattacacttcctcctgttgacagctgggttttaaagccagacagcgttcttcgttttcgacttttgtttttttaatgcagaataccatggcttcttttgcacgtcactgtccttttgcactgcattgcaactcagcatccccagtgtctatgatctatatggggcaaaggcgtatttttcatagagagctttgtgaagttattcttctccactatttcagttcagagcttaccatcttccaaagtcctgcccccttggccctctgcccagggtgtggacagacactcttgggtgttctctaaagattccagcttgttgaccaggcatggtcgcttgtgcctgtaatcccagcactttgggaggccgaggcaggcagatcacctgaggtcaggagtttgagatcagcctgaccaacatggtgaaaccccatctctactaaaaatacaaaaaaatagctgagtgtggtggtgggcacctgtaatcccagctacttgggaggctgaggcaggagaatctcttgaacccgggaggtggaggttgcagtgagccgagatggcgccactgcactccagcctgggcaacagtgcgagactccgtctcaaaaaaaaaaaaaaaaaaaaaaaaagattccagcttgttgcagcttgtagcaacccccagcagccactaagagatatttactcccactttttactcaagcaagttaatttctggaggtgaaacaattgcacttacgatcatccagggtctcatctggataagacttggtagcacgtgtaggtgtttaacgtggcgtgattatttaatatatgtggtatagtggtggggccccagaagagcaattttctatacaattctaattttgcgtgaaatgatccggatggtggttgtataacattctggataatatgggctggtgccaagtgacattttaacttctgcacgacttagaaaactgtgctacgtgttccacagaggaaattatcagcattcagctgcagtattcgcttgccagaaccattacccctcaagaacgctttcatgtagacgcttgaagacttgaaaaagagaaacaacttcctgttccattacaaacatatttcatgccaatacagaaacgataagaccacaccaaaataggggatcaatggagaaatctatggctttctgtaagatgtcatacaactaattttattatgaagaggtttttttttcccaataagtcttctacactcattattgtaaagagttttaataacatgtaatcttcacaatacaatatcaagtaaaaaggactggaaaacataattttaattattttgtttatttgcttagaagaaaatgaagaaaaaatacacgtatgttacttctgggcgatgggttgatttttcatttcctatttatattccttattcttttccatttctcactgttacaaataatgttatgataaacagcatgatgcagaaatctatgaccaaatttctgaacacttcattgggacagattccagaaaaggaattactgaatcaaaaaaaaaaaaaaaaaaaaagaacatttaaaaaggaactttttatctaaatgccattgccaaattagtatccagaaagtctatgctcatgtctgttaccatcagtattagtgagaagactcagcaaactgtgtactctgtcttttcacttaaaatctggccaggcttcatggctcaagcttgtaattccagcattttgggaggccaaactgggaggattacttcaggccgggcgttcaagactagtctgggcaacatggtgagaccccatctctacaaactttttttttttaaaaaacaggtgggcttggtggcatgtgcttgtaatcctagctactggggaggctgaggcaggaggggcacttgaggccagaaattggaggctgtaatgatctatgatcatgccgctgcactccggcctaagcaacagagtgagaccttgtttttaaaacaaacaaaacaacaacaacaacaaaaatgaaataacattgcatactggggatgtggaaaatgctagctcactattgctttaatttgcatttattttcatattattgaagttgaacattttctacatgtttaatatttgtgtttgtcttttgtggattatctgtttttatcttttagtattcatcttttaatgaatttcttcgtatttgaagaatgctattcttttgccatattcattgcatagagttttcctagattattgctaaatatttaatttagtccctgatgtttttaacatgcagagtatgttagcaagtctgtgaatctctatttttttgttattcctttattgattttaagcttagataggattttcttcattttacctatatatttctctaattttttatcctctaattcatgttctagagtaaaatgccaagtgaggaataaaatcgatttttcctttcaagttctttacctgtcttttcagcaccatttgttaactaagcctccttttttccattcgattttttatgtttattatctttatttactagggcttatttctgaattgccctgttttgtttatctcctacttaaccttcatcagtacttttttattgtggttttataatagattttattactagatatagcattactgtccttaattccttttagaggttttctttcctgctcattcttccaaatgaccaattcactgggacatttccaaaaaaattccatagggatttatcctgaaattgcattaaacatatccattcatttaagaagtataaaattgttagagtaatccttctaccaggaagcatggtattcttttatgttttcttttaaaggctttaaaaatatatcactaaagttgtataggtttcttcatatgggtcctaaatgtcttttattttttaattgagacaggatcttgctctgttgccccagctggattacagtggtgcgatcatagctcactgcagcctcagctgctgagctcaagcaatcctcctgcctcagcctcctgagtagttgggactatgggtgtgtgccaccaagactggctaattttttttatttttttgttatttgtggaaatgaggtcttgctatgttgcctaggctggtttcaaacttctagcctcaagcaatcctcactcctcagccccccagagcgttagcattacagatgtgagccactcagcttggtgctaaatgtcataaactagtaatttttcaataaaattactcatttcacaaaagttttaaaatgtatttgctttcagctatataaagtacagtatttcataatttttatctcctctgtatttgttgctacatagtttttgtctgttgcaattttatttgaatctttctgggttagatttgttaattattcatatgttttatagttttctcaaagaatcctcttttttttgcaacgatgattaccatatctatttgtgtatttcccagttaactaattctgcctttcccctaattctatcattacccctattaccatatttatgtttaacttttctaagttttaatttctttgctatttatgtctttatttgcattggggttactttttctattatttgtttaatcagcctctgttaatctttaccagcttggttaaaatgatggactctggagttagactgccaaattcagaacccccgcctcaccctgccccacccagccccaggtctggcccatgcaaattgagcataagctcttctgatttccacttcctgatttaggacatgaaatagtaataatatctacctcgttagtgtggtgtgaggattaaatgagttaactcatgtactatgatgcctggcagataaaaaatgctctgtggatgtcagcgatcatgaacagcatttctcttccatccgttcttttgttctttctttggaattcctgtcctcatcaggttagacctcagggatcttagtctccaggtctctcagcttttacctcccagtctctagctctgtgtgttttgttttgttttgttttgtttttattttagtttccagagcacatgtgcaggtttgttataatagggaaactcctatcacaggggtttgtcatacggattattttgtcacccatgtactaagcctagtacccaataattatttggggtactgtccctccttcaccttcaagtaggccccagtatctgttgttcccctcttcgcatccatgtgttctcatcatttagctcccacttctaagtaagaacatgcagtatttggttttctattcctgcattagtttgctaaggataacagcttccagctccattcatgttcctgcaaaagacatgatctcattctttttcatggctgcatagtattccattatatatatatatatatgtatatatatatgtatgtatatatgtatatatatgtatatatatgtatatatgtatatatatatgtatgtatatatgtatatatatgtatatatatgtatatatatatatacgtgtatatatacacgtatatatatatatatgtacatatatgcagccaacaagcatacagaaaaagctcagtatcactgaccattagaaaaatgtaaatcaaaaccacaatgagatatcatcttacaccagtaagaatggctactatgaaaaagtcaaaaataactacactgctggtgggaatgtaaactagtacagccgctacggaaaacagtgtggagattccttaaagaactaaatgtagaactaccattcaatccagcaatcccactgctgggtatctacccagaggaaaagaagtcattatacaaaaaaggtacttgcacatgcgtgtttatagcagcacaattcgcaatagcaaaatcatggcaccaacccaaatgcccatcaatcaatgagtggataaagaaattgtggtatatatctatatatacgatggaatactactcagccaaaaaaaggaatgaattaacagcatttgcaatgacctggatgagattagagactattattctaagtgaagtaactcaggaatggaagactaagcatcgtatgttctcaccgatacgtaagagctaagctatgaggacgcgatggcataagaatgatacgatggactttggggacctggggggaagggtgggaggggggtgagggataaaagacaacaaatatggtgcagtgtatactgctgggtgatgggtacaccatgttctcacaaatctctaaaaagcttactcgtaatcaaataccacctgtaccccagtaacttatggaaaaataaaataaaaaaaatagataaactttgataaagattgcgaaagaaaaccaaagttgctacatagatcttaaaaaaaaaatgacacatgctggtaaggttggggagtaaagggaacactcatatatgttggtgggagtgtaaatcagttcagcccttgcgaaaggcagtgtggcgattcctcaaagagctaaaaacagaactgccattcaacccagcactcccattactgggtatgtgctctgagttgttgttctgtgcagtggttccaggctactgtctcagttcctatcacctaccagccggtaatttcagagtgtctatgaatctgcatatttgaaaatcatgctttttactttctgggagtctttggtgtactctgattccactctttgggagcacatattcctttgtttgtttgttttttgagacagagtctcgctctgtcacccaggctggagtgcagtggtgagatcatggctcactgcaaactccacctcctgggctcaagcgattctcctgcttcagcctcccgagtagctgggattacaggctcccgtcaccacgtctggccaatttttgtatttttagtagagactgggtttcaccatattggccaggctggtcttgaactcctgtcctcaggtgatcctccctccttggcctcccaaagtgcttggattacaggcgtgagccaccgcacctggccttggcctctcaaagtgctgggattacaggcgtgagccaccacacctggccttggcctcccaaagtgctggcattacaggcgtgagccaccacacctggccaccctctaagttcttacctaagtcttctttctttagttgtagtcagtgggaaccaagtgcttcaaaggctcattgagtcaccctgtctctggtcactgagacggggtgagttgtcatttctgagactgaagtgagttgtcatttctctgcctggctgtagatttccatccgccttctctgccaagtcagggcaaaggcacaccaacaggttaggggaagcccggtggttttcatgttcacctgaccagaaacaagtgtgcctccttcctgaggtcaaggaggaagccccctctctttagggtacatcccacccaggagcaggagacacgggctatagagcagattttcttcgggtggtcagtagtcagtgaggtcaagaccatcacccccaagcctgaatccccccagagcctgctggagtaaacagttgtggccctttctcggggagcttcctggggaaggggcagatcctccgtatcttctctctaccttccctccagagacctgccttccctggccggtgtccactccggaggcgacttgtcgggacggcagatcaggagttcttgctgttatatattcacagccccttaactccgcatttactccattttctaaatggttattgctgccacacaaggaaacgattgattttttaaatgtttgtccaggacccagccactgttagtaaattcccagaattacgatggagtcatttctttttttctagatagacaatcataccatctcctgaatagtgatcatcttgtctcatgaattcctttagtcatctttctcacttgtatctcaagtcataatattggccagaacacagaaaacaacattgaataaaaatgataacaagcatccttggggcattgcttatgttaatggaaattcctctggtgtaggagaatatgcttctgccttgagatagatcactcttactttgtcgagaaaggattattcttgtccttgttctaaaaagtcctgaaggaatctagtattttccccagcactgtttgcagcttccatagagaccaccacactttttattgtgtctattgatttgatttcatacatggattgatttttctagtattaaattgtactcaagttctggaatgatctgtacttggctgtggtcagctatgtttggagcatattttaaattagattttccagttccagctttagcgtttttgcatgtgagatgtgttggttggttttcttttgtgtatttttgtatgagagttatattagcttttccactttttcttcatcctggaacagttaatataacatgaggagtgtctatttctcaacaacaggaaaaaactcagatataatttttcctaatttgagaagcttttcaggtattttttaaaaataggttatcagttttagaaatctgattttgttgattttctgcattttcttaaatctgtaataatcttttttaataaagtcaatagtttcacaaaaaatttgaaatagattagcttttggttatacaaagtacagtatttcataatttttatctcttctgtatttgtggctgcatagcttttctcagttgtaattatattttcttctttctggattcgatttgtcaatcattcatatattttatagttttctcaaataactctctttttgatacaatgcatatcatatctatttgtgaatttcccaattaactaattctaccatcaccctaattatatcattacccctattacctttaagtctaacttttctaaagttttaaaaatgttttattttttcctttccaaataacaaaatatttatttatttatttatttatttatttatttatttatttatttattgtggtggagtcttgctctgtcacccaggctggaatgcagtagtggcacaaccgtggctcgctgcaacctccacctcctgggttcatgcgattctcctgtctcagcctcccaagtagctgggattataccatgcttggctaatttttgtacttttgtagtagaaatgaggtttcaccatgttagcccggctggtctcaaactcctgacctcaaatgaacttcccaccttggcctcccaaagtgctgggattacaggcgtgagccaccaaacccagcccaaaataatgaaattattttaatgttatgaattacatctgaaaacaagtttgattaatacttacatatttgagttatgtaattttctcactgtcattttctttaaaagatactatcttgcatttgtattcttcattgatcaggagagtgttttccatttcggagtgatctagggctctgcttcaatgtttactattaatattaaatcctagtttctttgggtttgagtaggagaatgaggtctgcttatttcagctttgaaaaattagttgattttttgcgatctaccatataatcctgtttttataaatgtttcatgaatgttttaagaggtacagcctttttttcctacagcattctgtatattatctgttattttctgtgtgtatggttaataatctagtaattgcaattgtactactgaaattttcatcttgaaagacaacatggcataatggaaagaatgttttagagtgaaggtaaatcagggttcaaaactgaattttattacaattagtggcataatcttacagaggtcacctaatatctgaacctcccttatgccttattaaaacagggacatcaattaatacctaccttcggccgggcgaggggcctcacgcctgaaaccccagcactttgggaggccgaggcaggaggatcatttgtggtcaggagttcaagaccagcctgaccaacatggtgaaaccccgtctccactaaacatacaaaaaaaaaaaagtatagccaggagtggtagtgtgagcccctagtcccagctactcacgagcctgaggcaggagaatcactcgaacttgggaggcagaggttgcagtgagccgagattgcaccactgcactctatcctgggtgacagagtgagactgcatctcaaaaaaaaaaaaaagaaatagacttggcccgggtgctcacacctgtaatcccagcactttggcagaccgaggcaggtggatcacctgaggtcaggagttcgagaccagcctgaccagcgtggtgaaaccccatccctactaaaaacacaaaaaatagccgggcgtggtggcgcatgcctgtaatcccagctactcaggaggctgaggcaggagaatcgcttgaacctgggaggcaggggttgcagtgagccaagatggtgccactgcactccagactgggcaacaagagtgaaatttcatctctaaataaataaatcctaccttattgctatcataagtaaaatagcttaacaatgtgcctgccctatagttcatcacagtgagtgatgttattaatatttgcttatttgatctgctagtgattgatagcacatgaaagtcttccctttcttagctccaaaaaaaatgtctcattactataccttctagtattctcggatccttttgtctttctctcttgtaaagttcaagtctccaatttctgtgtttcatgtattatctttctctcatcattttacctcttttttattttccctgtctagactaggttggggctgtaggttattgatgtgattatctgtgctgtggctgttgctatttattatgcttctggaattgttctccccccacccaccaggtaatatgatatcatattttctggctgggtgcggtggctcacaccgataatcccagcactttaggaggccaaggtgggaggattgcttgaacctggaagttctagagcagcctgagtaacatagcaagaccctgtatctacaaaaaaataaaagtagctgggcatggtggtgtgcacctgtagttctagctacttgggaggctgaagtgggaggattgcttgggccgaaaatgttgaggtggctgcagagagctataatcatggcacggcactgcactccagcctgggcaacacagtgagaccctgtcgaaagaaagagaaggaaggaaggaaaaaaggaaggaggaagggagggaaaaaggcagggaggaaaggaaggaaggaggcagagaagaaaggaaggaaagaagagggaaaaaggaaagaagggaggaagaaggggaggcagacaaggaaggagggaagggagggaggaaaaggaaggaaattatatttttcagaaagcacttatatttacctctataaaattaatatactaatatgctattttaagtaacataacagaggagtatatgaagtctaagtgtataagtaaaaagttcatatcatgcagatttcaacttttccattacacaatggcttctctttctgcccttcccaggtcctgtgtcctaccccttccctgttatttctttatcatgtcacatgcaggtgctgctctactcacacatggcggcccttataatgcatacccaaaaaacaaattgaaaaggatgattaagaagagatatgggctgggtgtggtggctcacgcctgtaatcccagcatttttggaggccgaggcgggtggatcacttgagctcaagagttcaagtcctgcctggccaacagggtgaaacctggtctctactaaaatacaaaaattagccgggtgcgatggcatacacctgtactcccagctacttgggaggttgaggcaggggaatcgcttgaacctgggaggcggaggttgcagtgagccaagatcatgccactgcactccagcctgggtgactgagcaagactctgtctcaaaaaaaaaaaaaaaagaagaagaagaagaagcaatatgaatgaatgaagcctctgaaatctgtgcccacactgtgttagatgcttatgagcatctcttactttgctcacatcatggagaccactgtcccagacaatatccaatttccctgcattttccttctgcagcactttcccgtttttaacacacacacccttgtgagtccttggttgtctctgtttgcagctgcactcttaatttcctagagggcagtgcccacatgccccctgttcactgcagtatccccaaggccgagcacgatggctgccacgtcatgggtttgggtaaatatttattgacatgagttagaagttgcagttccctgccagcgcgtcccaggtaggctttgactttgctggtgcattgtcattgttcttgtttgttctcctcactgaagccaggctcattttcttttctattttatcttattgagacaaggttttgctccgttactctgactgcggtgcagtggtgtgatcatagctcagtgcagtctctaagtcctgggctcaagcaatcctcttgcctcagcctcccaagtagctgggactacaggcactcaccaccacacccagctaattttttatttgttttgtagagatggggtcttgctatgttgtccaggctggtctcaaactcccagcctctcacctcgatctcccaaagtgctgaaattacaggtagccacgactctcagcctccttccgttcctgtttcagcctcttgtcttttcatcttcgtatgtctatttgtggacaaatcttctttgtggaaggctttcattggccatatctaacacaaagcaggtgtttcttaacctttcttctgtctctgatagtgaataatttggaggagttaattttgtttttgtacattaaagggcagtgcttcccttctctgctggattaaaccttacgtttccccactagttttcatttttatttatttatttttttgagacagtttcactctgttgtccaggctagagtgtagcagcacaatcttggctcactgcagccttgacttccctgggctcaggtgattttgccacctcagctttctgagtacctgtgactataggcacgtgccaccgtgcccagctaatgtttatatttcttgtagagacagggttttgctagatttttgtatttcttgtagagataggattttgctaggttgcccagactggtctcagactcctgggctcatgcaattctcagcctcccagagtgctgggattataggtgtgagctaccgcacctggccttagttttcaatcctttttttttttttttttttttttttttttaagagggagtctcgctctgttgcccaggctggagtacaatggcgtgatctcggctcactgcaacctctgcctcctgggttcaagtgatacttctgcctcagcctcctgagtagctgagattacaggcacctgccaacacccagctaatttttgtatttttagtagagacggggtttcaccatgttggccatgctggtctcaaactcctgacctcaggtgatccacctgcctctgcctcccaaagtgttgggattacaggcatgagccaccacacccagcctctctacaaaaaaattaaaaaatgaattaggcatggtggtgtgtgcctgtagtctcagctactcaggaggttgaggcaggagaattgccttagcctcggaattggaagctgcagctgcagtgagctatgattgtgccactgcactccggcctgggcaagaaaaagagaccttgtctccaaaaaaagaaggaaactggagcctgaggcttccacctcagctttctgagtacctgtgactgtcggcatgtacccccatgcccagcttatttttgtatttcttatagagacagggttttgctgggttgcccaggctggtctcaaactcctgggctcaagcaattctcctgcctcagcctcccaaagtgctgggattataggggtgagctcctgcacctggccttagttctgaatccttttttttttttttttttttgagagggagtctcgctgttgcccaggctggagtgcaatggcacgatctcagctcactgcaacctctgcctcccaggttcgagtgattcttctgccttagcctcccgagtagcaggattacaggcaactgccaccacacccagctaatttttgtatttttagtagagacagggtttcaccatgttggccaggctggtatcaaactcctgacctcaggtgatccacccacctctgcctcccaaagtgttgggattacaggtgtgagccaccacacctggtctctctacgaaaaaattaaaaaatgaatcaggcatggtgttgtgtgcctgtagtcccagctacttaggaggctgaggcaggagaattgccttagccttggaattggaagctgcagtcagctgtgattgtgtcactgcactccagcctgggcaacagaaagagaccctgtctccaaaaaaagaaaaggaagaaaacaggagagcctgtggagggagctgcctgtggctctcactcattgcattacttgcaggtgctgaaacttcttcccatgtaatatgctggggttgttcctgcaattcaagatcaaaacagaggcaccaggaagggagaggaaatggataaaagggaagggggacaagatgccagacttcctagtaatccaagcacacatagtcaggagctggttgtctgggtgcctggattttgcagacctgggtctcccagcttggagcaggcagcacatgctgttcacgactcttcctaccctttcctggcaggtgctttctagtagtgcctgcagagaccaccagctttatttctccatccgcttcactggagccatggtgagtgtacgtttccccagattcattcaaatggatgactatcttcagcttctaggaccgctgtgactttgtgtctttttctagttgcatggagacttccgtgagaagttgagcaaaaacacatcagaaattggtatctccttgcctcttaatcctgaagtcaagattattctgcagtcattgcatccatattctcaaaatgcctaacatatttcagatcagaagttttaggctgtagctgggtgcagtggctcacgcctctaatcccattgctttgggaggctgaggtgggaggattgcttgaggccaggaggtggagatcggcctggggaacatagtgagaccccatctcttcgaataactaaataaataaaaaattagccaggcatggtggcgcacccctgtagtcctggctactcaggaacctgaagcaggaggttcacttgaacccaggagttcgagcctgcaatgagctgtgattgtatcactgcattctagcctgggtgacagagcaacactctgcctcaaaaaaaaaaaaaaaaaaaaaaaaaaaaaagttttaagcggaaattattctctgaaggttaaaaaataccctgcaaccgtcggagtagatagaaggggaggtttgatgcaattgagaggcctgtttctctcttgcctggataatttctcttccatatggatccctgagagaggtgtgtgtataggagaagttggaatgggaaataaagtccccctttgtatctgccttgctcatcccccatctccccatgcagaaaagaagacaggggtgaggtggcttggcctactatgaggaggccggctctggatgaacctaccacatagatgagaaacatgaccagaaatgggcttcagctctgagcacaaactttgagcacatcctgagagccaacccaatctgatttgctcctcctgttctgctatttggaggagaggggagagagggggcaatagcagcactaggaagtgcaatcagcctaccccaactctcatattcaacctgatgtggtttggttgtgtccccacccaaatctcatcttgaattcccgcgtgttgtgggagggacccggtgggaggtaattgaatcatggtgggggtggggggactttcctatgctgttcttgtaatagtgaagaagtctcacaagatctgatggttttaaaaagaggtgttcctctacacaagccctctcctttgcctgccaacatccatgtaacttgctcctcctttgccttccgccatgattgtgaggcctccccagccatgtggaactgtaagtccaattaaacttctttcttttgtaaattgcccagtctcatgtgtgtctttatcagcagcatgaaaacgaactaatacaacccctttacctcttttttatttgagagacagggtctcactctgttgtctagaccggacaactgcagcctgaaactcctgggctcaagcgatccttctgcctcgacctccagagtggctgggaccaaagcatagtgacatcatgcctggccaagttttttttattttttgtaaagatgaggtctggctatgttgtccaagctggtttcaaactcctggcctcaagcaatcttcccagctcagcctcacaacttattgggattataggcatgagccaccatgcctggcttgattttcttactctgctatggttaactgatatttttcattctaatgtaaagtgtgcataaaagcatttttttctatttttattgttctgcattatgtaatacatatacaaactttgtgcttgttgttctgctcccctgggaaatgggcttcctgggggttctggactgctgaaggcaatgaacctctctgggttgtccagacctttgttttactttgaccagctgtgtgaggataaggtagttcaggaactaggagagcctgctgaatgtaaaattccatgaacagaagcaagagaatgacgagactgtgctagttctttcagaataacagcagcacccttgcactgcacagagttaaacatcccagatctggaaggaccctaccttgtgtcaccagcagctgcaagatctatattagggcctctgaaccacgagaagccatgcatctattcctgctctaggtcgaaatgtttatttctataaatttttgtggccttggctgaatgactcaggaactgagagtgagagtgggggtgtgtgcagaagtgttggcctagcaagatatccttaggatggcacatttgcaaggttggcccttagctggtttctggagaattggagttttggaggggtcccaccattcctaaaacttttaagagtggttcatcaaggccaaactgtttgttcaaacaatatggtttatgctaagcaccctttttccttttgggagtcttatttatttatttttaagtggtaaagtctcactctggtgcccaggctggagtgcagtgacacaatcagagttcactgcagcctcaatctgttggcctcaagcaatcctgcagcctcagcctcccaaagtgctggggttatacgtacgtgtgatccactgctcctgcccctgtttgagagtcttgaatttgagtacatgccaggcagagagtgcctgcatgaccagctcccaatgaaaaccttggacattcattctcaaatgaactttcctggtgagcagcatttcacatctattgccgctactcgttgttaggggagtgaagcatgtcctgtggatgccactgggagaggattctgaaatcttgagcctggtttcctctagattttgccccacactctggatccttcagaagattgtgtgttgtattctttctccatggtaaatcatagctacacatacaactgtatgctcagtcttgggaggacttgtaccaaactattgaacatggtaatgggtcttgggggttcctccaacacatggcccacccacctaacgtgggttaggtgggttacactggacaatttaaccttaatttctccaatgcataacccatctgaaagccttcagtccccttcaaaccaagttgctactgctaagtcccttttataaaaattctggtgctgctgtcaggacaagaacatggtttttgccaccttgctactctgtattagtttgttctcatgctgctaataaagacatacccgagagactaggtaatttataaaggaaatagctttaatggactcatagttccacatggctggggaggcctcacaatcacggcagaaggcaaggaggagcaaagccacgtcttacatggtggcaggcaaagaaggagaggccatgtgcaggggaactcccctttatcggatcatcagatctcatgagacttattcactgttttgagaacagcacgagaaagacccacccccatgatccaattacctcccactgggtccctcccatgacacgtgggaattacgggagctacaattcaagatgagatttgcgccaggtgtggtggctcacacctgtaatcccagcactttgggaggctgaggtgggcagatcacctgaggtcaggagtttgagaccagcttggccaacatgatgaaacgctgtctctactaaaaatacaaaaattagctgagtatggtggtgtgcacctgttatcccagctacttgggaggctgaggcaggagaattgcttgaacccaggaggcagagggtgcagtgagccgaaatcgtaccactgcactctagcctgggcaacagagccagatgctgtctcaaaaataaaaaaaataaaaaaaatttgggcggggacagggacacagccaaaatatatcacacccccatcccctcactccagttatcagccccacagtgtccctttctcagtcttcatcctacttggccctctgtggcattgaacattactagagactaaccacctgcccttgattggaggtgtcccttgatctctcaggcacatgcctctctcttggttctcttctcagactattttgttcccattgtcctttgtctcctgcctcttatgtagagtgcaacaggatatcaaaagggcactcttttgcctcaattttaggccataaagctgaagaataatacagtagatgccaagttttcctcctagaagtacatgctagaccaccctcaagctaagatggcatcagctctgctgccactatcccattgttcttctctatggctcagtgtgcttgggctgctacaccaagataccacagacctggtggcttcatcagcagaaatttgtttatttttttgtagttctgaaggctgaaagcccaacctcaagatgctggtttggttggtttctactgaagcctctcttcctgtcttgcacatgaccactttttgcagttctgaaggctggaagcccaacctcaagatgctggttgggttggtttctactgaggcctctctccttggtttgcacatggccacgttttatcagtgccctcacttggacattttctctgcgcatgtgtgcatatggattagggctccatagttatgagacaatttaaccttaatttcttccttaaaggccttgtctccaaatacaaccatattgggaattaacctatcaactttgatgggacccaattcagtccataacactttttaaatttaattcaactgtatttaattaatttattttttgagacagggtctttctctgttgcccatactggggtgcagtggcatgatcatagcccactacagccacaacttcccaggatcaagcgatcttcctgtctcagccttctgagtagctgggactaaaagcacacaccatcacagctggctatttttttttttttattgtaatttttgtaaggatgagctctcactatgttgcccaggcaggtctcaaactcctgggctcaagggatcctcctgcctcagcctctgaaagtgatgagattacaagcatgaaccacccatgcccagcctcataacactttttaagaggttgacattaaaggattaggcaaaagaatttccttgggaaatagttgaattttttcctaaccttctcagggtggggaaggggtgttttctcattcaatttgagctaaaggtgtttcctaagagccatttgtagagattgacttgtgattgctgcagtataaagcataaaggcagcttatgtttcagccacctgcaaaaagtttaaaggcctgggctggagctggagctgctgttgagtttagtaaccaagcagagcaggagagggctggctttggaagagctgccatctcaatgacacatggggcaatggaggagcctgcttgggggggtcttcaggacctcctagagtgctaatgttgccccagaggagggagagaccttcagaagcccagaggtttggggaggacattttcagtagccaaaagggtgagaggcctgggcccccttttcccttactcctccttctaagcctgtccaactatggtgtggctagaaaccacagctgcacagtggggaaggaggtggactcaataagagtggtggtggtggtgggggagaccctgatctattcctcttccccactctaggtttactagactgggtcaaacccaagtcaaaagaaggaaggtgttttctttcaaaggaaggaagtctgtaatgtgattagtagcctgcacggaatcttttattatctaaaagttactggatgacttttgattccttaagagtttataacaaagcaatgggaccagcccagtactctctccagggaaagatatgagacagggaagctcgaacagggagttgtgagaaagagcaaagtgtttctgcttgcatcctgtggagtctagctcatccaacacgccacctacatagctgctcctcaagccctttgctgagtcctcttctcttccctgccttggtcctttccttcctttgctcttgatgagttcatctggctagatacgaacaactgaattcactgtttaatttttaaattttatttactttttgaacaggtaaaaagtcatatggttcaaatatccaaaattgtgaaaagatatttaaggttaggcagggtggctcacacctgtagttctagctcatagtgttacaggaaaggggtcctgatccagaccccaagagatggttcttggatctcacttaagaaagattgtggggtgagtccatagagtaaagtgaaagcaagtttattaggaaagtaaaggaataaaagaacggctactccataggcagagcagccatgagggctgctggttgcccatttttatggttatttcttgatgatacgctaaaccaggggtggattatttatgcctcccctttttagaccctatagggtaacttcttgatgttgccatgacatttgtaaactgtcatggcactggtgggagtgtagcagtgaggaggaccagaggtcactctcgttgccatcttggttttggtgggctttggctggtttctttactgcaatctgttttatcagcaaggtctttatgacctgtatcttgtgccgacctcctatttcatcctgtgacttagaatgcctcaccatctggaaatgcagcacagagggtttcagccttattttacccagctcctattcaagatggagttgctctggttcaaacacctctgacactagcactctgggagactgaggtgggagggtggcttgaggtcaggagttcaaagttacagtgagctgtgatcacaccactgcactccagcctgggtgacagaacaaggccctatctcaaaaaagaaaaaaaaaaaaatagatactaggttggtgcaaaagtaattgcagtttttgccatgctgatgtaatgggaattctggagtccatggagacctgaaacttccaggagaagctttgggggtggggtaaaggcagctccccattccccacctacaacactgtacttgtgttccaggaagctgtgtatgcattccaggagtagcttgcacacaatttgcgagactcggttaaataaaaacatcctgttctccaaatatcagggacgtgtgttctgaccactgatcagtggttctgactacagaggtgcagacaaagaggctggaagccattggtggtgcacctggccccctattgcaagccccttcccctctggttgaagttgctttcaggggattttaaggtccagtatcctgttcctccatctcgccttccccaacttctccacttttattttccccctgtggggagccagacattaaggagtgggacattcaaaagcaattgcctctacaaggaacgctagaaagtgactacacaggcccagggaaatgtacaggcacagaaaagacctgagaagacattcagtttagtcagattgatcattggcatagagacaagatattcaggcttgggtggtaaagacagctccccattccccacccacaaccctgtactagtgtttcaggaagctgtgtatgcattccaggagtagcttgcacacagtttccaagaactaggttaaataaaaacatcctgtcctcgaaatatcagggatctgtgttctggtcactgatgattgcagtgtttccttcctctgaaccttgatgagttcatctggctggatacaaacaactgaattcattgtttagtctttacattttatttattttttaaacaggtaataaatgatatggttcgactatcaaaaattatgaaaggaggctgggtgcaatagctcatgcctgtaatcccagcactttgggaggccgaggcgggtggatcacaaggtcaggagatggagaccatcctggctaacacagtgaaaccccatctctactaaaaatacaaaaaaattagctgcggtggtagcaggcacctgtggtcccagctactcgggaggctgaggcaggataatagtgcgaacccaggaggtggggcttgcagtgagccgagattgcgccattgcactccagcctgggtgacagtgcgagactgcgtctcaaaaaaaaaaaattatgaaaagatatttaaggctaggcagggtggctcacacctatagtcctagctcctagcactttgggaggatggcttgaggccaggagtttgagtttacagtgagctgtgatcacaccactgcactccagcctgggcaacaaccaaaacagtaaacaaaaactaaaacaatacaagtaaatgaaaacaaataaaaaatgacaaaaataataacaaaaaataaatccttgggagaggggagaatctgatttccagagataccacttattacattaacatatccagttttcagcaaaaaaaaaatcacaaagcataaaagaaacaagaaagaatggcccattcaaaggaaaaaaaaataagctgttcctgaaaaagacctgatagcagatcgaatacacaaagaataaagaaagacattgagaaagtcaagaaaataattttgaagtaagtttatatcagtaaagagatagaaaacctaaaatgaaacataagagaaattctaaagccaaaaagtataataatggaaatgaaaaactcactagaagggttcaaacaggcagaaggaacaatcagtaaacttgaagataggacaaaggaaattaccaagactggggaaatgaaagaaaaaagattgaaggaacgtgaacaaaacctaaggaatcgtgtccatcaagtggaccaattgacctattgtgggagtcccagaggaagagaagataggggagggagcagagggaatatttgaagaaagaatggttgaacacttcctaaatttgatgaaaaatattaaacattcaaggagattgacaatatccaggtaagatgaactcaaagagacccacagcaagacacattatcagctttcaaaagacaaagacaaagagaatctttgtagccgtaagagagaggtgtctcatcacatatgagattgtcagtaagattgtcagcatgtttctcaccagaaactttggatgccagaaggcagtgggctgatatgttcaaaatgataaaagaaaaaaatacctgtcaatcaagaatggaatatccagcaaaactgtccttcaaaggtgagggagaaattaagacatttttagataaacaaaaatctgagggagtttgttatgactagacttgccctgcaacagaggctaaggagagtccttcaggctgaaatttacggacactagacagtaacttgaagccatatgaagcaataaagatcacaataaaggtgcaattatgtgggcaatcataaaagctaatattattgtaacattggtttgtaactctacattttgttttctacataatttaagacattaatgcgttttcaaaaattactagtttgtggtttgggccatgtaatgtataaagaggtaattttgtgacatcaacaattgaaaggagtgggaatggaaatgtaaaggagtagtatttttgtatgttattgcagttaagctggtataaatccaaattagagtgtataactttagtatattaaatgtaatccccatggtaactacaaagaaaatagatataaaatatacacaaaaaggaaatgagaaaggaatttaaatatttcactacaaaaagatcaactacacacaaaagaatacagcaatgcagaaaatgaggaaccaaaagccttaaggcatgtggaaacaaataggaaaatgacagaagtaagttcctccttattagtctaaaaaaggaaggaaatgctggcatatgctacaacatggatgaaccttgagggactttatgcatgaaataagccagacacaaaaaggacatgattctacttgcatgagatacttggagtagtcaaaatccgagagaaagtagaatggtggtcatcaggggctggagggtagggggaatgaggagctatggtttcatgggtgggggtttcagttttgcaagaagaaaagaattcagaggatggatggtggtggtaatggttacacaacattatgaatgcatttaatactagacctgcacacctaaaaatggttgtgatggtacattttatattatgtatattttactaaaagaaaaaagaaggagctgtcatgagaacatgctctactattcctatgccccacctgccagacgtgccaatgaataaattgctattattagtttttcgggagtgggtacatgtctggatatttttatataaatacttatgcagagaaatcagactatatattctccttgacctccccatttttttaaccaaattgtagcatactaaaatacagttctgtaccttgcttcttcaacttgagaagctatcttgaagatcttagggatcttcctatagatcctggagacttttttttttttttttttttttttgagacagagtctcactctgtcattctgtcgcccaggctgaagtgcattggcatgatcacagctcaccacaatctccgcctcccaggttcaagcgattctcatgccttagcctcctgagtagctggaattacaggcaagcaccaccatgcctggctaatttttgtgttttagtagatggggtttgccatcttggccaggctggtctcgatctcctagcctcaagtgatctgtctgatcggcctcccaaagtgttgagattacaggggtgagccaccgttcccgggcacatcctggagactttcaaatccacatttttttagctgtcaggcactccttgacaccatcctgcctgcaccttgaaaccagcatttccccagtacgtcctcctcctgacttctttgttgttcctagtttcttttcttttctttttttttttttttttgagacagagtcttgctctgtcacccaggctggagtgcagtggcacaatctcggctcactgcaagctccgcctcctgggttcacgccattctcgtgcctcagcctccccagtagctgggactacaggcgcccgccaccacgcccagctaatttttttgtatttttagtagagacggggttccaccgtgttagccaggatggtctcaatctcctgaccttgtgatacgcccacctcggcctcccaaagtgctgggattacaggcgtgagccaccgcacctggcctgttgttcctaattagtttcatggtccctttggtgtcgcaaaccagacacctcagcatcactcttgcctcctgcccttccagtcagttgccatgtctcgttagttccatctgaaatgcccttttcttttatccagacttctccaatccccatcctccacactggctgccttccctattgtcttaactaagaccctttccccagtcagctctaccccaccaagtctaaccttcatactgtccccagattgatctttggtgagcaaagttctggcgctttcatacccaagcctgggcaggttctactgactctgcatcgaagatgagcccctcagcctgccttgaccttctgggcccagcttgtcctgctctcttcctatggggatcctctatccagcatgaagggtggtcggtcaccttccctccttcctggcatcctcaccattgctcaggccactcagcttatctccctttgcaattcattagaatccttccctcttttaaaggctcactgcaaaatcatggaaaatgacctgtctggaccctgcgttcctgactttgtcctgccttaacacaatgcttttaggtcaattatagcactcccttcattctgccttgagtaatggattgcaagcccctggaagctaagctgcgccttatgctttggagatttcatcaactaatttgaatggagtctcagatagacattttttcttcttgttaccctttgaagcccacccacttttcctgtatattcctctcctcccttttattttgcagtgatttttttaaggattattttacctccttatgagaattttggctggttggtcttaatgaatgttgtacagtcctggcactcctgcagcttcctgccctagttcaagttcattactttgactcacatagcagtggggaaaccacgagacacagtccttggcaggctagctttctgtgcttcttgctaagtggatcatgatatttggaagctagagaagggaaaatgaggcctggtctgagtgaattacattctttcttcctgcagctacttgctcattcaagagtgataaaagaatttaatcaaagcttttgcatttaggacctcctgcattccatgaaaggttgcagatctaggaagagactcaccattgtcttttgggggcatgtgattctgtaatggcagtttgatgggaccctgcagggcctgaacaggttttgttcatcagaccaattcttttctggtggaagagacttcagacgtgtgcagggttctctgtgaacgacctgtatcccctccctgggaatggagcacccatagagaattactaagatcctgactgcagacaaagaggcgatttaaggagcatctgttttgacaattgccatttgcattaaagctcctgatagctatctctcccaatttcccactaactttcttcctaaacacccagataggaaaacatactataactctcaaactttgaaaagagcttgagatcctgtgatcctatgccaggaccaagggctggggtctctgatatcaagggaaggcagtacaatacgggggttaataccagggttcttgtcgggtgcagtggatcacgcttgtaatcccagtgctttgggaagctgaggtgggaggatcacatgaggccaggagttcaagactagcctgggcaacatagtgagaccctgtctctacaaaaaatttaaaaattagccaggagtagctgggcgcggtggctcatgcctgtaatcccagcactttgggaggccaaggcgggcggatcacgaggtcaggagatcgagaccacgatgaaaccccatctctgctaaaaatacaaaaaattagctgggcgcagtggtgggcgcctgtagtcccagctactcaggaggctgaggcaggagaatggcgtgaacccaggaggcagagcttgcagtgagctgagatcgtgccactgcactccagcctgggtgacagagtgagactctgtctcaaaaaaaaaaaaaaaaaaaaaaaagccaggagccaggtgtggtggctcacgcctgtaatcccagcactttgggaggtggaggagggcggacggatcacctgaagtcaggagtttgagaccagcctggccaacatggcaaaaccctgtctttactaaaaatacaaaaaatgagctgggcatggtggtgggtgcctgtaatcacagctacttgggaggctgaggcaggagaatcacttgaacccggaaggcggaggttgcgatcagccaagatcatgccattgcacttcagcctggatgacagagcgagtttctgtctcaaaaaaaaaaaaaaaaaaaaaaaaattagccaggcgtggtggcacataactgtggtcctagctactcgtgaggctgaggtgggaagatcactcgaacccaggagttcaaagctgcagtgagctatgattgcaccactgcacttctgggtgacagagtgagatcctgtctctagcaaaacagaaaacaaaacaattaagattctgagctgagcccccactctgcctcatggtagctgcatggccttgatacagttattcttaacctctttttttctaagttatctcattgataagatgtggaaggggagaacctatttatagtgttggcatggaattcaacaagggaatacatgtaaagccctgagctcagtgcctggcacatagcaagtgttaaataagtagttcctattatttattattactctctgaaatgatgaagaatggcctctggtggctgacctgagatgcaagagctagaccacagggagccatttagatttcagtttgactctgtgtacctggtcgccatagcactcgcttggtaagaaaagctgggatcaggagacagtgatccagacagaccatgtcagtgagtgaccttttgaaaggtcacaaaaagcacaggcagactgctggggctggaatctcagctctactccctgcgtaagcttctgcaagctactgaacctctttgagcctcagttttctcatttgtcaaatgggcagcaggaagatgtaaatgaattagtatatgtcccagcactttgggaggcggtggcaggtagattgcttgaggccagcctgggcaacatagcaagaccttgtctctgaaaaaattttaaaagattggccaagtgtgatggcatgctcctgtagttccaggtactccagaagctgaggcaggaggatcccttcagccgaggagtttggggctgcagtgagctatgatggcaccactgcactccagcctaggtgacagagcaagaccctgcctctaagaaaaaaaaaaaaattgtgtgggtattttaaaaaaccatgtccaccacgttgtgcgtgcccagtaaatgttagatattattatgattatcaggtttcctggaccttgcttcagcctggcagcttgggagtggtttttagggacttagtgtaaaacctacctctgagattctatttgtttccgttcccctaaggttgagggtgtgggggcatagggatcagacctctgggtacaatgctgataacttttggggggtattcccagccctgtttgtctgttaaattaaaatctggtaaagaggtcatttctgtagtctaaatctgaatgtttatgttaccagtagggttggtatagaattgtagattagagggaagagtcttcatttactgaaggtctgcagaaaatgtgctgtgtccttacatacttaggaaccagagctgagaaatatcgggagacagctggagatatgggggacctatcctgattgttcctccaaccatgggcctggagacatccccctttgctcattgagtaacaaagagagtgcatgagaaaagaagactgttttcccaatactctaacgctcaagacaaaatataccaaagtgtgggtttttctccctcaccaagaaattccccaattatctgcaaacactggactggatgtcctacaattaaattgaattccgttactatctgttactatctatctggagttaacattatttgaggagcacctgtttagacaatttccatttgcatcaggtccctcaggtcaagggctcagtcccacaagattgctcccacttaggacaccatttcaaagtccacgtggccacctgtgcttctgaccataaatcagaggttccctccttgggttcattcatttactagagcagttcacataactcaggaaagcactttactaattattacccatttgttagaaaagaatacaactcagggaaaggcagagaggcgtaaggtaatgggagtggtacatgcagcttccacgccctctctgagagctccatcctcccagcatctccatgtgttcaccaacctgaaaactgtctgaacctcatacattagggatttttatgcagatttcatcatgtgcgcctgattgattatgaacctagtcttcagctcctctttcctccctggaggttggggagatggcactgaaatttccaaggttctaatcatggtttggtgtttctggtgatcatctcccactggaagcccaccaagaagtgcttcattagaacaaaagacattcctatcacccagggaattccaaaggatttaggagttctggccaggaaatggggtcaaagatcaaatattggccaggcacggtggctcacacctgtaatcccagcactttgggaggctgaggtgggcggatcacgaggtcagaagattggctaatcttcactggctaatacagtgaaaccccatctctaccaaaaatacaaacaattcgctgggtgtggtggtgggctactcaggaggctgaggcaggagaatggcgtgaacccgggaggcggagcttgcagtgagctgagatcgtgccactgcactccagcctgggcaacagagtgagactctgtctcaaaaagaaaaaaaaagaccaaatattagaacaaaagatgctctttgcaactctattacttagggaattatcagtgttttatgagctgtgtaccaggaaacagagacaaagatttctatagctatatctgtctgtctatctgtatgtatatatttgagatggagtcttgctctttcacccaggctggaggccaatggcatcatctcagctcactgcaacctccacctcccagacttaagcgattctcctgcctcagcctaccaagtagctgggattacaggtttgtaccaccacacccagctaatttttgtatttttggtagacatagggtttcaccatgttggccaggctggtctcaaactcctgacctcaagtgacccacccatctcggcctcccaaagtgttgggattacagcatgagccactgcgcctggccaatatgcatttcttattataaatcaaagtatcacaagcgaaaaacatacattggccaatctggaattccaaacgtcctctcctaaatgactagaagcaaatatttccatgatctgtacctcttctgccaagtcacgtgtactccacgccatagttggccctgcccataggatcctgagtgcccttctccatcgcttcttctctggccaacaatttggaatagcaaatgagctgctccctttgccaggaccaagatgtgtttcagaagcatcatttctgcttgtcagcttttggtctgtagttcccagccaagtgcaccatctgtgagcactgcctggtactgtgatgatttggcccagagctccatgtggacctgtgaaatgcaccagttccaaactgctgcgctccctgcaccctgagtcgaggtttcagaggtgggtggtcttgctcctcttgctaccttgaaggtgcactgttcaaagacagcctcgttctcctggtgctggcaagcatgggttttgccacatctcgtaaactatgaggttcccaagtgggagagaatggtgcccattatatcacggtcaggagcagcctggtgggcatatcttagatcaggtctcatgtgtttttttttttttttttttttttttttgagacggagtctcgctctgtcgcccaggctggagtgcagtggcgcgatctcggctcactgcaagctccgcctcccgggttcacgccattctcctgcctcagcctcccacgtagctgggactacaggcgcccgccaccacgcccggctaatttttttgtgttttttagtagagacggggtttcactgtgttagccaggatggtctcgatctcctgacctcgtgatccgcccacctcggcctcccaaagtgctgggattacaggcgtgagccaccgcgcccggccaggtctcatgtgtttttgtgtgtgtgtgtgtgtgtgtgtgtgtgtgtgtttgtttgtttgttttgagacagggtctcactctgtcaacccaggctggagtgcagtggtgccatcttagctcactgcaacctctgcctcccaggctcaagtgattttcctgcttctgcgtcccacgtagctgggactacaggtgcccgccaccacacctggctaatttttgtatttttagtagagatggggtttcaccatgttgcccaagctggtctcaaactcctggccttaagtgatccaccctcctcggcctcccaaagtgctaggattacaggcatgagccactgcacctggccctcatgatgtctttgcaaaaatagattcgtgtccttgagcttctaagcctctatgaacagttagacctcactgtgggtgcagatagtgagatgatgcccactgctgatagaccgacattccagagggagtacctgggcaaaagaaccacagtacttggggcgtctcctagtccagtgcttcttaaccttcctcttctttttttaaataagcacctcccaagaaccttttcagatatgcatttttctagttgtcccaccctcttgaaattttgtacagatacactgtgtattatgtactgtagccctagaagagccgcaagccattgtaatatctaacattggctaatgttattttgttccctaagaagccattttcaccccattgtgggtgatactgtcactcttgagaatgtatagtttagttcaagactgtttggccatccagccccacctgtgactagtggaggtgatttggggtgagcagagagttactgcacaaatgtaacaagcatgtctatccaagacgtggagccacgtggagttagctttcagaggtgtcaaattctaggtagactgggccattctcctttccctctagctttctacttttcacttttacaaataccagttgagtatctatctgtaggcaaatatcttgttctatattcaagataaatgttgttttattttttctctaaaaatgaagttattaaggtcaggtatggtggctcatgcctgtaatcccagcactttgggaggctgaggaaggaggatcacttgagcccaggagatcaagaccagcctgggcaacatagcaagaccccctctctattttttttttccccagacagagtcttgctctgtcgcccaggctggagtgcagtggtcttaccttggctcactgcaacctctgcctcctgggttcagcgattctcctgcctcagcctcccgaatcgctgggattacaggcacctgccaccagacccagctaattattgtattttttgtagagatggggtttcaccatgttggccagactggtctcgaactcctgacctcaggtgatccacctgcctcggcctcccaaagtgttgggattacaggtgtgagccacctcacccaacccccctctattttgttaagtgcattgttagatccaaaggaaacagcactttacaggatcttgattggtacttcctgtctatatctgggacaagtacaccaggaatgcattatagaggtgatctctctgtatttctggcagcatcgactagtgtgcttttggaagtatttgataattttgaaggcaagatggtaactcgttgcttgaattagctttcttacgattaccagcaagagtgaaattttagacttatcttgttggatgataagataaatcaatttcttctccagaggccaccgactgcccctcttcatttggtggttaaatcctccctttcccattgacttgccacgcctccctaatcctttaggaaattttacctctgctgggatctgttcctggacaatctgttcctggacaatctgttctgaattattggcatcttgatgctcacatctgcttggcattgtgaaataggttttgaatgaatattctttgaaggtgaatgcactctgagagggcattgatttatgtgtgggcatttggacaaactcttgtgtgcagacacctggctgtctgtgctggctgcagccaaggtagggatgtggtgaacttttgatggagttgcccttttgagcagttcagagggtgcagaatgctacactgatgactcctggaggacccaacaatgccttgaaggttcgctcttgtctgttgagttggctcaagtccaccttctgattactgtcagctctagcatgaaagatccagcagatgctgaattgaacaaagaaagaacgagcaagagacatcattcattcattgtacaagtacatactgaatgcctgctttggtgttcaatatacaaagatgtttcagaccaagtccttgaccttgcagaactgacaatcttttgcttgtgagataggcatgcaaatcagtgactgggatataaggttttattttattttattgttttattattattatttttttagatggagtcttgctcttattgcccaggctggagtgcagcagtgcgatcttggctcactgcaacctccgcctcccagattcaagcgattctcctgcctcagcctcccaagtagctgggattacaggcatggacaaccacacccagctaattttgtacttttagtagagacagggtttcaccatgttggtcaggctggtcaagaactcctgacctcaggtcatccacccacctcggccttccaaagtgctgggattacaggcatgagccaccgcacctggccaggatacatggttttaaattctacagtaggtacacatggagttagtaggagagagagaaaaaaagttcgaccagttctgcctaatgagatcaggaacaaaacaaaaagagaacatgacatttcagctccgtcttagagaaagagaattcaccagatagacaagtgagggaaggcatcccggacagagggataggcatacacatgcacgcagaggtgtaaaggagcttgtattttatgcaaaggttggggacaaattgatgcaaaagagatagtgaggcttgaacactatgctgaggtggtatccctattttcagtcaaaggtgctgttcaggccgggcatggtggctcactcctgtaatcccagcactttgagaggccaaggcaggcggatcacttgaggtcaggagtttgaggccagcctgggcaacatggtgaaaccctgtctctactaaaaatacaaaaattagccaggcttggtggcttgctcctgtaatcccagctactctggaggctgaggcatgagaatcacttgaacccaggaggcagaggttgcagtgagccgagatcacgccattgcactccagcctgggcaacagagcaagacaccatctcaaaaacaacaaaaaaagtgctgttcaaatatagaaagcatgatgagatttggtcttggggaattaaactcagaactgcatagaagagactgcgaaggtaagagtgtaaaagccgtgctactcataacagaatcgtagctaggaacattaattcttagaaggattttctcaccttcatggttgaaaagggaactagccattgagtaatgaggaagatacagcaaccacagatacttaagaggtgaaatcaagaaggcttgatgactacatgtatatgtgggtgacaaggatggtggaagagatggggtgaagctgccacttccatcatgtacaactgggcaattcggagtaaaaggagaagcaggggtgaggtataaccatgttaagtgggaagtgatggttggacatttagctagaaatactgtcaaatgtttaggaatatgtggttttggttgtactaataattgccagtttcttgtggtactttcagtcattgaagaacattgaacagttttaagtaatgttaccagctcttcttcattgattgaggtcatgccaagaagaaaagcgtagaggtgtttattgcatcaggtacggtaggtcaagttcagcttgtttgcaactcatatttacatcttctccttgcaggggatggccaggtggattttgatgaattcatgaccattcttggccccaaactggtgtcttcagaaggtcgcgatggttttcttgggaacacgatagacagcatattctggcaggtgagtaagaatattttttttcagactaagtttgacagtaaatgtgtctgagactaacttttgactgaattcttgaacttctatttggcacgtgaagatctcttctgggctgagcgacatatgttccagaacaaagaatcaaaacaactacttttttagggtttggaggagtgaaatatctccccatttttttcttgtagcaatttttttttgcattagggaaaaatgaaattattctactgcacattcacaaaagtctttttcctggggacacttcaaaggggcacactgatattatctgaaccggttctgtgtttgaccccagttccgggatatctttgctgagagaatggcatggttgcctggtacatttggatcccgtcaatatccttgcacttaatgagagagaatggttttgtctaagaatgtgtattcagtgcttctcaattagctcctgtttctatcttgtaaaatctcttaggaaattccaaacatctaacattgtaattattaaagtataatgaaatcatttttatattagttctctactcttaaaatgtgacaattattttatgattataaaatttagggagtgggttatcaatcattattttaaaaaatttgaatcacgtaagttgtctgtcaaattaaattaaattaccagttagacacgtaaaacgccattcagacacagcatgatttttcttttttttaaatttcttttttttttttttttaattttatttattttattttttgttttttcccttcaccaggagatttctctaacctagataagggttgcagttggtgtgtctttctagtcttattcaggtacccatcttgcatagaaccaacaagtatttagtaagaacttacatatgctataatctatcagtgcttgtgggttttacaaaaggcatttaagactcagacctagctatttcacaatttggctggggaagctgaatttggtggctcatgcctgtagttccagtgctttgggaggccaagacaggaggatcgcttgaggccaggagttcaagaccagtctgggtaacatagcgagatcccgtctctgcaaacaatttttaaaattagccaaatgtgatggcgcatgcctgtagtcccagctactcttgaggctgagggaggaagatcgcttgagcccaggagttcaaagctgcagtgagctatgatcacaccactgcactctagcatgggcaacagagcaagaccctgtctcaaacaaacaaacaaaaataataatttggctagggaaacacaattaagagagggaaaacaaacaagtgattaattagtgtgatggtcactagactgtaactccttgaagcacagggcttcagagttgtagctcactctgtgcatgctgtacacagcaagccctcaataactatttgtttcaatagatgaatggaagggcaagaaaggaggaaaatacagtcttgaagggtcagaaaagaatttagggaatgtgacacttgctttgaaccttgaagtatgggtggaattaaatgcaaagaaagaaaagagggcatttcagttctgccatgatgagagtttgaaaaggggttggcatggggaagtcattgaccatgactaagataccgtttgaagggcaagacctcaaaacccactggcagaatggatttagggcctgaagaaacagaagaggtgaggctgattccagagttcccaacttgctgttattggcaggggtcagatcatggagcaacagagaagtcttgtggggttgaatcctcaattggacatgctgagtagaaggtgagggtcaagcagccaagtaaagggaggaagtctatgcacagctgaaatcagttggggctggaacaccggattgagattcatgagagctggtgggtaaaattataggcaaggatgagctcaccgagggaaggtgcataaaagaggatgagcagagagatgggacctggtcccagaggacatccaggatcaggggagagtgagacaggggctcgtgaatcccccactgctgacaggaaaacgccatctccctgaactgttgttaggatccagaacatctccaggaccctactcaccatgcaaggagaatattgcagtgctcatggaaccttcagttatgacttgacacttgcaaggaccaataggtagagtcccctggtggaaataagaaatgaccccagagttcagaagatgaaggaatattgtttcccatctggccatcttttgacccatggaggtccactctgatgatgggccttggcgagttgcttctcccctgggcgtttctccttcttctttctctcattctccatctattctcctgaatgcctttttgcttgttttttgtgtattttagagatagggtttcattccgtcacctaggctggagggtagtgatgcaaccatagctcactgcagccttgaactcctggactcaagtgatcctcccacttcagccttccaagtggctgggaccacaggtgcaagccaccataccctgctatatttttctgtgttttttggtagatatggtgtcttgctatgttgcccaggctggtctcaaactcctagcctcaagcaatcttcctgccttggcctcctaaagtgctgagtttacaggagtgagccatggcacctgagcccctgaatgcttcctactctttacctccatccttagggccaactaaggagaatgttccaaggccttgtgagttctaagcattcttctttctggccctcatctggatgagaaggagctatggctacttaatctacactcctactcctcctgtcttccaggttcatcacagtagagcgtgtacactgcaaggaaatatatctcttacaatatatggactgcctgtagcttaattcagacatgctataatgctcacaaagtctccatgtttttgtcttactcaagattttcttccccactcagggtgaaaagataggctggagaaaggagggaaaattccatcttgaaatatttaaatcaatgctggaagtcacagacttagtggctgtggctttcctctcctgctagtgctcacccagctcagaattttacgactagcaagcaagaacaaaaacatccatcaattctcagtaatcagcctccccttcttccccctgcgactgcctgccccttcagagacagcgtgaaaaaatggtacttaaaacttctacagcattggcttgtttctggaaaagagttcaggttcccagtgcttgggtggtttttcaggtttagaagaaagctgagtgtgtgcatgtgtgtgtgtgcacatatatatacatgtgtgtttccttccttgaagtgattgaagataatatacaaaaaagaagcagaaaggttgctttcccaacacagtgagagcctgtctctaaagcagattgaaaaattagctgggcatggtgttatgcacctgtagtcctagctgctctggagctgaggcaggaggattgcttgaggccaggagtttgaggctgcagtgagctgtgattgtgccactgcactccatcctggctgacagactgagacctgtctcaaaaaataaaacaaaaataaaaaataggaaaagtagcttttcacctccagatatccaggcagaagatattgatcttaggaggtactgatatccttgaaagaagaccatcctacttaagagactctagcaaggcttcccatcagtgacatagtcagttttccgtggaaacagacctgagactacttctagaagggtatatatttgtggtctttggctgcataatacattacaccaaaatctagggccagaaaacaacactaaatattttctatctcacttagtttctgtgggttgggaatttgaaagctggctgagctgggtggttctagctcagggtctctaatccagttgcagccaagatgctggctggagctgtgaccagccttgggcttgactggactggaagatgtgcttcctggtggctcactcacctggctggcaaggtgacgctggtggttgacgggagccctcaggtccctactgcacagaccttgccacaatgctgcttgagtgtcctcctgacatggcagccagtttccctcaaagccagtgatccaggacagtgctaggcaagagcaatgatatcttttatgccctagctatcaagttggacacaatcatttctgcaatattctcttggttacacaggtcatccctattaagtgtgggagagaacagcctcccggtgaatgccaggaggcaggagccattgtggatcactttggaggctagctaccataaagggtaaagattctgtaattggacttcaacttctgatctgacattgctgccccaagccttccattttccccaggcttgggtttcttcctaccttagaggaaacctataaccaaggctattctctgtatcactgagaagcaatcctatcaagcactaggtgccttttcctaataaaatccttcttccaggccagacagggtggcttatgcctataatcccagcacttagggaggccgaggtgggcggatcagttgaggcggggagtttgagaccagcctggccaacatggtgaaacctcatctctactgaaaaaaaaaaatacaaaaaaaaaaaattagctggatatggtggtaatcgcctgtaatcccagctactcaggaggctgaagcatgagaatcatctgattctgggaggtggaggttgcagtgagctgagatcgagccactgcactccagcctgggtgacagagcaagaccctgtctcaaaaataaataaataaataaaataatttttttccagtgctttccttactggtgttctagcctatagtgccaagggtagaataaaatcaaatgggattcagcaaaaacagctatttattggttggtactagtcgcaaaagttatgagcccctggctctttgcaggaaattgattaacagtgaagggggaatatagttggctacaaatgcggcttcctttccggggaggatggtctgagagtcatgccccagggtctccagtcctcccggcatacgctcagccctctgggtgtgagactcttggcagccagttcagaaccgctttcctatgcataagttgtaaagctgtgattgtgttcttagtcttcgttcatcaagcttctgtgtgtttttttgttactgcagtggtatatttgctgaggaaatgtgaaactgtgtatggagtcagccttaggatatggtatatgggaatggcagagaggagaggagggaaggaagggactgagcggggctgagactcaggactggggggtaggcttcctgctcaatgctgcaggttaattgcacctgccaagaagtcaagcacggtcctcagggtccctgcttttccaccatttatttacgccacacatcatgtgcctacttgtatccaagaataagaggcttatgatacagtagatgtccccaagtggcagaggaaagagccctgctattttatcatggtgttttcatgaatttaccccagcagcctttttcattttcttctgcttgacctcaagccccgtgcaaccgtgttctgccatgagtttgcagacagcaagctatagagagcatatgtgaaaggatcatgggagattaaacaggtctgccagtcctgggggccagccaacacttctgttaacctcttttccctctgaagaaacagagaaatgagtcccacacttggtgaggagagctgagctgtttgtgtgtcttacttttgccaccgtgaggttcaagaacacctcggccagagtgacgccgaaaacatctcatgtagaactgggttcctttgctcacatttttaatcttattcacaatcaaaccttattcatgaagacttcactaatttagactttctgttttaagaaatgaaatattcacagtttgtgagcaaatagatctgctcattggatggtgctggtcgtgttggaatgagtccggggctaaaggtcgggagacaagaagcccataatagctccctggtctttttgcatgctcaggacttttgggcaatactcccgagcacacacgaagtccagggagccattctgcaagctggtctttagaatagcttgtttatcccacagctgtgtgcaatgtgcaagacattgtaaattaccctagcctgaaagtgcatagggtactcgttccccaatttggttgggatgaaagtctgtttgccacgctgacttgctttgcctctccctggttatcaatcataggtctgctgctgtccaatcctcactcatctggtgggagaatatgcagcaggtgcagtaaaatacctgcatctactccccagaaacctttccggaaaggctttaccttttgtctctccatcccagttcttgctgtggtctcgtgtctcctgtggctttccatttctgctttggtcctggactctttttttttttttttttttttaatttttgagacagagtctctctctgttgcccaggcaggagtgcagttacatcatctcggctcactgcagcctccatctcccgggttcaagtgattctcatgcttcagcctcccaagtagctgggactacaggtgtgtgccaccatacccagctttttttttttttttttttgtatttttagtaaacacggggttttgccaccttggccaggctggtcttgagctcctggcctcaagtgatccactcaccttggcctcccaaagtgttgggattacaggcatgagccaccgtgcccagcctggtctaggaatcttgatctctgtctcaggtcctcatgcaaaacctagttcttcccagcccaggcccaggcttttgtctgggacattttataagctggtcccaccgtgatggcagagatgggcaggtggtttggttttaaaattactgactttaggcctggcacagtggctcatacctataatcccagcacttcaggaggccaaagcaggagtttaagagcagcccaggcaatgagtgacaccctttctttacaaaaaattcaaaaattagcgaggcatggtggtacatacctgtagttccagctactcgggaggctgaggcaggaggattgcctgagcccaggaggttgaggctgcagtgagctataatcatgccactgcactcttgcctggtcaacagagggagattctgtctcaaaaaataataataataataataaaataaataaaattcttgacccatggacagttgagagcatttgcatttcatggttgtgacatgtgaaggaaatattacatacaaaaagctataatacaatgtgactgcaaatctgttatgcataaaaagactggaaggaaatatattcaatcattgacagtgactttttttttttttttttttgagatggagtctcactccgttgcccaggctggagtgcaggggcgcaatctcagctcactgcaacctccacctcctgggttcaagcaattctcctgcctctgcctcccaagtagctgggattacagacgcccaccaccatacccagctaatttttgtgtttttgttagagacggggtttcaccgtgttggccaggctggtctggaactcctgacctcaggtgatgtgccggcctcagcctcccaaagttctgggattacaggtgtgagccaccgtgcctggcctctcttccattcttaatcatctaatggaaccttaatagttttcagcagtgatgtctatatcaaggcctgctagactgacagcaagccttcattccccacagggatcttaccaagtgtggaaaaatggaatatgggaagcattcatgttaacagtggttctcaaagtgtggttcctggaccagcagcattagtaatacctggaacttgttagaaatgggaattctggcccagcaagtgactcacacctataatcccagcactttaggaggcagaggtgggaggctctcttgagcacaggggttcaagaccagtatgggcaacatagcaaaaccccatctctagaaataataatttaaaaaattagcctggcgtggtggcacatgcctgtagtcccagttattctggaggctgaggtgaggacattgtcggaatccaggcagttgaggctgcagtgagccatgattgcaccacctcactccagcctgggcgacaagagtgagagcctgtctcaaaaagagaaaaaaaaaaaaaaagaaagaaagaaatgcaaactcctgggccccacctattaaattgaatattcaatactgacctgttgaatcagaaactccaggcctatggcccagcaatctgtttctattagccctctgggtgacgtcaacgctggcttgagtttgagatccacttagttacaggattttaatgagcctgacatttgggacaaggcagcgagttagttttactgatctggttctgacccttgcttccttccaggcttggtaatttgggtttttcttttagttatccttattcataagtgtaattgatctttagtctatttaacactataattttaaactgttttgaaaaggtggagaaattacctatcaatatgtagctaatttctaagtaggaaataattttctaagcattggaggcaatggaacaatcaaataatactaacttatactattagattataagaatatttaaaaagctaacaaaggctggacgcagtgtctcacgcctgtaatcccagcactttgggaggctgaggcggaggatcgcttcagcccaggagtttgagaccagcctgggtaacaaagcaagatcctgactctacaaacaaatacaaaaattagccagacatggtgggacatgcctgtagtcccaggtactagggaggctgaggtgggaggatcaatttagcctgggaggtcgaggctgcagggagccatgatcatgccactgcactccagcctagacaacagagcgagaccctgtctcaaaaagtaaacaaacagaaaagctaacaaactggcaaaaatatggcaatttgtagaataaaacacaggtacagaacatttctaaagctatgtgaaacctcttgacaataaatgggataaagagcaatagacaactgatagacatttgaaataaacattaaaacagctcgacctcaccggaaatcttagaaatgttaattaaaatagggattggttaacagttatcttctcagaatggaaaataaatcatgtaatactcaaagttgtcaggagcaagataaaataggcaaactcagctggttgcagtggctcacgcctgtaatcccagcactttgggaagctgaggtgggcggatcacctgaggtcaggagtttgagaccagcctggccaacatggtgaaaccctgtatctactaaaaatacaaaaattagctgggcgtggtggcgcacatctgtagtcccagctacctgggaggctgaggcaggggaatcaccggagcccaggggacggaggctgcagtgagctgagaccaagccactgtactccagcctaggcaatagagtgaaactccatctaaaaaaaaaaaaaaaaaaaagagccaactcatataacactgatagaaatgtaaatagaaagaaatgtatttacaatttctttgtagaaatgtaaatttgtaaatcatacaacttttcagaaaactatttggtgacacttggccataatttttaaagccctataatttaaaatatgttcaaaccctgtgatttaaaataattttctacatttagtaatctaccatataaaatcagtcagagatgtaggaaaatgcaattataaagataaaatattatataattgttagaaataatattttcactttatagtaaatggaaaagccaagatagagatggaatttacagtataattacattaccatcctacatctattatgcccattatattaatctattatgcatccatttatagtcatagaaaaaaatggaaaaaattctgattgtacttattttgactggcacaaaagtgaataattttttctttatacttgtttgtattaggctatacggtctattctgttattattcagtaaagttaacaaaatctcaaattagtctgggcatggtatctcctgtctgtaattccaacacgttgggaggctaagacaggaggatcagttgagcccaggagtttgacaggagcctaggcgacatagtgagactctgtctctaccaaaaataaaaaaattagctgggtgtggtgtcatgcacctgtggtcccaactactggggaggttgaggcaggaggatcacttgagccaaggaggttgaggctgcagtgagccatgatcacgtcactgcactccagcctgggtgacagccagatcctgtctcaaaaaaaaaaaaaaaaaaaaaaaatctcaaattagcaaaattacattatccaacaattgttttcaggggcaaaaacaaaaaggggagaagtgattggaatttaaagcatttctagttcacacgcccatggttatggtaaatggagcacaaagttgatatgagagtataaaagccggccgggtacagtggctcatgcctttaatcccagtgctttgggaggccgaggcaggtggatcacctgaggtcaggagttagagaccagcctgaccattatggtaaaaccctgtctctactaaaaatacaaaaaaatcagccaagcgtggtggcgtgcacctgtaatcccagcaactcaggaggctgagacaggagaattgcttgaaccccggaggcggaggttacagtgagccaagatcacgcccttgcactccagcctgggtgacggaaggggactctgtctcaaaatcaatcaataaataaataaagcctaaaatcaaaattaatgcagctgccagctgccaggaggaaaagaactcactggagaccactgagtggcagctgtcacccaaagccactgtatgaccctctgctgcagaggctgcaggaggcgcaaggcaggactgtcacagatgctgctctccacataccagccttatgtccagttaatatgctgaaaactcatattttgggaaaaagtctgaaatgattttatgatcacaaaaaataaattgattaaatgtaatttttgttttgttttgttttttgagacggagtctcactctgttgccaggctggagtgcagtggcacgacctcggctcactgcaccctccgcctcctgggtcaagtgattctcttgcctcagcctcctgagtagctggcactacaggcacccgccaccacacccagctaatttttgtatttttagtagaaatgggatttcaccatgttggccaggatggtctcaagaggacctcatgatccgcctgcctcggcctcccaaagtgctgggattataggtttgagccaccgtgcccggccgattaaaagtaattttaaaaaattgcttcaaaataacctcatggctggtacttcagcctgtagctgagatgagctgaccagcggctgtaggtggggagaagagaaaaatcactggtcacattatcgggaaagtcctggcaccactggtttcatatctctgttccatagaaccttcccaaattatatttaaaagtattttttttattcaatctacttatcctcaagtgtttaacccatagggtatgatgtgaactgtagacgcccaggaaggtgcagaattttcattgaaagttatctaaatgggctgagtatggtgactcatgcctgtaatcccagcacttggagaggctgagaactgtttgagttcagagttcaagaccagtgtgggcaacatttttttgtctctacaaaaaaaacctaaaaattagctgggtctggtggtgcatacctgtggtcccagctacttgggaggctgaggtgggaggatcactaggatcgtgccactgcactccagcctgggtgtcagagtgagactctctctcaatgaagcaaacaggagagaaaggaaagatgattaggatggatgctatcagaagtagaatcttggccctgaacttgttaaacttcagaggaagcagagaaaggagcgagacaggcatggaagctgatggggacctcttggggtcagtcaggtaaatcccttcaaaccccaaaccagaagtgatcaaaggcaggttcaggagagggaacaggggtcttcctgtgcttcagggatggtgtcctggaggagcctctgaccacggctccaatgctcttgacccacagcgcagagttcagaggttcaacggtgcagccaagagaccagggaggtggctacagccacctgactctctggtcagtgggccctgatccccacactcctgacctcctcccagccagacactggggagcaggccctatactgtcttgtggaggtactgctgtctggttttttgtttttgtttttttttgttttttcctatattgccatggtgaataggattttaattttccttctttcttttttgttttttttcttttttttttgacggaatctcactctgtcgccaggctggagtgcagtggcgccatctcggctcactgcaacctctgcctcccgggttcaagcagttctcctgcctcagcctcccaagtagctgggactacaggtgcgtgccaacacgcccagctaatttttgtatttttagaagagacaaggtttcactgtgttggccaggatggtcttgatctcttgaccccatgatccgcccacctcagcctcccaaagtgctgggattacaggcattagccaccacgcctggctaattttcctttcctttccttttcttttctttttctttttcttttcttttcttttcttttttttttttgagacagggtctcctctgtggctggagcgcagtgacgcgatcttggctcactgcaatctccgcctcctgggttcaagcaatttttctacctcagcttcctgagtagctgggattacagacacgcgccaccacatgctggctaatttttgtatttttagtagagatggagtttcaccatattggtcaggctggtcttgaactcctgaatgcaggtgattcgcccacctcggcctcccaaagtgctgagattacagatgtgagccaccgcacctgattttaatttttcattaaatgtttctaacccctttctgccagtatgatggaaaatggctttggaattttgggcttcatctggctgccttattgaattctctcattagcaagagtctaggtggtttcggctgcagtaactaaatactacagaccaggtagcttataaacaagagaaatgcattgcttacagttctagaaggttctggtgaaggccctctcccagattgcagaatatcaactgatttccttgggtccttttatcccttcatcccttgggataaggggattaatcctttttatgagtctccactttcaggatctaatcagctctcaaagggcccgcttcctaataccatcacaatgggggttaggatttcagtatatgaattttgggaaaacacagacagcagtcatggatttttccagtgattttcttaggctctttatccctgcaatgactttgtctacaaattgcagcaattttgttaccttcctttcagcagtgtatattttatcccatttgtgttgactgacacctatttattactaataaacagtaagggtgatagttgattttaggaaattaacctcttacctactgtattagtctgttttcatgctgctgataaagacatacccgagactgggtaatttataaagtaaaagaggtttaatggacttacgtttccacgtggctggggaggcctcacaatcatggcagaaggtgaaaggcatgtcttacatggtggcagacaagagagaatgagagccaaatgaaagggaaacccgttataaaaccatcagatcttgtaagacttgttcactatcatgagaacagtatgggggaaaccacccctatgattcaatgatctcccccagggatggtccctcccacaacacatgggaatgatgggagcttcaattcaagatgagatttgggtggggacacagccaaaccatatctaacttaccaacattttaaaaaccatgaatatatgatagctttttctcaaatggcctttgaatctataataataggatcatgtgattattcttgtttggacaagatgtgataattaatagatttcctattattaaatcatttttgtattcttagggttaatattagttgtcatggtagcccattttcttaatgcaatttgaatttgtagtgtaagttttgaatttgatttgccatttttattttttattcatatttataaataaaagtgacctatagtttatacaaaattacaagtgtcattgttagttcttgaaacatagttaacctagcatgatgaaattaatttgtttgctttatattattttctgtgatgtataataaattctgtacagtatggaattgatttataactttgactttaggcttgctagttcataaactgcttttttgttttgttctcatttttttgaggtgattatttgataaatattagaagttaattgttcttcagtctattttgaaaacttatattatcttcaggttaccaattcctcaaaattacttagtttattagcatttacttacatataacattgtttaaaaatttatttgaggccgggcacagtggctcacgcctgtaatcctggcacgttgggaggcggaggcgggtggatcacctgaggtcagttgtttgagaccagcctggccaacatggtgaaaccccgtctccactaaaaatacaaaaattagatgggcgtggtggcgggcacctgtaatcccagctacataggaggctgaggcaggagaatcacttgaacccgggaggcggaggttgcagtgagccgaaatcacactgcctcaccccagcctgggcaaaagcgtgaaactgtctcaaaaaaaaaaaaaaaaaattgaaagtcttctcataccatggtttgaattaatttgatatgccagatgattgtctattttagtgattttggggaaaatctatgcttctatttaatgaataatccttttttctctgttttcattctagtattttcagcttttctcttcatttcccttctcttgcttcttgttctgatcatttattatcatttataataataatttgtgtaaattattttatttagttttcttttttattaatgaaataatttagatataaattttcttcttcgtatagctttaccattctggagatttttatatgtattgtgatcacttactatatggtctataattgtagataatattttcattcactcaatagttatttgggagaatgttactgaataccttgtttaaatacttgttattggtttttcatttttttgcataatcatagaatgtcagatatataatatcttcatactatttattgtatccatttattgtgtctcaatatgtgtttgatttctgcaaacataatatggtaattgaatagattgcttgcacaatttataagaaatagagctactgatccatgacccctttccactaaaaattacattaaaatcatgaatgtcctcatttattttttatctactcactggcttagactgatagtgttaacatttgtctcaattctgtttctgacactttctctttgtgtgtgtctgtgtgtatttgatattgcctgccattatttgattgattcattcattcattcaacagaggcttattgaaagtcttttgaggttgggcccagtgactcatggctataatcccagcactttgggaggcccaggcagtaggatcacttgaggccaggagctcaagactagcctgggtaacatagcaaaaccccatctctattgttttttaacaaaataatttttaaaaagtctcttgcatagagcgcagatgttgtggtgatcaataaacaaggctctcgcactcatggaatttacattttagtgtaaggggtaggagaaagataggcattaaataaattgataatgaataaggaaatttcagataatattaagttgttttgttcgttttgttttgtgttttgagacagagtctcgctctcttgcccaggctagagtgcagttatgcgatccaggctcattgcaatctctgcctcctgggttcaagtgattctcctgcttcagcctcccaagtagctgggactacaggtgcccgccaccatacccagctaattttttgtatgtttagtagagacagggtttctccatgtttgccaggctagccttgaactcctaacctcaggtaatctgcccacttcggcctaccaaagtgctgggattgcaagcgcaagccacttcacctggacacaagttctttaagaagttgcaagcatcacttctacttatgttccccggccagatgttagtcacgtggctggtggaagtcagtcacgtgccatacgtggcagcaagggaagctgggaaatgtcgtctttattccgaacagtcctggtccaagaattttaaaaattggggatttggttgccattaagaaagggtgaattgacacgtgaggaagaactgtctctcatctcatcagtgtgtggagtttggatatgatttcatgtacaagcagttctcattggagtgttttaagaacttgagtggattgatttaatctgtatgcaaagtacatcattggttgctgtgtgaaggagtgtaggggctagaatggaaatggggacccagttatgaagttattttaggagtctgggaggcatgcggatgactcggactagggttggaggagctgagatggtgtgtaaggaacagacatgagctttatatttgaattacagctgttcattaaattaatatatggcacttccattatgcatccatgattaccatttatacctataaatagccttcgtggtccatccattatttttttcttgaatcctccttttctaatattaatactaacctcatctcattttctctttatttgttttcactgggtataacctcattcatcctttttctttaaaaaaaatctacttttttagatgtccctctctataaaaatcatcgtgtcagaattatttttataagccagtctgagagaatttgtcttttaatagagtggtttaatccattggcaatcctgttataactgttgcttgttcacagttcagtggccccatattattctttttgcttttaagctattttattttccatcttttgctctattgattgttttgtatattttatctcctaaattaaatggaacaatagctcttcttgttagaagccttttactgattttctttaccttcatgaaatatgtatttaaaattatatttgtctgaatattaaattcaaaggaaaaactaacctcttatttttcctggaagaaaatttggcttatatttactttccccatttacttcccaatgtctgttaaatctggcactatgcaagctggatttttttaagttattgaaatggctgtagactcacatgcagttgtaggaaatcattcagaaagatcccatgtacactccacccaattttctcctaatggtaacattttccaaaaccataatacaatatcataactgagattttgatattgatacaaactgctaatagtcttcggagttccccagttttgcttgtactcacatgtgaaagtgtgttgacttccatacagttttatcacatgtgtgtaggtttctgtgtctaccaccacaatcaagctattgaacaattccatcacccctgttgccctttaatgacaacatctcctcattcccacccccacccctaactctgtcaactaggtcttggttttctaaaaagtctaaaattttgccattgcaaaaattgtatataaatggagtcacatactatgtaattttggagtgggcgtttttcttccatcataatatgcttgagattcattcaaattgttgtatcaataatttgctctgggccaggcatgggtggctcatgtccataagcctagcacttgggaggctgaggtggggggattgcttgagcccaggagtttgagaccagcctgggaaacatggcagaaaccccatctctatttaaaaaatgcataagttagctgggcatggtggtgtgtgcctgtagtcccagctacctgggaagctgaggtgggagggtggcttcagcctgggagttccaggctgtagtgagccgtgatcacgccactgaactccagcctgggtgaaagagcgagaccctgtctcaaaacagaaaaaacagtttgcttctttttactgctgagtagtattttacaggatgaactgtttcatggtatgaaacttatttaacccactcacgtgttgatggacacctaggctgtctcaagtttttggtttttatgaataaagctgctgcgaccatttgtatgcaggcttttgtgtaaacatgtttccatttctccaggataaaagagctcaaatgcacttgcaggttggtatcataactgcatgttttgttttataagaaactgctattttttttccacagtgatggtagcattttacattctcaccagcaatgtatgagtgattcaggttttctgattctcaccagctttggtatgtcactattttatattttagccattctggtaggtgtggagtgatctctcaactgcagttttgcatttctctgatggctaatctttaacagtgatcatttaccatctgtatgtcctcttctgtgaaatgtctgttgatgtcttttgcccatattctaattggttagttgtttttgtgttttgttttgttttgctcttgagttttgagaagtctttatatattttgtatactactccttggccagatatgttgtttgcaaattggttagttgtttttgttttgttttgttttgttttgttttgttcttgagttttgagaattctttatatattttgtatactactccttggtcagatatgttgtttgcaaatgtcttctgcaagtgtgtagtttatcttttcattctcttcttacaacctttggaagaacaaaagcttttaattttgatgtggtctagcttttcgatttttcccagtatggactgtgattttagtgtcaagtctaagaactctgcctagccctagatactgaagattttctcctatttttttcttctaaaagttttatagttctatgttttacatttaagtccatgatccagaatttagttaatttttggataaggttcacacctttaggtcaagattcattttcttacctacaaatatccacttaccccagcatcatttgttgaaagggctgtcctttctccattgaattactttgatgactttgccaaaaatcaattgggcatatttatgtgggtgtatttctgggttctctgttctgtttcattgatccatgtgtctgtcctgctgccaattctacactattttgattactgtaactatatagtaagacttaatatcagttaagtgatttcttgtactttattctttcctgtcaagattgttttaactcttctaagatctgtgtatttccatgtaaattatagaataaacttgtctgtgcctactaaaattcaccaggatattgataagaattgccttaaacctataagtcaacttgggagaattggcatctttattatgttgagtcttctagtccagtggtctaggaatagcgtcatcacctttctggcaccagagactggtttcgtggaagacaatttttccatggaccaaggtgggggatggtttcgggatcattcaagcacatcacattgattatgcactttatttctattattattacattgtaatgtataatgaaataattatacaactcaccataatgtggaatcagtgggaaccctgagcttgttttcctgcaactagacagtcccatctaagggtgatgggagatagtgacagatcatcaggcattagattctcctaaggagcatacaacctagatccctcacatgtgtagttcacaataacattcacacttctatgagaatctaatgctactgctgatctgacaggaggtggagctcaggtggtaatgcgagcgatgggaagcagctgtaaacacagatgaagcttctctctctagcctgccgttctccctctgctgtgcagtccagttcctaaccaccgctcacctcttgctatctggtaccggtccatggcccgggagttggggacacctgttttcatccatgaaagcaatatgtctctcctttcattaagtcactgatttctttcacccacattttgtaattttaagaataaagatcctatacttgtcttgacaagggtatacctaagtatttcatcttctttggagtgaatgtaacatgtttattgttagtaaatagaaatgtgattttttgtgttaattaataggattaatttttcaaataggcaaataaaaattgtatagatttatagttacatgatgttttgatatctgtatacattgtggaatggctaaatcaagctaattaacatatcaattacttcacatacttactgagatcatttaaaatctaatctctcaggaatttcaagtgtacaatagactgttagctatagccaccatattatataatagatctcctgaactttctcctactgcataactgaaattgtgtatcctttcctcaatatctccccacctcacaactcctcagtccctgataactgtaattttattctctgtttttgtgatttcaacttttttagattctacatataagtgagatcatggagtgcttgcctggtttatttttcatttagcataatgtcctccaagttcatccatattgtcagagatgacaggatttccttctttttaaaagctgaatataatactgtcttgtaaccttactgatctcacttagttctaggagggattcgtttgtagatttcttgggattttctacatcaaagttgatgtcatcttcaaataaagaccatttaattccttcttttccaatctgtataccttttatttttcttattttattgagctggctagcacttctggtaccaacatttcctgacttatggttgttcaacttacaatttttcaactttataatgatgcaaaagtgatatgtattcactagaaactgtacttcaattacccatatatctgctttgctttttaactttcagtatagtatttaataaattatatgagatggtcaacattttattataaaataggctttgtgttaggtgatttttgtccaactgtatgctaacataaatgttctgagcatgtttaaggtaggttaggctaaactaggatgttcagtatattaggtgtattaaatgcattttccacttaaccatatttgcaatttacagtggtttttcaggatcaaatctcatcataactcaaggagcatctgtatgatgttgactagcagtggtgggagtaaatattcttggctccttcccaatcttatagagaaagcattcaattttttcagtccttcacattagctgtagaatttttgtagttgttctttaccaagttcagttaattcttctcttctttaatttctgaaagtttttatcatgaatgggtgttgtattttgtcagatgttttttctgtttcacttgatatggttatatgattttcttctttagtttgttgatatggtggattatgttgattgacttttaaaatgttaaatatgactaaattgattgatttttggctgttgaaccagacatgcttacctgacatgaatctgactttgtcatgttaccagtggccaatctgtatgggtctgcagcaaccacaattcttgccttctcagaagaaagaattcaaccaaggggcataaggcagagtgagagactgaggcaaattttaaggcaggagtgaaagtttattaaacagctttagaacaggaacaaaaggaagtaaagtccacttggaagaaggccaagtgggcagtgtgagctatcaagtgcgtggtttgacctttgacttagggttttatatgttggcatacttccagggtcttgtgtcccttctccccttattctccccttggggtgggctgtccacatgcacagtggcctgccagcacctaggagaggccacatgtgtatacagtgtacagtacacatgggtgtactggagttgcactcatgctctcttgagttggatgctcctagaaggtcatgcacctgttaaactctgccactttgccacttagtgcacatacacgagcccattcacccaactcctgagatcttattgagaagctgatcaccagtttcaggtttttctacctgtttagagactgcctttccctgatgctggctacaaccaattactgttacttagtgcatatacatgagtccattcacccaactcctgagatcttattgagaagctgatcaccagtttcaggtttttctacctgtttagagactgcctttccctgatgctggctacaaccaattactgttatttagtgcatatacatgagtccattcacccaactcctgagatcttattgagaagttgatcacctgcttcaggtttttctacctattgggagactgcctttccctggtgctagctatgaccaattactattttagagagacaacttaacaactacctgcccatcacctgatggtcttctgacattcctggtcgagagggaaccctctccggccctgctgatgtctgcctgactacctactgtaacagtcatggtgtatgattctttttatacattactggattcagtttgctagtattttgttaagattcttacatctaagttcatgagagatagggtctgcaatttttgtttgtttgtttgttttgtgctgtctggttttgttatgaggccttgtaaaatgaattagtaagtgtttctatttcttttattttgtggggagttgtgtaaaactgtttatgggagagatggtataaaatggtttttaattcatatttaaatggtagaattttccaatgtaactatttaggcttggagattttttctttttttcaaaatcttttaaattatgaaatcaatttctttaatggtgtagcatcattcagattatctatttcatctgttttaggggtttgtggttttccaggaattggtccaattcttctaagttgttgaatttatgagtataaaattattcatagtattcccctattctcttcttaatggttgcaggatatataataatattccctgtttcatttctgatattggtgatttgtgttttctgtggctgttttctgtcactgttgctagaggtgtgtcaattttattctttttttttgaaaaatatgcttttgtttcaatgatttttctcttatttttctatatccaatttcattgttttctgctcttagcttactatttgcttctttccacctgctttgtagctttttgttttgtattgttctttttttagtttcttgagataggaacttcgattattgattgacattccacgctcactttctttcagttctctgtatttttatttactttgagacttctttgaaccttgagttcagcagcgtgttattaattttccaggtatttagaggttttcctggtgtctttctgttgctagtttctagtttgatttcattatggccaggtaacatattctgtgtgatttcagttatttatatctttgtggtttgttttatagcctttatattatctgtcttggtgaatgttccgtagtcatttaaaaaaaatgcatatggctgggcacagtgtctcatgcctgtaatctcagcactttgggaggctgaggctggtggatcacttgaggtcagaagtttgcgaccagcctggccgacggcaaaacctgtctctactaaaaatagaaaaattagcagggtgtggtggtgtatgcctgtaatcccagctacttgggaggctgaggcaggagagtaacttgggaggcagaatgcagaggttgcaagtgagccaagattatgccactgcactccagcctgggtgacagagtgagattccaactcaaaaaaaaaaaatgcatatgctgctgttggatggagtgttctgtgtatatgagctagatcctgctggttgattctgctatgtagttctctgtatacatactgattgttctccctagtagttctgtcctttgctgagaggtggctgttcaggtttccaactataattgtgaatttgtctgttttccctgttaactctgtttttgcttcatgtattgtgaagctttttgatgtggccatatttaagattgcatatcatcctggtggattgatcctttgactattatataatgtccctctttgcttctattaaatagtgattttctttgctctgaagttgactttatttgtattgatgtagccactgctgcttcttaaaattaatattttcaggttatataattttccattctgcctatgttgttgaatttgaagtcagtttcttgtaaacagcataaaattggattgtgtctctgtccactttgccaatctgtttttttattggtgtacttagaccatttacatttaagttaattatctatgtaagtctaccattttattaatttttttctgtttggttccttggattcttgttcctctgtttttcttttcatgtagggtacttgaacagcttttaggattccatcttgattttttcattgcattttaaagtatatctctttgggtgcggtggctcacacctgcaatcccagcactttgggagaccaaggcaggcgattgcttgagtccaggagttcaagaccagtctgggcaacatggtgaaacctcatctctactaaaaatacaaaaattagctgggcatgttggtgtacgctacttgggaggctgaggcatgataattgcttgaactggggaggtagaggttgcagtgagccaagatcatgccactgcactccagcctggggaacagagtgagactgtctcaaaaaaaaaaaaaaagtatatctgttcgtatagtttttgtagtggttgctctgtgacatcagactttactggtatcgacattttgcctcttcaagtggaacatgaaaaccgcatttccttttagaaccattaccttccctgctcttaaatatcattgtcttgagtacaagaggttgttaataatttgtgtctcaatcattaaatataatttacacaatttagaaggaaaaggatagtctattgtatgtacccagattgctactgttcctcttatttcttcctcctccttgatgccccaagcttgattctcttcccatttcttttctgtttgaagaacttcttttagggcagtttttaagggtaaatctgatcatggtaaattttttggtttttctttatccaagaatgtttttatttcccctcatttctagagaataattttgccagatgtaaaattcatagatgggctgggcaccatggctgacgactataatcccagcactttgggaggctgaggcaggtggaggcacctagggaggtcaggagtttcagaccagcctggccaagatggtgaaactccatctttactaaaaatacaaaaataagccaagcacagtggcgtgcacctgtaattccagctacttgggaggctgaggcacaagagtcgcttgaaccctggaggcagagtttgcagtgagctgagatcacaccattgcactccagccagggggacaagagcgaaactccatctcaaaactaaataaataataaaattaaattcataaataaaaattatttttatttttcacaacttgaagaatgttgtgccacttctggcctccataatttcagatagggacattattgtcatttgaattttttttgcctataagtaatgcatcatttctttctggatgctttctagaatttttctgagtttttagttatcatcagaagttcaattgtaacatgtttttgcataggcttatttggattttttctgtatgaggtttgatcagcttgttgcatctttggtttgtgtttttcaccaaatttggagatttttggctattccttctttgaatactctttagcaccattttgtgtctcctctccttctgggactctgatgagcgttgaattttttaattgcccctgaggatctgtttatatcatttcatctattttctttctggtgttcataatgagtgaattttattgatctgtcctcacaatcactgattttgacatctgtcatctgtcctctactctcctatccagtacattttgatttttttcagttttgtaatttccatttggttccatttgattctttctttctttctttttttttttagagacaggatcttgctctgtagcccaggctggagagcagtggtgcagtcatagttcactgcaacccccaaatcctgggctcaagccatcctcctgcctcagtcactcgcatgagtagctgggactatcagtgcatgccaccacaaccagctaatttaaatttgtttttgtagaaataaagtctcactgtgttttccaggctggtcttgaactcctggcctcaagcaatcctcccaccttggcctccccaaagtactgggattatagatgtgcgccaccaagcccagctggttcttttttataactcctatttacttgcaccaccaagcccagctggttcttttttataactcttatttacttgttgagattttcttatgtttcatttgtttcagtagactttttaattgattgttgaaacatcatggtgacttctttttttaatttaattttattttattttaaggatacatgtgcaggacagtgcaggtttgttacataggtaaacatgtgccatggtggctatatcaacccatcatccagggtaataagccctgcatgcattagctatttatcctgatgctctccctcccccttgctctcctgacagactggataaagaaagtggtacatatacaccacggaatactatgcagacataaaacagaatgagatcatgtcctttgcagggacatagctggagctggaagccattatcctcagctaactaactcaggtacagaaaaccaaacaccacatgttctcacttataggtgggagctgaacaatgagaacacatggacacagggaggggaacaacactcactggggcatgatggtttctttaaaatcctttgtggatgatttcaatgtctgactcatctcagtattgaagtcagttaagtgtcttttctcattcaagttgtgagtttcttggttcttgatgtgatgagtgattttctattattatcgcagatatttcatctggtagcttcatggactctggattctatttaaatcttttcttttagtaggcagttatcttgtttaggtttagtcatgtttaggtttagtcacctcgtttaggtttagattctggtatacttttgcggactatggttgcaatgagaacttgtttgcagtgcctttatggtgctctattagccagcctggtttatacagggctgctggggtcccagtggttcctcctggtgcttcttgacggggcagaaaagattttcttaggcaaagatggcaggtgtatctctttgcgggaggagattcttaagcaggaacaaggaggcttcctaagccaagtgctttttatgacgagattctcctctgctgtggggaacagagcattccccaggccacgcacttgtggttgaatccactatactgttgcctccaatctctgggcaacagtatagtggattcaaccacaaggatcaggctgtttgttttggtggagatctaccttgctggggctgtcgtgttatattttggtgagagagggagatttcaggcctgccagggaaggaaagcacctcccttagctttttactgttagtggtattccaatagatcctccttgcctgtcatgtggggtttgtctggggctgctctcaaactcctgacctcaggtgattcacccacctcggcctctcaaagtgctgggattacaggtgtgagccacggcagccggccttgtgtttagttttgtatcatatttacaacagttaattttgatacaggagctagaaagaaattacttaggcagatagtgaggctaaaggaattctcagcaaggtttcccttttaacaaaaagcagccccaaaataatttcttttctaacaaagagcagcctaaaaactccagctgcaaacataaatcagcaggctaaagcttgcacgggtgaatgacagcagctgtgctaataaaggaggaacctggaagccaggtgcgttcagcacggaggctctgtcttcccttctctcttcatcacgtgtacagtaaggaccaggcaacatggccctgggcaggtagagaacccatgtgcgtaataaaaaattaggaaggggcgccaggcgcagtggctcagacctgtaatcccagcactttgggaggccgaggcaggcggatcatgaggtcaggagatcaagaccatcctgactaccacggtgaaaccccgtctctactgaaaatataaaaaattagccaggtgtggtggcgggcgcctgtagtcccagctactcaggaggctgaggcaggagaatggcgtgaacctgggaggcggagcctgcagtgagctgagatcgcgccactgcactccagcctgggggacagagccagactccgtctcgaaaaaaaaaaaaaaaaaataggaaggggcagccaggttcttcgtgagctatgcagatggcacacctggtccaaccaatctttcgtcctctatgtaaatcagacaccacctccttaagctactctatgaaaccttctgcatttcagcacagaactggcaactcatctttctccaggacccctctctgtacagagggctctcctctttctttcgcctattaaacttttgctcttaacctcactctggtgtgttggtatccttaatttccttagcatgaggcaacgaatctcatgtattactccagatgaataacaccacttcaattttactatcactgttttttttttttttttttttttgagatgaagtcttgctctgtcgcccagggtggagtgcagtggcacgatctcggctcacggcaacctctgcctcccaggttcaaatgattctcctgcctcagcctcccaagtagctgggattacaggtacccaccaccatgcccagctaatttttgtatttttagtagagacggagttttgccatgttggccaggctggccttgaactcctgacctcaggtgatccgcctgcctcagtctcccaaagtgctgggattataggcatgggccaccgtgcctggcccaattttactatctgtaaacagtttttatttacattgtcattcctttgtactttaaatttcttacatctgaattgttaattataattaatctcataaaatttttaaaaatttaaacatttcttaaaaatttttatagtaggggttgggtattactcaagagacatatttttctaggcctttgcagatctgaaaatattattccattaactttatgaataaaattaaaataggactgaatatagagtttggggtcacaacatttaaatttcagtcgtataattcaacattttttgtagtaaaaatgcttcatatcagttcatctcttgcaggttcataatgtacattagtttaattaaggccttcatttgagaaggttgtttaattttgtttagcgtatcgtgtctcaagtgataaaatgatgatgatggaatttttgtgtggtgtgcttttcctgttaatatttatatcctcaggctgggcacagtggctcacgcctgtaatcccagcactttgggaggcgaaggcaggtggattacttgagcccaggagttcgagaccagcctgcccaacatggtgaaacaccatctctactaaaaatacaaaaattagctgggtgtgttgacacacacctgtaatcccagctactcaggaggtggaggcaggagaatcgcttgaacccgggaggcagaggttgcagtgagccgagattgtaccactgcactccagcctgggtgacagagtgagactccatgacagacaaaaaaaaaaaaaaagcctcattgttgcccaggctggggtgcagcggtgcaatcatagctcactgcagcctcaaactccttggcttgagtgatcctcccacctcagcctcccaagtagctaggactacaggcacacaccatccactaagagatataataagtgagcacttacttatatctaaaagagaacttgacaatgacttaaatactaaagacacagacctaacaaaaatgggcagtcaaggtggcaacagaggctggtgatatgtcttcctgggcctctgcacctccgtcttccactttacatcctcagcctgtaggaagtacatcctcatccatgttgccttctggctacaaaagggctgctacagcctcagacaccagaactatatttggaatggggtgggggtggtagcaaaaaaaagcctttcttctccaatggttctctttcttctccaatggttctctttcttatgagcgaagggaactctttctcagaaatctcctagcagcttttccctgtaagtttcatcagcaagatcagaatggtatgcctactcttagcagcaagagaagctgagaaaataggaaaagaggccagtgatcgtgattggcttagatctgctatgatccacccttggtgctggagtctgtcaaccttaagtaacgagatttaataacgatatttcggctggtctcgaaaatatgattaagtatagagtttattgcagcccaaaggtaagaatagccattcaggaaacacaaactccagagaaatggggtcagtgctctcaagttaaaagttaaggtctttgctgggtgcgatggcttacacatataatcccattggtttggaaggtcaaggctggaggattgcttgaagccaggagtttgagacaaacctgggcaacataggaagaccccatctctgcaagaaaaatttaaaacttagcgggcatggtgatgtgcacctgtagtcccagctactcaggaggctgaggtgggaggatggctcaagccaaggagtttgaggctgcagtgagccatgattgcaccactgcatcccagcctgggcaacaatgaggctctttctctaagaaaaataatagtaaaaaaaaatgtgaaagtcttgcttatataggcagtaaacaaaggaatttagtagaattataacattttcttatacaaggctagtttatgagctgcagcaatttagttagttacagtttattttcttttctatgcagcttgttttcatttcctttccaatttaaacaagtgtatttaacattccatcttagacaatgtgatagtcataatgtctttgtgttagaaaggtaagtgggaagttaatctataatgaagataaacagtgaacagagaaggggtcttccctgatgtgctttcatcatttacaatttctaaaacaatgtattaacaggtaaggaagaagaataatctataatcatacaaacaaaggttatagctgcctaggttacagctgcctgtttatgtgactcagttcccataatcacatgcccttaagggtcaaagtattttaaagttccaacagcttagattttgaattacttatttttacaactcattattatcaaatcaaatcagttttttgttttgttttgttttttaagaaaggaagaggggaagtgagtggcttctggccataccacaaatggcaccagccacaaccttcctctaagtaaaattgtaggcagaatgcctcactggaactacttttaagtatctgtcccttgttttcttgttctttgtagaaaataagtttgaacttggcttgattatattccttgtagagaatctgttttgtacaacctgcctggtgcttatgatttttttttcttatttgtttaaaatcatgttatagattgattggtcagaatggttcatctttattactttgctttgcacttctaaaatgtaggcacaggccttccatccagtgcagttttctgctattctctttttttttttttgagacagaatctcactctgttgcccagactgcagtgcagtagcatgatcttagctcatcgaaagctctgcctcctgggttcaagtgattctcctgtcacagcctcccgagtagctgggattacaggcacccaccaccacatctggctaatttttgtatttttagtagagacggggtttcaccacgttggccaagctggtctcaaactcctgactgcagatgatctgcccgccttggcctcccaaattgctgggattacaggtgtgagccaacttgcctggcctattattttcttttttaattcttgcttatgctttcgttttgttcttactcagccttatggttttctcctgtgcaacacatcgaattcttacttctgttctcttccttcatatttgtcgaccccccccctcactgtttcataccttttccatctgaattcagagacattctgatgttggtcctctgcgttagtactcctgatttagagagattctaatgttggtcctctgcgttagtactccttgatttctggagtgtatgttgtgctgtatgaaactgttaaccagaaacgggccccaatccagaccccaaagagatggttcttggacctcgcacaagaaagaatttggtgcgagtccttagagtaaagtaagagcaagtttattaacaaagtaaaataacgttattaagaaagtaagggaataggctgggcgtggtggctcacacctgtaatcccatcactttgggaggccaagactggtggatcacttgaggtcaggagtttgagaccagcctggccaacatggtgaaaccccatctctgctaaaaatacaaaacttagccgggcgtggtgatgcatacctgtaatcacagttactgaggaggctgaggcaggagaattgcttgaacctgggaggcagaggttatagtgagccgagattacgccactggactccagcctaggtgacagaatggagaaaaaaaaaaaagtaaatgaattaaagaatggctacaccacaggcagagcagtggcatgggctgctcgattgagtattcttatagttatttcttgatgatatgctaaacgacggatggattattcatgagttttccaggaaaggtgtgggcaattcttggaactgagggttcctcccctttttaggccatatgacattgccatggcatttgtaaactgtcatggtgctggtgggagtgtcgtttagcatgcttatctattataattagcatatgatgagcagtgaggacgaccaggggtcactttcatcgccattttggttttagtgggtttcggccagcttcttcatggcatcctgttttatcagcaacatctttgtgacctgtattttgtgccaaactccaatctcatcctgtgacttagaatgacttaacctcctgggaatgcagcccagtaggtctcagcctcattttatccagcccctattcaagatggagtcaccctggtttcaaagcctacacaacctacaacgtaattttgattttgctcttggttttttattttcctagtatcttcttctgtctttcttgaatccctttcggcttcattcccttttcaatttcttctcctcctgcttctgttccatagtgtgcctggattttttttaagacactaagctgtgttaaagcaccatctttgtttgctaacagtgatttttggagttgtttttctcctctaatcaggataatgtttattttccttcatttccttttcaaaactattgtgctaactcccctccaaccctcgccccggatccgtattttcccagtatcctgcgatttgtcgcaaagtgcaaaggttatctatcttggttttccaatttctttggggctgtttgtcttcttgtggctcagagagtgtacttggtggtttctttctacatcgtttctcagacacacggctgaattagacacatagctgaattagtggaaattcctcccagatattggccttgtgatcatctttttttttttttttttaatagatggaatctcactccgttgcccaggctggagtacagtgatgcgacctctgctcactgcaaacctccgcctcctggcttcaggcagttctcttgcctcagcctcctgagtagctgggactacaggcacatgccatcacgcccagctaatttttgtgtttttagtagagacggggtttcaccatgttggccaggctcctctcgaactcgtgacctcaggtgatccacccacctcagcctcccaaagtgttgggaatagaggtatgagccaccgtgcccagccagtcatctcttatctatagttcacagttggcactatcttttttatttctttgtgtattcttctgggaaattagcaaggaaatctggtttgactctgggccagcatgcaattggctgatacttgcaaaattcccagtgaggagtaatagaaaaaagcacagggctttgaggcaaataaacttactcccagctgtgcctcctgtttgctgtgggactgtgagcctgttattgtgcccctctgagcctgcttccttagctctcataggaatgtctgcatgacaaggtcattgtgaggatgaaatgagagaccacatctgagatgctggacacactgtcactcactgtgtgtccagtcccctccctcctattcccatgtagtgctctacatggaaacagcaagcatcagatttcttgtgaaccagctctgatcgatggcccgggtcagcgtctgtgcctggatctcattctcatagctagggccctgcttttagcgtctcatacgtggagacttctcctaatttcccagaagaatacacacagaaataaattaaaaatatagtcagtgccaactgtgacctggagataaaagatgaccacaggcctatatctgggaggaatttccactaattcagccatgtgtcggagaaaggatgtagaatgaaaccaacaagtatgctctctgagtctattccacatgactgtgggcttggggcaccggctatgccttcctgagagccgcctctgccgcagtttctgtgcctggcaggatgcgcgcacacacctttggagatacgatatggtgttgtggttaggctcatagatgctggagccaactggctgcttctgagtgccagatgccccttacaagctgtggaagcacagtcaacttcttctccttatttttgcttcatttccttcatctttaaagtggggatatgatttacacacctcctagggttgatggaactgtgcaaagcattaaacacttcctgacacatgacaagtactgtatcagtgtctgctgtgatgacgacaatgatggtggtgatgatgatgatgatgaagatggccatccttgtcgttgtcatcagacattgtctcttgctgcagactgtttgctgacacctgttgtcacacctgggcactctgtgccctgctgcctgactgacacggcctcccttcccccactgctctccagtctgtgtccctggacccgctggattcgaggagtgaggtctcattcccttccccatctgtcctgcactgtgcagtcaccttctccactcccagctatatatgcccaacactaaaaaagataaaggatggagactctagagcctgtccttagagacaataaaaaagagacgagcctgctatccggaaagatttagacatttatctgcctgcaggcaagagactgaactgcatgatccttcaaggtcacgcctctgctcaaaatctttcaaagactccacttctccctgaggacagtgcaaattccgaaacccttcatgatctgcctcctaagcccagtcccctctcatgggggttgcgtaacactttcacaagcctaccctgaaaacctcccaaattactcatggtcccaacacatgtcctcgcacctccacacttgcccagtggctcttccctgtgcccatgggcccctccctttctgctctcctccctgaagctaatgcctgcatcatgcattcataggctgcttagtagtcagggcttgctggggaagcagactgcctagcccacccctgggggccctgctcctgtgtcctcacagcccccgcatggacttgtgaaatagcacacgggcccctgtcctgaagccagtggttcctcgtgttcacagacactgaataagcacaactcgtgacataatcaaagcacaacttttatatttgtttccttctgttgcccctttaaaatgtatcccatcagagaaatgtcactttgtccctaggtgaaaattctggcaggcctgtgacttcagtgtggaggagatttttttttttttttgacacgaagcttcgctctgtcaccgaggctggagtgcagtagcgggatctcggctcactgcaacctctgcctcccaggttcaagtgattctcctgcctccacctcccgagtagctgggattacaggcgtatactaccgcccggctaatttttgtaattttaatagagacggtgttttgttatattggccaggctggtctcaaacccctggtctcaagtgatctgcctgcctcagtctcccaaagtgctgggattacaggcatgagccatcgtgcctggccccacaagacttttaagaactaaatattttactcctacaacaaagtacagagcaaatataggaaacaccatgttatataacaaatcacctgtactgaacaaatgttaaactatgcagcatttgcttcagaatttctaaagaggtgaaatattgtagatctgtgtcctcttagttttcttcccggttttaagttcttctctttttcccactgggccacattggcttttatcttttctaaccacatttttctgtttttctatgtaggtgtgtagtgtaaacagtaatgtgctttacataaaaggcatcaatgaaaggtgatgtctgcagctgaagatcaagacctttattctgctcagccagtttctgttcacccacactgtgcgtgttgagaatatcttgtataattttatctaaatggtgtaagactgcaatgagctgggtttatatttttaagcatcaagatgctttttaagatttatctggccaggcacagtggctcacacctgtaatcctcaggtttgaggcctgaggcaggccttgggaggccaagtcaggtggatcacctgagatcaggagttcgagaccagcatgaccaacatggtgaaaccccatctctactaaaaatacaaaaattagttgggtgtggtggcacatgcctgtggtcccagctgctcgggaggctgacgcaggagaattgcttgaaccagggaggaggaggttgcagtgagctgagatagtgccactgcactccagcctaggtgcagagcaagactctgtctcaaaaaaaaaagagaaagatttatccatgttgatgcgtgtcaatatagattattttaaatgctgcagaatatttcattataccatcatcaatacatccagtctcataccatggatcatttagattgcttccaaatttttattattacaagtcatgttgctattgaaatcataactactggccaggtacagtggctcacacctgtaatcccagcactttgggaggccaaggtgggtggatcatctgagatcaggagttcaagaccagcctggccaacacagagaaatcctgtctctatcaaaaatacaaaaattagcagggcatagtagtgtgcacctgtaatcccagctactcaggaggctgaggcaggagaatcgcttgaacctgggaggcaggggttacagtgagctgatactgagccactgcactccagcctgggcaacagagcaatactccatctcaaaaaaaaaaaaaaaaaaaaaaagaaaactacctgtacagcatgagtttctttaggactgtgttattgggaatacatatctttagttccattaagaattggtaagttgttctctctttgtttttaaagtagagatggggtcttgctatgttgtccaggctggtcttcaactgctgggctcattcaatccttccacctcggcttcccaaagtactgggattacaggcatgaactactgcacccagcctgctgcgttgctttctaaagagctttgtttcaatgcacaatctcatcaataccttatgaaagctcccacttacctgcatccttggtaacttaatctttgccaatacgcagagtgtgaaatgatatttcatagtcgttttgatttgctctgcttttcacttcagagaggctgaacatttccccgtctttattggccagttgggttctctcttttgtagcttgcctgttcatcgtctttgccaggtttttcaatttggtggtgtgtctttttcttctttgttttgattcattgttgtactcttacatggagtaactcagtgctcctgggcagtagcaagcagagaaataataactcaagctacagtctgcctggacggctccaaactcaagccaacttgctacgtccccaggagagagaaagaacttccatctttgccaagtagaagaatctgggcagtaatgaatgaggataacagccaaccatgtgtggatacttaattgcgtgaatctgcaactccatggttcatttcctacataagcttagccagagtcattcaggtgtgtttgccatacagggttactctaagtgtatgctaaagttattgctgtcaggtgcatttactctgcagctggtctgggatggccttgggtggcaagacccaactcctgccatgggtctcccatatctctccagaagggtaccagcccctgccatgggtctcctgtacccctccagtgatgttcacatggtggggcaggattgaagagggagagaataagcacctccacatgttcatgagtcactggaggctggaaccagtcagcatggtccaaatgttctctccagtgcgtgggggcaagttaactcttctatacatgactcaaattcttcacctggataacatcattcttgctattttggttattgtgactttgaaggatgatacactacatctctcttcaaattaccgtttatttcatgagatgagtagattctgattctaaagcaaccaggagtggcttacacaccttgcgactttgatcaagcatttaattctacttggctggcttcctactactttcttggccttctcatttaaatggtcaaaggctcccaatcatttcacacttctgcctgttcccccctcactctctctcttccaccctccactatgcaaagagaaagagtgtttttttggctcatctgtgctgtttcacctgaattaacctcgctagctagaaagccatcatcttttctttcctcctttgtaagagagtattcttttgattaattatttactcttaagagtttatatatattttttagattagctagaggtccatctatattattagtctttacaaactattatcttttggcgcggttatcatctcctctgtttttttcgatcataatttattaatgtctctttaatatagtttgattatatttattttcagcatttctgtgtgtttttacttgggtttgtctttgtaagtagcatatagctggatttaaaagcatccaatcagctgggtgtggtggctcatgcctgtaatcccagcactttgggaggccgaggtgggtggatcacctgaggtcaggagtgcgagaccagcctggccaacatggcgaaaccccgtttctactaaaaatacaaaaattagccaggcatggtagcgggcacctgtaatcccagctactcaggaggctgaggcaggagaattgcttggaaccaggaggcagaggctgcagtgagccaagatcacagcattgcactcccacctcggcaacactcgcaaaattccgtctcaaaaaaagaaaaaaaaagcatccaatcagatagtctttgcctttaaagagatcagtttaatccacttcctctgtgtgtatgtgtgtgcacatatgtgggtgtgtgtatgtgtgaatagagacactgttggactcatttgtactatccttattttgtgttttctatatcattggttaggttgcattctttacctgttgagtagattaaccctcttctcattttgtttccttctgaattggcatcattgtccgaggtaaatacctgaggttcatgcctcatgccgaggaaatcaaggacacagacacacacaagaagtgagtttaagagtgaaggtttaataggcaaaagaaagagaaaggagaatagcttgctcttctcgagagagaagggtgcctgagtgggactcccagctggcagcagactgcactggattttatagacaggcttgaggaggcagtgcatgatttacatagggcccacagattggttggaccaggtgtgatgtttatatagtgtgaggggaagctggctgccccaccctaatcttattatgcaaatgggctttcacttggcctgcaccaggttgtctgctccttactgcacacgtggttggcaaagagaagggaagatggagccgccatgttggacatgcctagtcccaggtagcccctttcctactggtacaactgccggcattcacccatgcaagcttctggcctgcctttctatgtctgcagctcagttttacaggctgctgtttgttagaaaaggaaatgatttgggggctgctttccactgaaaggaagactttactgaggacttccttaccctcactatctgcccaaatcatttcttcttaactcctatttcacttccttggtttggaagctataaattgtatttctgttaatttagaggttacccttgcatttattttttattctgttttgttttgcgacagagtttcactcctatggcccaggctggagtgcaatggcgtgatcttgactcactgcaacctctgcctccccggttcaagtgattctcctgcctcagcctccagagtagctgggattacaggcacctactgccatgcccagctaattttatatttttagtagagacagggttttgccatgttggccagggtggtcttgaactcctgacctcaggtgatccacctgcctccgcctcccaaattgctgggattacaggcgtaagccactgtgcccggccgacccttgcattttaatatcttttaaaatgttttaatgaagttcaaaattaattattcagcatctctgtggccaccgccaccttcattttttcttgattttttgggtgaccctgataatatcacagaggcagggagacagaggggcttcacattggctgaccagaggcatctggtactcacctccttcacaaagaagaaccaaaacagccagtcgataatcacatactgaatagatcacctaagagagaaagctagaagtcaactaaaaagtgagaaaacaccaaaggcaaggcgagggaagccaggcagcgtgcctggctgggatgagctgggagcctgcagtgtttcccattgcaggaaaagagtgagtgtttcagaaaaactcttcagctgtgtttttcctcgactctcgtaccaccaccaccacaactgtcaacacagaggaagacttctgtgaccagatgcgcaggggttttcctcccacaccaagcagcagacacaagccgggagtccttcaattccattctgacactatctacctagagagaggtaggtagttccaccctccaggaacttccacgtgttcagctatccagaagctccccaaactgaaccctgtcctcttgtttttttttttggttttgttttttcatttcagacagggtctcgctctgtcgctcaagctgtagtgcagtggtgtgatgtctgctcactgtaacctcctccgcctcccaggttcaagcgattattgtgcctcatcctcctgagtagttgggactacaggtgtgcctggctaatttttgtatttttagtagaggcagagtttcaccatgctggtctcaaactcttgacctcaggtgatccttccgcctcagcctcccaaagtgctgggattgcaggcatgaaccaccacccccagcccctcttgggtttttatggatgcctcacgatgtcagcattttgtcccccagggtataggggaggaccctctctggaaagggtcttaagacccacaatcagaaaggcaggggaagattagagtcctgcctttgggcagatgaaaggggggcaggggaaaatcagagagattctgtctcctgagacttgttcctaagatctaacacactaaatattataacaaaagactataacgagggctaagggagttatggaccaggaaccatggataaaaactaatatatatcatagcactgcggtgaatgattcccggtgtccacattcccactgtagactcctgtagtcttagccagggagccacgggcagtgtggcggtgtcctggtgtgtggtttttctgcttcctgtggccttcttaagatcagctccatgtcagccccagggttggaaagaaccctgtggcctcttttcctgagtcgaggagcctgctctcagcacctgctttcaaggaatgagctgagcccaggtgtctcattttgtagggggcaattttagacatctttccacaggaggggaggagcaccccgctacctctctctgtttctgtacccgaagtcagcaggccttcagtttcagggcaattttctgcattacatttgggttccgtttttggcctatagaaatgattactttgttctttaaatggacagtgtctttcccttatttatgttgcagagggcgtggaagtggtgctcagagcaggcccttctatcgcccactggactggtgtactgctgctagatcctgagttacttgaggataagaaccatttaaagtatttcatttctatatccctatgaggaacactatgccattgtaaagtggtgtcaagaattctgatgtgttggctgggcgtggtggctcacacctgtaatcccagcacttgtgggagtccgagagacaggagaatcacctgagatcaggagtttgagaccagcctggccaacatggtaaaaccctgtctctactaaaaatacaaaaattaactggacgtggtggtgcacacctgtaatcccagctacacaggaggctgaggcagaagaatcacttgaacctgggaggtgaaggttgcagtgagcagaaatagtaccactgtgctccagcctgggcaagagagtgagactctgtctcaaaaaaaaaaaaaaaaagaaaaagaagaggccaggcatggtggctcacgcccgtaatcctgcactttgggagtctgagacaagagaatcacctgaggtcaagagtttgagaccagcctggccaacatggtaaaaacctgtctcttctaaaaatacaaaaactaactggatgtggtggcacacacctgtaatcccagctatatgggaggctgaggcagaagaatcccttgaacctgagaggtaaatgttgcagtgagcagagattgtaccactgcactccagcttgggcaacagagtgagactctgtctcaaaaaaaaaaaaaaaaaaaaaaaaaagaatcctgatgtgtctgagattttatactacttgcatgctaaccagtgacctgccatggttttctggatgctagcagaagacatgagacacctaaattatacaaagaactttattcctcaagccatagcagtaggcagagtatcattatttttagttggtcccctgagccccagttcccatagagcaggggtccccaaccccccggccgtggagcagtaatggtccatgacctgttaggaagcaggctgcacagcaagaggtgagaggtgggtgagtcagtgaagattcatctgtatttacagcctctccctgtccctctcattcctgcctgagctctgcctcctgccagatcagcggcagcgttagagtctcatagaagcataaaccctattgtgaactgcgcatgtgagggatctaggttgcacgctccttatgagaatctaatgcctgatgatctgtcactgtctcccatcacccccagatgagactgtctagttacagggaaacaagcccagggctcccactgattttacattatgatgagatgtataattgtttcattatatattacaatctaataataatagaagtaaagtgcacaataaatataatgtgcttgaatcatccccaaaaccatcccctctccccagtcctaggaaaaattgtcttccatgaaaccagtccctggtgccaagttggggaccactaccatagagtgatgctcagaggacacagtgtcatctgcataaaattataggggaggaccccttagctaaggggcagtaggcttgcctgacctcagtcctggagggagacatcatctctaccatactgggcagtaattaaatttgcactttctctggagggagacactgtggcttcaaaggctgttctctctgcaaacatccttgaaaagacagtactgaacaaaagcatttggtgcctgtgcttataagacatacagaaatgtaagagatccacagagaattgtcttccaacaaatagttgctcaataagtcttttccgcagtttcattatgtgcataaatgtactacagtgataggatatagtgaaagcataatagtcaccagagatggaggatggatctctagtgttgcctatgactctgggataaactgcagtcaattcagggaagtttggtctctctctatatgcacaatgggaagtaataggaccaggcaaaagcctgtcaacaataggtctcgtgacaacacctggagccacagctggcgctgcccctgccctcagtgctaaggctgctactgttcttcggccagcaccgtaaagaattcatgcctgtaatcccagcactttgggaggctgaggtgggcggatcacgaggtcaggagatcaagaccatcctggctaacacggtgaaaccccgtctctactaaaaatacaaaaaaaattagctgggcgtggtgggggggtgcctgtagtcccagctacttgggaggctgaggcaggagaatggcgtgaacccaggaggcggagcttgcagtgagccgagatagcgccattgccctccagcctgggtgacagagcaagactccccctcaaaaaaaaaaaaaaaaaaaaaaaaaaagaattctctagagtccctgagtttttgcaatactgactcaagattcagcatcgtgattgcctgcatctggttggacgatccttaggcatagaagctgacttgtttgagggtttattctcagaagtggctcaaattcccaccaagactcttatggtggggaagctcccagacgtaagaaaggaatgcagatcttgagcctacactttgcttggacacatatctttggcagctgctaagatgtgtgttagtctgcttttgcttcaggagctggtgggcatgaagagggatgattttggttttctttgcattgctttttttttttttttttttaaagacagagtctcactctgtctcccaggctggagtgcagtggcacaatctcagctcactgcaacgtctgcttcccaggttcaagcgattctccttcctcaacctcccaactagctgggattacagtcgcccgccaccatgcacggttaatttttatatttttagtagagatggggtttcaccatgttggccaggctggtcttgaactcctgacctcaggtgatccactggcctcagtctctcaaagtgctgggattacaggtgtgagccaccacacctggctctttgcattgctttttgtaagcactgtggagacatgtgtctcaggtaaactcccagcaggtgtccatagcccatgagacagacctgtgtggctgagtgccaggcactagcccctctgattgtaaaatctgatgagaggaagcaggtgcaacactgtctggtctaaattctcatcaaactcacgttttcatttttatttatttatttaaaaattttgaaacagggtcttgctgtgttgcccagactggagtgcagtggtgccatcaaagctcactgcagccttgaactccttggcttaagtgatcctcccacctcagcctcccaagttcctgggactatacaggtgcatgccgctgtgccagctgatttttttctttttcttggtagagatagggtctcgctatgttgccgaggctggtttcagactcttcccttggcctcccaaagcactgagattagagacattgttatcaagcaaaagggtgcccaatgcactagaattgattttggtttttgaccaaaatcagttctatgacatcaggttttttagaaaagaaaagctttatatggaaagtcaactcataagcagacagaagtgtcaagatcaaattcgtctgtttgtggttggcttcaaggcagtatttttattagaaaaggttcgggtggattttgagattaggtgattggtggaaagaaagtgctctggaaagtccttgggcatgcgcagttatctcttcatgttagctcacgggttgcacgtgcaaattgcagggggagttagtctgaaacaggcaggggaaattcaggttgtgacatcagcaggctccttctgtgcaaactccagccagccatcttggttccaatcgatttcagtcagttcttttatctcataagcagagggagtttcagccagttgtttctttttctatctgccatcctgcagactcaagaatttccattcacttttggtttcttttaactctttgggggcacagtttcagcgtgagtcactgcacgcagcctttcaagcagcctatccattttcaataggataaggatcaaagggaggacctcgttcatttcccatctctgggaacatctcagccatccctgcgcccagcgctcctgtctctggacagaacctaggctagggttccgtgcaagagtctgtagaggccatctatgctccaggacacaggctgctcccatttctgcatttggggagggagaatctctgggagaaggagccaggctcagtgctgggaatgtgtggcccaagaccatccccatgacctagctccacaaaggaagggtccctggaaggtcacgtccagctatcatatttgcctttctctctggttctcagtccaccctgcttggggatgttacgtgattcatcacctttcagtcattgccatgaccagatggccagccttgggatctacccccatgtgttttacatcagtgtatcctctgaagttctttggttcttgaccgaaatcattgttcaaataaagtcaatggtggacccaagaccagtgaccagaaataaatgtttgtcttgagaatcctctcagtctggtgtgaatggttggaaattgtctcttgtggagaccggagtctggcataattagagtgtactcgagatctcaaattttaaaagccttaatatagctggtaatactattaggttggtgccaaagtaattgcagtttttgccatcaaaagtaatggcaaaagctgccattactttggcaccaacctaacctaatgtgttttgtactgaaactggtatcatgaaaagaggatggaagagcaagagagtgaaagttagtgcatggagggaggattaaggggcatgggtcttcatggttaaaaataattattggtgtgatctcattaaaaaactaaataaaaaagaggccgggtgtggtggctcacacctatcatcccagcgcttttggaagctgaggtaagaggatcacttgaggccagaaatcaagaccagcctgggtcacaaagcaagatcctatctctagaaaaataaaaataaaaaattagctggttgtggtggtgcatgtctgtagtcccagctactgtggaggctgaggcaggaggatttcctgagcccaggagttggaggctgcagtgagctatgattgcactgctgcactctagcccgggcaacagaacaagacccccttctttaaaaaatataaaaataaaaatgaaagagcacaggtatgttccatgaagcacatggaagatattggatatggattgtgccaggaaaattaacaagggaggtggtggatgggatagagactacaaatattgattctgccattggatttaaactttattgttttttatgactgaggacacagatgccacccaccagaggaatgaatgtcaaattggtggaacaagaggctagcacggggctcacatccctccctaaatgtgcctctgttgcaggacctgtctctgggcttgtttgctgggatgggtttgcccagagaagagtatctgtccctgcacagcacccttcttgctgatgagaagaaacacagccagtgactaattggatttggtgaaagccccagctggttgggtgggatttggtgactgatgtgccgccctgctgtggcttcctggcttaaggacaggaccttctttccccagacagaaggttaatgagaacagagagcaaaacatctcaggggccttcatctcatctcccagaactattgcccaaatggagcctgtgctggcttccaacctaattgctaatccgagcggaattgcaccagtccaacctcggagctacagagccgtaggccaggtggtgaccgtcttccttcccagagtgccagaaagtttgttccaactgacagcagggccaggggaaaagaacgtctgtggctgcactttccaagtcacagacatctctgcggatggtttgttccccagaacttgccaatacctgcccacttaatgcttgtcaattcatccagatcacagattgtcactatagtctactgctttctgcccagaatcttcaaggacagaatggtcagtaagcatcgtagcagaagaaaacacctcaaggggtggtggaacaggcacctagcctgtgtattcttttctaaaaaggactagatagcaatataagctgtgtggggtttttttttctttttctttttcctttttttttttttttttttttttttgagatggagtcttgctctgtcacccaagctggagtgcagtggcatgatgtcagctccctgcaacttccccctcccgagttcaagcaattctcctgcctcaatctcctgagtagctgggatcacaggcacgtaccaccatgcctggctaagttttgtagttttagtaaacacagggttttgccatgttggccaggctggtctcgaactcctgacctcaggtgatccacctgcctcggcctcccaaagtgctgggattacaggcgtgaaccaccatgcccagccaagctgtgtctttattgcaaggatgatccaagttaataaagatcatcattttgtttaccatatatttggttgaattacatcaattcagactatgcagggaaggccagcctggactacttagagatacctcattatttagacattttgaagaaatggggctttattacagcacatccccacatttttgtatatcgaaggtaattgaaactaactgctacttttaaaaagtatttttaaatggaatctctgagacacattgataattagagcatccttttataccctcaattaaaacgccaaagtctctggaagttttctttttacttaagtcacttaaacgtagctgcgtcattttatttaccctttgtttggcaagggagctcattttcagtgataatggagatgaagacttaggccctcccctcatcaaattatcatgcatcttaaatgtgccaaatctaaaattcttaatgagggtttacagttcataaacacgtctctggttttaaaagcctcatcttaagcaaggagaagacacatttctgctcttgccacgcggtgagataaccatatattggctcacagatacgtatcttctggcttacccattatttctatggtgcaaacatcagaagcaaggaatactcaaaccagaattcaggctgggcaaggtggctcacgcctctaatcccagtactttgggaggccgagacggatggaacacctgaggtcaggagtttgagaccagcctggccaacatggcaaaaccccgtctctactaaaaatacaaaaattagctcggcgtgatggtgcgcacatgtaatcccagctacttgggaggctgaggcaggagaatcgcttgaacccgggaggcagaggttgcagtgagccgagattgtgccactgcactccagccagggcaacagagtgagaactgtgtcttaaaaaaagggaaaaaaaaaacccaaaacagaattcaattttcagggaatgtgcctgttaagtagtgcaggattattttttcaaaaatagagagcacctacttatgttgctgttaatgagaccatcaactggaatagatcagcgtttgccctcaaagaacccaccctccagtgaggggatggtgtgagggctttggaggacaattctctcacctggctggcaattcctggggctcaatgtttatagaactgtccctcttttcatgagtgaacatcaggtgactgttccaagctgcaaaatatggggaacaaacaaaagatcgcaagagatcacactctgcccacacgccttgcaggtctcaacatcagcctctcctggttacagctgagacagccttgattgctatacaggaatcaaatgaggggagcttaacggcccatcaatcactgccaagcacacgtgtgaatgaagcacgcacgaagctgaaagctgcatggtaatcaacagagagtggctcattaaaatccattaaatttcctaagttggaaattgattgctgtctctctgcacaccatctaaatctcatctgacagctttgtctgacatcatttatcacttgcgacaaaataccaaaggaaaagaggatacacctttggccaaattatcccactttaggtctgttctttctgcctgtgtggaagtattgcacgctctcttagcagatgaacataaaagagaaggtaaaaatattctcctttcagatataaactaaaacaaaaaatggatcagacctccaaaggatcatttctcacaaaggccgccattctataaccagaagtcttttggcccacacaattttcgagtcagatatacacgaagtttcttctccctgagcgtgcaacaaaatgcaaacgcccactattgaaaaatcctgtggggtgttcagaacgaattgaatgtcatcattaagctttgggcctgtggacccctagaaggctgaaggtttcagagagagatgcaaatttaaacatatcagggtccagatgtctggagggtattgtgtattcatttacttgtctattcgtgggtactacgtccgtattcacctctttttagttgggttgagcttgagcaaatagcgtcaactctgagtgtgtctttctttctttctttcttttctttctttttttctttctttctctttctttctttctttctttctttctttctttctttcttttttttttttttttttttttttttgagacagggtcccactctgttgctcaggctggagtgcagtggttccagtttggagtgactgtgaatggagctatgagcaatcacagctcaatgcagcctcagcctcccaggctctggtgatcctcccatctcagcctcctgagtagctgggaccagaggtgtatgctaccatacttggctaattttttacttttttgtagagacggggttttaccatgttgcccgggctgttctcaaagtcccaggctcaagtgatccccctgcgttggcctctcaaaacggtgagattacaggtgtgagccatcatacacggccctgtatttcttcacctgtgtaatgagaataataatatgaccttgcttcttgcagatgtgacaatcaaatgagataatgcatatagaatacttagtttcatactttgcacatacaagggtctcagtaaatattcggggttttttgtttgtttgtttgtttgtttttgaggcagagtttcgctcttgttgcccaggctggagtgcagtggcacgatctcagctcacttcaacctctgcctcccaggttcaagcgattctcctgcctcagcctcccaagtagctgggattacaggcatctgccaccatgcccagctaattttttgtatttttagtagagacggggtttcaccatgttggccaggctggtcttgaactcctgacgtcaggtgatttgcccgccttggcctcccaaagcgctgggattacaggcatgagccaccacgcctggcctcatctcctttctttggcctctttttatagcgtgccttccagcagacacactcattactccctatttaccagtcctcttttgtggctgtgtgcctgtaattctcagtcatattgcagtattgcttttgctctttcctttactggttcctagtgtcataatcacacctaagatgccttcaggatctttcttgcctccgctgggaatgccgagtgaacctgcacaggcttggaatctaggtgttcaagccagcctgaaattggctctcaattttgctgaacctatcagcctcagatccctggtgctgatcaaagtggtttttaaattgtaggtcttgccatttggcagtaactgggccttgtcaaataggaaaacgctgggatggtgatgacttgagcccttttgtgaataaggagcacttcccttctctgctccttattgaaaatgtcacgagctttattgcctaagtgttaaagcgcggggacgaagtgggaaatcactttaacttccattcagagaatgttgtattgcctgcctatttctggagggcataaaagggtagctggctgcaaaaaaaaaaaaaaggtatattttgcagatacaagtcccaaaaagcctagttgccattttgcattggatttcttaacggccaaagcctaaaatgagtataagaatgtcttcttggtatagccttttcattgctacttggtcaaatatgctgggattgtgatataacttaatataataacgtaagttgataagtaagaaaatgagggtgtttgcttagtcagaataagttagtttcatatcagaagggtactgttttctcgcaggattaagtaactgttaagtcttgggattggaaggaagcaatcatttatctaaatgaatctttataggagatccttctcaaatgactatccaacctgtatatatagtgataaccactgcctagaaactctgtcttttctcggacagtacattgtatctgttctgtgccccattaggaatgggttgctgggccgggcgtggtggctcatgcctgtaatcctagcactttcggaggccaaggcaggaggatcagttgagtccaagagttcaggatcagttgagtccaagagtttgagaccagtctaggcaacatggtgagaccctctctctaccaaaaatcaaaaaattagctgggagtggtggcatgagcctgttgtctcagctacttggaaggctgaggtgggaggatcacttgagcccaggaggcagaggttgcagtgagccaagatcataccactgcactccagcctgggtgacagagtgagaccctgtctcaaaaaaaaaaaaaaatggtcctacagtagcctgtacccattggccccacacctaattcaatgggacaagtcagaattaatttacttcccttctacctgacaactcataaaatatttaaagaaagcttttgtgttttcactgtctctctttctcttctccgggataaacttccctgttccctaagtaccatcctgtttacctttttctgataatgctatgttcagatccttattcctcatacaaagaaacatcccaaattgaataaagcatggtagattctgcatgatagtaagccttaatgaattatgtttttatggcttgaatgtttattaatatgtgtcaggaggagacactgtcatgatttatttatgtatgtatgtattcggttatgtacactgtaccttgattaaaaaaatacttagtctctgacaagtatctagaccacattaagataaaacggtttgttagaaagaaatcaggacaaaaggcaaatgaaagtaggaaagtaagatgatgctgaggagaaggttaataccgagaatgcatgtcagacacccagtgccctgcttgctaagagcctgggcaaagggtaacactaattagttacagggttcacaggctgcaaaagataaaaacaactccagtactcaagagaagtgctgtataaccatttctggtgctgaaacgtttcttctttgactccacatgaaggggagactgaatgaagtatttggagatataatttccaaaattcatcctttaggtgtgcagttctatgattttttttttcttttgagatagaggctcactctgtcaccgagactggaatgtagtggtacaatcatagttcactgcagcctcaacctcctgggctcaagcaatccccctgccttagcctcccaagtagctgggactacaggtgagtgccactataactggctaattaaaaaaaaaaaaaattgtagaggtgtggtcttgctgtgttgcctaggctggtcttgaactcctggactcaagcaatcctctcacctcagcctcccaaagtgctgggattacaggtgtgagccaccacagccagccacttctatgtattttgataaaacttatgcactcatctaactagcactacattaaagatagagaatatttccatcaccccgggtcccggcacggtggctcacacctgtaatcccagcactttgggaggcggagatgggcagatcacttgaggtcaggagttcaataccagcctggccagcatggtgaaacctgtaatcccagcctcttgggaaactgaggcacgagaattgctggaacccggcaggcggagggtgcagttagccaacattgcaccattgcactccagcctgggagacagagcaagacttcatctcgaaaataaaagagagtatttctgtcactccaaagaaggcctcatgtacctttggagtcagtagccctagtcccagcccctaggaactgctggtctgatctcacttcttgtagttttgcatttttcaaaatgccacagaaatagaatgaaacagtatataaccttttggcctggctttttttcattcagtataatgctttcaagattcatcagtgtggatgtgtgtattacgagtctgtttcttttttttgttcaggagtgtactaccatagcttacactctgtgcatttatcccttcactagttagtagacatttgacttgtttccagtttggagtaactatgaatagagtcgctataaatattcatgtacaggcatttgtgtgggcatatattttcatttctctcaagtaaatacctaggtgtgggattactgaataaaatgagaaatgtatgtttaactttatacagagatgccaaaatgttttccaaagtggtgataccatttttaattcctaccagcaatatatgagagttccagttgctttacatctttgctagcaatagatattcttagcttcttttgttcgcttttaaattttagcctgtttaataagtctacagtggcatctcattgtggtttttgtttgctttcttttcatttactttagtaaattctttagtaatatgtatgctcaaatcttcccctttttaaattgtattgattgctttcttattattgagtttgaaagttctttatattctttattctgggcacagacttttttcttttcttttcttttctttctttttttttttttttttgaaacagggtctcactctgtcgcccaggctggagtgcagtgacacgatcacgggtcactgcagccttgacttgggctcaagcgatttttccacctcagcctcctgagtaactgggactacaggcatgcaccactgagctcagttaatttgtttgatttttagtagagacaaggtcttgctatgtttcccaggctggtctggaactcctgagttaaagccatcctgacttggtttcccaaagccctaggattacagacatgagtcatcacacctagtcaggtttctttaacaggtatttgttttgtgatattttctgccatattatatctcgtgtgttcattatcttaacagtgatttttgaaaataaaagttttcagttattgtgaagttcagtttgctatttctctccttcattattcatgctttatgcatcttatctaaaaaatctttgcctagataaaggctttctctgttttcttctgtatattttatagttttaggtttaatatttaagttgtttccattttgaactgtttatccactacgttattggaataaacaagtgaatgggtttcaaagatatgtttcctaaacagttctcaataaaaaccaatgacatcatggcaaagaatattccagaaacagcttctactggggaagctgaacaaggacatatctttctgttgttctgacagaattcaatgataaattttagagtgtctagagaaagcctcttcatttggggggatttacaacttacaaagttgcatgtaaaattaatctagctttaaattttctggaagagaagaactataattttcattaggctttcaatgggggtagtgaccaccacttgctccccaaaacgttaagaaccatggtattagtctgttcttgtattgctgtaaatacctgagactgggtaatatataaagaagagaggtttaattggctcttgattctgcaggctgtacgggaagcatgatgctggaatctgctgagcttctgaaaaagcctcaggaaacttacaataatggcagaaggcaaagaggaagcaggtgcatcttacatggcaggaccaggagcaggagacagagagagaggagggaggtgccacacacttttaaatgaccagatgtcatgagaactcactatcaagaggacagtaccagaaggatgatgctaaatcattcataagaaatccacccccatgatccagccacctcccaccaccccacctccatcactgaggattacaattgaacatgagacttgggtggggacacagatccaaaccatatcaaacattgacctagggcaggattccacagaccaaggttcacaggccatgtccagcttgccacttattttgcaagtaaagttatactgcaacatagccacactaatttgtattgtccatggctgcttgctttatggtgacagagttgactgtagagttgaattgttgggatagaaactacaaggagcaccagaactatttgttatctggtcttgcacaggagcatagacagactgtatatccttcaggttaacctgcaaaatagaaattgtctcagctgatttttctattgagtattgtgtagattgaatgcaagattatactccctggtagtacttggagggcagaagtgtggtgttgatggttttgcaaaactccatatttcaacagtgaaaagctctaagaagcaccgctactgtccttttctacaggaagaagaccaagaaagatcctctaggcttttaaatactaagttatctttgtaaattatttaggaatcactcaattgagtgatactggggcatctttttatgccccagaacatagctgcaataattttaaattgtgaaatattttaagtggtcactaccatatgcctaactttgaactttcaccaatatatcttttggttgtgcatataccatatcagttgaaaaatggatctcttttaaatgaataaggtaagtccctatgtaggaatttagctatacaccatttaagtgcatttaatgtttgtttgtttgtttgtttgtttgttgttactgtttttcaaatagcagctctgaagcccttctttgtagaatgaatgagatacctattaaagtcactcctggcttatgagtataaaattatgtcatctgcaagtgagaggaagcttttagttttccttacagaaggttggcaccttctttctaggactcacactaaagattgtgcttttccaaaagtagtatcttagtatctaaacaattaaagggatactttttaaaaagtgaggctgggcatggtggctcacacctgtcatcttagtactttgggaggctgaggcgggaggatcacctgagcccaggagtttgagaccagcctgggcaacataacaagactctgtttctataaagaataataaaaagtttagctgggtggggtgacatgtgcctgtgttctcagctacttggaaggtggaggcaggaggatgacttgaacacaagaggtagaggctgcagtgagctacgatggcaccactgcactctagcctgggggacagagtgagaccatgtctccaaaattaaaaagttaaaaataaaacgtgagccagaaaacattcttattttcccctgaatcctcaaaaacggtctctactaactcaaagtctggcagtgtttttaaggtgctgattgtgagctcagcccaagtcagtgaaaccatctattccttacagatttcttcatggactgatagaacattacattggtcagtattggaagactcttacccaaagcccatctcattcccaacatttcttgcaaagcccagacttatcatttatacagagggaaacaggcatgcatttttaatgaagtgttcaataagttaaatatatctatactttggaatgaaataaagggttgttcctttttttgttttgttttggtttggtttttttttgagacagagtctcgctctgttgccaggctggagtgcagtggcgtgatctcagcgtgagccactgcgcccagccggttgttcttttgaaaatgatattaatgatcttgctgagagctatctccaccactcaataaaaccttacactcattctccaagcccacatgtgatccaagttttccagtacactagggcaagaacccaggatacagaaagccctctgtccttgcgataagcagagggtctaattgagctcattaacacaagctgtctgcagacggcaaagctgaaagagcacactgtaacagacgcccaccaaggcttcaggagctgtaaacactcacccttagacactgctgtggggtcagagcccaaaaatgctccccacgacccctacacctgcctgtctgcatgcttccttaggagtttgagcagcagggcagcaaagaagagtcacaaccctgtcgcacatcctgtgacgggggataaaggaacactcccatttcagtgtccatccgtaggggaatgcgtaagccaaagtatatgatatgacatacttagcaacagttcagatgtacatacatagcagtgtggataaaccttaacaatgctccctttagtcaaaaaagaaacaatgagattcatagcaggaaacatttatgtttaaatacacggacattgaaaacaagacatattttggggacagtatatcagaggggataagaatatgaattcctcagccaaacttcataggtcctaatcccagctccactatttacctcttatgttagatgagttacttaatttttgtgcctcagttttcccatttgcaaaatggtgataatctcattgcattgctatccagatttgatgagttaatgtacgtgtagcatttaaaatatagaataagtgctaataagtgtaatctattattgcagtacatgtatcagtattacatataaaacatataaagtggtgaccaagggggtaagggaaaaaaagtggaatttggggaccaaggagagacgataagaaaaaaagaagagaaaaagtttcctaggctgggcacggtggctcatacctgtaatcccagcactttgggaggccaaggtgggcggatcatttgaggtcaggagttcaagaccagcctggccaacatggcaaaaccctgtctctactaaaaatacaaacatgagctgtgtgggctgggcacagtggctcacacctgtaatcccagcactttgggaggctgaggcaggtggatcacgaggtaaggagatcaagaccatcctggccaacatggtgaaaccttgtctctactaaaaatacaaaaattagccgggcgtggtggcgtgcacctgtaatcccagctactctggaggctgaggcaggagaatcgcttgaaccagggagtcggaggttgcagtgagccgagatcgcgccgccgcactccagcctgggtgacagagcaagactctgtctcaaaaataataataataataaaaataacaaagtttcttagagcttactgtttagtacaggtgaccctaattttgtgacactagcaagagtaaactttccaggtttacctggtaactgagattccaaaacttaaataccagttacaaatcttggatacctatgtttaaacctgtcctctttgtagtatttgaaggccaaactgagatccttatatatgagaatttattatacttgaatctttcaaggttactagaatttgagtaagcgttgaattgatgagatcccgctgatctcttctgatttcatttttccttgttactttgttcatctcaccagggattgtcttttttctttttggcctggcaattcctgacagatcaggcactagaaggaaaaaagacccacatttgctgtgacatactgtagataaaactggtttaaagctttcagcaatttgtagaaaagatgtggaagagaaatcttctcctcacggcacccaaagtggaattttaaaaggtattagataatgaaaggtttctaggggaatttgaaatcttcttagtcagtctcacactttctagccccctgagctcaccagtgtgaaaggttgagatgaggggaaatattcactctctatatagtccagaatgtccattcaaacggtagcaaatgcagagggctcaaatatggcatggcttttgccagcagttcgcagcatggactcggtattggtatttgttacaggtaattggcttctgctcacattaattaatttattggaggctgggtctctctctttcacccaggctgcagtgcagtggtgccatcatagctcactgcagcctcaaactcctgggctcaagtgatcctcctgcctcagcctctcaagtagctggaacaacaggtgcatgccaccaggcatgactgattttttaaacttttttttttttttttagagatggggtcttgctgtgttgcccaagctggtctcaaactcctggcctcaagtgatcctccagccttggcctctcaaaatgctgggattgcaggtgtgagccattgtgcctggccacaaggttattcttataataactttcctatcttgcacttgcatcttgttttatgagaaaacggaatacgcagatacaaatgaagagatgatggacatagggtaggcaggtgaaaggaacaaacaagatataatgaggctccctgaggctacaatagctggaaattgttcccactccaagggctgaagggaaagggttactggaacctcacgaggtctggaagaggtgccactcagcgggaaataggcttgtgaagagacatagctactgccagagtagcagagttttgtcagaaagtatgcaggggaggaggaccctgccctctctcttctgctgcccttgaatttcttgccattgtctgaattggcctaacccaaacagaagctagcagcaagtttgtctaggagatgcaatctacagagatcagtttccaagggcccagggcagagaggtgcagggagggaatggcttgtggagatggcaaatggagaattgcgcacacacattttcttattcctttttgtttgttttaatagtgagagaaagaagtttgcagatttcatgtaacagtacccatgggagtacagtacacaagtgaacgtaatctattacgggttttatggcagaaaagagattggtaattactggtctatggggctgactcccaagggggaaatacaggtaacattttcatcagctagatctcatgtgctaacattaaaacagaactgggttttatgtataaatacatttggtagggaaatttctattaggatgtaaatatctgtctttagaagaggggatgtaagctcggtttgattccttgtctgtcttgtttgctattgtatacccagtatctggcacagttcctggcattgtgaataaatgaatgagaagtaatctttcagataccttatgtattataggtatagactaattggactgacaatgatagtaactttgctgattatgtgaaattcatttaagataaaaagtcttatgagcagtggctcatgcctgtaattccagcactttgggaggccaaggcaaacagatcacctgaggtcaggagttcaagaccagcctgggaaacatggtgaaaccccatctctactaaaaatacaaaaattagccaggtgtggtgtcacaagcctgtgatcccagctactcaggaggctgaggcacgagaatcgcttgaacctgggaggtggaggttgcaatgagctgagattgagccactgcactccacctgggcaacagagtaagactctgtctcaaaaaacaattaaattagaataaaataaaaagtcttaatatcacgaccaggtaatggtgtaggagtttgcacctgcatggaggtagagagtggaagaatataactattaaaaaagatctaaaattagaactgccattcaatccagcaatcccactaccaggaaagaaatcattatatcaaaaagatacttgcactggtatgtttgttgcagcactattcacaatagcaaagatatggaatcaacctaaatatctatcagtggaggaatggataaagaaaatgtggtacatagacaccatggaatactactcagccataaaaaagaatgcaatcattatcttctgcagcaacacggatggaagtggaagctactatcctcagtgaaatagctcagaaacagaaagtcaaataccacatgttctcacttacaaatgcgagctaaacaatgggtacagatggatgtacggagggaatgatagatactggggactccataaagggagaggctgggacggaagtaagatttgaaaaattccctattgggtacagtgtacactgtccagatgatgggttcatgatgcaatatatacatgtaagaaacctgcatttgtatcctctaaatatgcttttattttatttttttattttattttatttatttatttatttatttatttatttatttatttatttatttatttttgagatggagtctctctctgttgcccaggctggagtgcagtggtgccatcctgactcactgcaaccaccacctcctgggttcaatgattctcctccctcagtctctagagcagctgggattacaggtgcccgccaccacgcccagctaatttttgtatttttagtagagatggggtttcaccatgttgaccagactgatctcaaactcctgacctcaggtgatctgcccgcctcggcctcccaaagtgctgggattacaggcctgagccactgtgcccggcctaaatatgcatttttaaaaaagaatacaactgtgaagagacatcacatttggtttgcccaggaattgaaatagactagaactagaaatagattctagtcctatgagcaccatggagtctgaccactgtcctcttgtgctgatggagttgggactgggtgaccatcgtgtctcacctttgctgaaagtatccaccacacatacccttcccccacttaaaaaaaaaaaaaagctggaaaggtaaaaaagtcaaaaccctggaatatgtagagatgtcctaaactccaagtctcttctatctatatcatgttaaaactcatcaggagaactggtatacccctatgctctatgctctgggaaaggaacatagtcgttttggtagatgttcctgggagaaggggaagcccattttcctttcctcaaaaggacttgcctctcacccatcttaggaaagttttccaaatatataaaaacaaccaagtctggattctccaatcctgtgtttgcgatctccaagaaagaacagaacacacttctggacaacttgtccaaacttcagaactgatcacaatgttgctagccacattatgtgaatattagatttcatgttagcttgtcatttaagaccaggcagaagggaagctcctcctgaaccatgagacctgactcatcactgcctaccatgacaggtgcttcactgctactaagtctggtgaaaaggagaggggcaagccattcagtttgctttctctcctagcctttgatagtgccacagcttccagaacatccttgctttaattgagcagcctatgcctatcttttataactaacaagtgacccaaaatacaggcatgtgaaagcctgatactccaggtttcccgtcataaggaaagccactcggagaagtcaggcagcatgttggaaagtgatctgagggtctgatctgtcagtcaagaaagaactctgggcaatgtctgttgtgaggctgggtgggagactcagtctgttaaggtagcagtgatgggtcaggtctcacagtgcaggaggagctgcctttctgcctgattttgaacaagcagctaacatgaaatctaacagaagagaccacataatgtggctagcaccattgtggtcagctctgaaggatggcaacgcaagttgtccggaagtgtgtcctgttctttcttggagatcgcaaacataggattggagaatccagactttgctgtttttatatatttggaaaactttcctaagatgggtggagaggcaagtccttttgaggaaaggaaaatgagcttccccttctcccaggaactgtatataccacatgtgcctgggcaaacttggtagtctattggtactttgtgaaggaccaataaggtctttgacagataggaagactacacaaaggggcctccctgagttgtctgttgtgtcttacaatgaagacagggaactggaggaagccaagagtctcatgagacagagaatggatcaaactaataataagctcattttaacaagaccagtatgagaatagggcaagaaacctgacaaacagaggggaacagtagatactggggactccataaagggggaggttgggagaggtgagatttgaaaaattacctgttgggtacaatgtacgctattaagatgatggatccattaaaatctcagacttcaccatgatggaatataccatgtaagagattggtaattactgcactttctttttttttctttttctttttttttctttctttcttttttttttttttttttgagatggagtttcactcttgtcacctaggctggagtgcaatggcacaatctgggctcactgcaacttctgcctcccaggttcaagagattctcctgcctcagcctcccaagtagctgggattacaggtgcatgccaccacgcctggctaatttttgtatttttaatagagatggggtttcatcatgttggccaggttggtctcgaactcctgaccccaggtgatctgcctgcttcggcctcccaaagtgctgggattagaagtgtgagccaccatgcccagcagaaacctgcactttcttagtgcgaggtgtgagccacagcacccagcctaaatttttcagtcttaaaatgagaacattcctagtttcttctccttcttcaaaaacaaaacaaaaaatccggagaatcacctcacttcatgcctgtctaactcaccggaaaattgcattaatctgtctgagaactgaagttacttaagagatttgccatttgtaagttgaggaaggcattttaggtttgcagtgatcagtacaggcgacagatcgtaatggggtagagaaagagtgtcaaggtttgagagtggtgtcttttttggggtttgattttttgcagagtgaaatatttcatctctgagttgcttactacgaaaagagtgtctttgttttatttttttaaacctctttatttcctttttaggcttttgtatcagatttcatcacgtttttgtctttccagaatcattaatgataaattcttacagtcaagaaaaatattagatctaaccaaaaatttaaaagtcacagtcccacccacctcctatcaatctttctgaaagaagtaaatcaaaattctctcacagaagatgaaagtgaattgtccatcaaagccgagagtggctgcttgattacttcagcatccagaccatgtcttcggctgcgatagaaacaagatgattaatttcagagcttctctcggtgtctcatttcgctttcaccacctccccaccaattcataaagctcccgtgaagggagatgaagggattgactatcaaaaaaataaagtatagggctgggtgtggtggctcacacctgtaatcccagcactttgggaggccaaggtgggtggatcacctgaggtctcgagttttgagaccagactggccaacatggtgaaacctcacctccactaaaaatacataaattagccaggcgtgatggtgggtgcctgtaattccagattctcaggaggctgagacaggagaatcgcttgaacctgggaggcagagattgcagtgagctgagattgtgccactgcactccaacttgggtggcagagtgaaactctgtctcaaataataaaataaaataataaaataaaatgtaaatgctcctggcttgctgtgtgcctgcactgctacatacaatcaaaactttaaattgggactggacacagtcagcccctgtaatcccagcactttgggaggctgaggctggaggataacttggggccaggagtttgagatcagcctgggcaacataacgacaccctccctctgtttaaaaaaaaaaaaaagttatcagaacaaaaataataataatttttaaaaaaaatactttaaattgaaataatgcccaatagtaaaatttccgggcactcttatctgcagtctttctgtagctcccaagtcctcccctacagcatacatatgtgccctcaatcatcctactcatcacaaaaggaaacaaagttcctttctgctattaaaattctagaacgggctgggcacagtggctcatgcctataatcccagcactttgggaggctgaggagtgaggatcgcttgaggtcaggagttcgagaccagcctggccaacatgatgatgctccgtctctactaaaaatacaaaaattagctggacatggtggcacatgtctgtaatcctagctacttgggaggctgaggcaggagaattgcttgaacccaggaggcagaggttgcagtgaaccgagatagtgccattgctctccagcctgggtgacagagtgagactccatctcaaaaaaaaaaaaaaatccagaacatacatggcccagtctatactatctcggttgggggctttcagtgaaactgccggctctgagatcaccaggtaccacccaggtgccagactaaatagcggcttttcaatcttcagccctcaagccctcttagagtacattctacttctgactttcctcccagaggaggttgtctgtctgcttggtctgaaataagtgcatcatagtcaggtcatgttggaatctgactccttccaggacggatctcctgagttccagaacatcaggggcttattgagccagggcatgctcaaaacttaagatctgtaccctatattacctctatgttgatcagttttttaatctaaggaaggcaatgcagtatgttctgtaatattttccacttagaccagtggggaaagcgttcattttggggttcaacagacctggatttgaacccctgctgtgccattgacttaagtgtggaatctctaaattcactgattcttgcagttctcacttagggagtaggggtcatattgacctcaaagagcattttgagatttaaataaaggaacgtatgcaaaaagttgatcagcttttcaacctctccgctgtgtcattcccattagaatactgatacagtttggctgtgtctccacccaaatctcatcttgaattgtagctcccataattgccatgtgtggtgggagggacctggtgggagatcactgaatcacagggacggtttcttccatactgttctcgtggtagtgaatacgtctcacgagatctgatggttttatcaggggttttccgtttcgcttggttctcactctctcctgcctgccgccatgtacgatgtccctttgcttttccttcgtcttctgccatgattgcgaggtctccccagccatgtgggactgtgaatccattaaacctctttcctttacaaattacccagacttgggtatatctttattagcagtatgagaagggactaatacagatacaaacatacttagacaactctcatcctaaaaaacaacattccacgccttgtaagatgtgggtaaaataaataagaagaataatagtcaaatgaaactgtctgttcccctgtagagaagagttaaacctcactcctcttcactgctctgaatcaaccccccaggtagtagtctgtactcactgctgccagttctcttctcccactgactcctgaatctactctgtcttgattttcattcttaccattccataaaacaaaacagctctagtggaggtcactgatgaccaccatgttgctaaatcccacagtcaattctcaatccgtatcttctttttaatgtttgagacagggtcttactctgtcactcaagctggagtacagtggcgtgatcacagctcactggagccatggcctcccaggctcgtgcagtcctcctgcctcagcctcctgagaaggtgggactacacatgcacaccactatgcccagctaatttttattattatttttaattttttttttaattttaagttttcgagatggagtctcactctgttgcccaggctggagcacagtggcacgatctcagctcactgcaacctccatctccctggttcaaatgattttcctgcctcagcctccctagcagctgggaatacaggtgtgtgccaccacgcctggctaatttttttgtatttttagtagagacagggtttcaagatgttagccaggctggtcttgaactcctgacctcacatgatcagcccctcggcctcccaaagcgctatgattacaggcatgagccacagtgcttggccccattttaaaatttctcatagagatgatgtcttgctatgttgcccacgttggcctcaaattcctagcctcaagcaatcctcctgcctcagcctcccaaagtgctgggattacaggcgtgggccactgtgcccagcctttacccctgattctctagcaatagtgaattcattgcagttgttccagtaagccagattctcaggttctcttttctttgagagactgagatcatgttttttttgtccacactgccaaccaccaaccccaccttgcctgcctagctctccctgtctatgaagacatttcctagctgcctccctcaccccccaggagacaggtgcctcctatgttcccctgtagaaacatcagcccagccccatcagagcatctgccccatgacatggaaactggtcctctgcttgtcagtctctgcaaagtcctgctggcccttgggtccccactcccagcacaatgcctaacacataaatggcactcagtaaatatttatttctcaggaaactttatcaacaattattcaaaacacttttacacacatctcaaaagagctattatgaaggtaaaatgctgttaataggcgtgaaagcaccttagaatgcggaaaacaccagaaagagaatatgtatattaaagcagaaaattggcttttctccaaagccttgacagtatataaaggagaagaagaggtgactatatctttctcctgccaatgagacagcaattcgagtggcctggagtggtcatttaagatgataaatccattcttctaccacaagtgtgtgttgatacgcatctacttaaatagtgcagggaacaaggccatatggaaaatattaagatgaagaacaggatggaggagagaagccgtgggcaccaacagattaagataaagtgtggaggactgaggcagctgtggtggctcatgcccgtagtcccagctacttgggaggccaaagtggaaggcttgcttgaggccaggagttcaagaccaccctgggcaacataacgagatcccgttcctgcaaaaaattaaaaacagcagctgggtgtagtggtgcgtgcctgtagtcccagctactcaagaggttgaggaaggaggattgcttgagcccaggagtttgaggctgcagtgagctgtggtcacaccactgcactctaaactggatgacagggcaagactttatctccaaataataaattatggaggactgagtcacgaaagccatgcaaaaggcatttatgacaagctaaagaggaaggcactttctcctattagaggaatcgaagaagactttctggggattagaagaagctggacaggtattgatgagctttgaatgtgaaggcaggaaggatgcagggatcctacaggggccgagccgacaagagcatggtggggcttggttttagaaaaaagaattcagcagattgtgcaagagggaacagcccggcacctggggcgtccgtatggccgtacttgtaatagtccaggaatgagttgagatcgctagcgatctacactagctttcttgggtcatgaaagtaatgcagccatggcttccttgggtcacggaagtgatgcagagattgagcatttggaggaccgatcaaatcagcttttatgtgccgctagcctcaaaaagggagcattgccgcctggccaagggacaagcctatgtgggccccttcccctcacccagagccgagtccttgtggcagagcagctccttctctgctgacatgcacgccttccctggaccaactgtggagttattatcatattaataccaacatcttcctcaggcaaggaggtgaggggggtgcacttgggaaaggcagaaatgactgggagccactgagccgctgttgaggcgtcagggtggagccaagaatgggaggaccctaagcatgaaagtttcatgatttaggaagatcctgccaggtgacctgtggtatcttcaatttagcagttgcaggtcgcatatccaattcaacagatcagtgatttgatagagatgcaagaaggaagctgctgggcagactcttcatttttcatacttcagctagcaactgtttctcttgaagatgtcccagaaagcagactcactcacatcctggggtggtcctgcctggttctccctccaccatcagcagccgcatctgttggtttgggcaagtgatggattggttgggtctgactcccaggaggggaatggaaaaaaaaaaaggctgcagcagtttgacaaactagagcacagaaaaagtgcaagacatcagaagatccaccattctgcaagtcgcttgcatgatttcaaagtcaaagactttgatttcaaatcctggctcagggtgagccaaccagaaccagccactgagccatagatgccaggtttctggctgtgatcagttttgtcttagtagggtatgtgacatctgccaatccaaaaagtatatttagagatgctatagcagaccagactcctcactgagttcttgcagaagctggaaaaacttgtttctgttattcgttttttgttgttgttgttgttttgtttttgtttgtttgttattgagatggagtactgctctgttgcccaggctggaatgcagtggcatgatctcgactcactgcaacctccgcctcctgggttcaagcgattctcttgcctcagcctcccaagtagctgggattacgggcacgcaccatcatgcccagctaatttttgtatttttagtagagacggggtttcaccatgttggccaggctagtcttgaactcctgaccttaggtgatgcagctgcctcggcctcccaaagtgctgggattacaggcatgagccatgcgcccggccgtttctgctattctttactgtaagtaaaagcatttctttactgagagtgttttctggagagtacatggtgttagagagctctttgatcaaagtcccttatgccatataaaaagaaaagggtgttgtgccctagaggcagctatgctgtcatcttttgactgagtaattaaactgatatttactaagagcctactatgtgtccagcaggtttcaggcactggccgtgaatgagagagatggggcagacaggcaataaatgaacaaacaaggaaatgtcatttatggataaatgttatggtagaaataaaacggggatagacgggggcctattcaggaatgcctggttagggcaggcttctcagagagggtgaaatggctaggaaaggaatgacagggtggagccggctttatgaagaactctgggaatggcattctgtgcagaaggaacagtagatacaaagtcctaaggtgggagcagcttggcatgttcccagagcattaagaaagccagtctggctggagcagactgagggagactggctggtgccagatgtgcagtgggctgatcaggtaggagtatggacgtgattccctgtgtggtctgaagcagctttaagtttaaagaggtgtgttctgactggatttacagtttcaaagtctgactcgggtggctctgtggatcgggggtgttagggacaaaagaaggacttgactactctgggtcagggaggaactcagtatgagctgtttggggccagagtggtggggagaggatcagttcgggctatgcttgcaagtctttaagaggaccgtggtgatggattggtcataggaatggggtgttgaaggaagacacagaatcaaagatgatgcctaggttttttggcaagtactctgcaatatccaaaaatgcgtggtagtgattgtcggagacctagatcctattctcaacccttccatgtatctgtgggtgaccttgaatgagtccctctgcctcagtttcctcacctgtaaaatgatggagttggaacagattacatgaaagacccctttccgccctgcccatacttgtgctgtggctaaaacaactgtgagcaattctcctcccataaggggctcactctccaggtgttaccaggggagggtgtccaggttcttggcatctcgaacaaagaattggacaaaatgcacaaatgaagcaaggaaggaatgaagcaacaaaagcagagatttattaaaaatcaaagtggccaggcacggtggctcacacctgtaatcccaacactttgggaggctgaggcaggcagatcatgaggtcaggagattgagaccatcctggctaacacagtgaaaccccgtctctactaaaaatacaaaaaaattagccaggcgtagtggcaggcgcctgtagtcccagctactcgggaggctgaggcaggagaatggcgtgaacccgggaggcggagcttgcagtgagccaagatcgtgccactgcactccagcctgggcgacaaagcgagactccatctcaaaaaaaaaagaaagtacactccacaggttgggagcaggcccaggcataggggctcgagagccctgttacagaattttttggggtttaaataccctctaaggctgggtttggtggctcatgcctgtaagctcagcactttgggaggccggggtgggtgaatcacttgaggtcaggagttcgagatcaccctggccaacatggtgaaaccccatctctactacaaacaaaaattagccaggcacagtgatgcatgcctgtaatcccagctactcaggaggctgaggcaggagaatcgcttgaacctcagggagaggttgcagtgagctgagatcacaccactgcactccagtctgggcaacagagtgagactccatctcaaacaaacaaacaaaaaaccctctcgaggtttccattggttacttggtatacgccttatgtaaatgaagaggatgaagtaaagttacagtcacttactcgacgtacaccctttgtaaatggagaggatagttctgtcatagctgaagtgtttccatttgatttagctctaggaagtccttatgttccctgtctccaaaccctattctcctgcctcatagcctgtcagggattcgcttccttactctgaatgtccacaatatttatggccattctttcagtccagaccgcactgtcatagtgacaaactggcagcatggaaaacaaattcttttttttttttttttttttttttttttaagagacagagtcttgctgtgtgactcaggctggagtgcagtggtgccatcacagctcactgcagcctggaactcctgggctcaagtgatcctcccaccttagcctcccaagtaactgggactacaggcacatgctaccatgcctggctattttttaaatttgtttgtaaagacagggtctcactatgttgcccaggctggtgtggaactcctgggttcaagcagtcatcccatcttggcctccaaaaacattgggattgcatgcatgagccactgcacctggctgaaaacaaattattattttttttttttttgagacagagtctctctctgtcacccaggctggagtgcagtggcatgatcttggctcactgcaatctctacctcctgtgttcaagcgattctcatgcctcagcctcccaagtagctaggattacaggcaatgcaccaccatgcctggctaattttttatttttagtagagacggggatctcaccgtgttggccaggctagtctggaattcctgacctcaggtgatccgcccgcctcagcctcccaaagtgctgggattacaggcataagccaatcgtgcccggcctgaaaccaaattctaatggagctcagtgtcacatgtatgatgactctctcttagaaggccatggcttccttgggtcatgggagtaatagagaaactgagcatttggaagacccatcaaatcagcttttatttgctgatttgatttgctgatcaaaaagggacctttgctgcctgggcaagggaagagactatgtggtcctcttcccccccactcagaacagagtccttgtggtggtgcggctccttctctgctgacatccacaccttccccagaccgattgtgagtcctcataatacaaacatcttcctcaggggtgctggctcaaggtaccttttccctgcatgcactatcgccctttcgatgagaagtctggcagataattatcacctgaacaaaatctgggcatcagtcccccaaaaatgcactgcccctctgtggatcttcctacatacctgcctccctggaaaagagaagaaaaaagcatgtccacatctttcttttttttttttttgagacggagtcttgctctgtcgcccaggctggagtgcagtgcaactagctcactgcaacctctgcctcccaggttcaagtaattctccttcctcagcctcccgagtagctgggattataggcaccaaccaccacaactggctagttttgtatttttaatagaggcagggtttcaccatgttggccaggctggtctcgaactcctgacctcaggtgatccacctgcctggggctctcaaagtgctgggattacaggtgtgagcctccatgcccggcagcaatttttaaaaattgtaactgcattatgagaacagtatttcaaggtgacccatttatgtggagatttttagaagaagaaaaaacctccagtataattttcttcacttttaagcccagtgatattttcagaaattcaagacataccatagcataggaaaagggtgtgtctagagagtctctggcttccatgtctgatctcattctcactatcagtatcatatcttcattgtactggattttaactcaaactgaaagatgccctctgattctctgtccatttctgtaaaattgccttagttcatgatgtggttgcattgcctgagataatgtacataaaactcccactggcggggcgcagtggctcaagcctgtaatctcggcagttcgggaggccgaggtgggcagatcgcctgaggtcaggagtttgagaccagcctgggcaacatgatgaaaccccgtctctactaaaaatacaaaaattagccaggcgtggtggtgggtgcctgtaatcctagctactcgggaggctgtggcacgagaatggcttgaacctgggagtcagaggttgcattgagccgaaatcacgccacttcactccagcctaggtggcagagcgagactctgtctcaaaaaaacaaacaacaacaacaacaaaaacacaactcccaccaaacgtggcttctgcatggtggttcatgcctataatcctagtgctttgggtcaaggtaggaagattgcttgagcccaggagttcatgagaagcctgggcaacacagcaactcacctaaagtttcaggtgactgaaaaacagcagtttccttgccatcactcacggcaccgaattcaaagtcaggaaatcctgattccagaccgtgtcaggtaccatccaatgccttacagtttattttccatctcaaggaggaaaaaaggccttttcatgcttgcctcatgacagatgtgggaaaatgatgtatgtgtatgtaacgttcttggctgtctaggcatggtggctcacacctgtaatctgagcatttttagaggcaaacgcaggaggattgcttgagcccaggagttcaagaccggcctaggcaatacagcaagactttgtctattaaaaagaaattagctgagtctgttggcgtgcacctgtagtcctagctactcgagaggctgaggcaggaggatcacttgagccccggaggtcaaggctgcagtgagctatgattgcaccactgcactccactctgggtgacagagcaagaccctgtctcaaaaaaaaaaaaaaaaaagaaagaaagaaatggaacccgctagatgtaaggcaacataaatttaggctaccattattattgtcactatttctataagaattagatttttttactcagggtcttgggaaacagacaaaaatagaaatgtatgaagatattctgatttccctcctttggagaaactttttttcttgttatgttcttcagctaattaaaacaaaatgagcccaacatctaccatttccctaagatccacaatttccaaaaatccttttggaacttgaattgcctagctaatccacaaagtctgcatttgagcttccaccagatgcagtccctaaagcggccctcaccccatgcctctgctgagcagaattccgttcatggggaagtccttcagaagcctgcccaggtcgtctctgccctaacttctctgaactctggagcagcggtccccaacctttttggcaccagggacctgttttgtggaagacagtttttccacagaccagtgaggaaggatggttttcagataatgcaaccacattacatttattatgtactttatttctattattattacattgtaatatataatgaaataattacacaacgtgtaattacacatcatgtagaatcagtggaagccctgagcctgttttcctgcagctagacgatctcctctgggggtgatgggagacagtgacagatcatcaggcattagattctcacaaggagtgcacaatctagatccctcgcgtgtgcagtttacaatagggtttgagcacctatgagaatctaatgctgctgctgatctgacaggaggtagagttcaggcggcaatgtttgctcacctgccactcacctcctgctgtgtagcctggttcctaacaggccacagactggtgctggtccacagcctgggcgatgaggagccctgctctcgagcactggcactctgcaatgcctatttcattctcattgggttgtgccttgtgttggtacttaactgcgttgttttgtgtatcttgttgacttaatgtcttagcccattttgtgttgctataaaggaatacccaaaactgggtcatttagaaagaaaagaggtttacttggctcctggttcctgcaggctgtacaagaatcatggcacccacatctgattggcttctggtgaggccttgggaagcttttattcatggtggaagggaagggggagcaggtacatcacatggtgagagagaaagcaagagatgccatgctcttttaaacagccagctctcctttgagctaatagagtgagaacctacttattactgtggggagggcctcaagacattcatgagggatccgcccctatgacccatgcccctcccaccagaccccacttccagtattggggatcacatttcaaaatgagatttggagggtacaaacatccaaactatatcacttagctagatttcagtgtagtcacctctagggaaagacgtacatgtgttttctcctgcctcctaactcttcttcaaggatgctgggagactggtaccacattggtagccaatttcttcatgagcacaaattcaaagattagacagagggtagcaattgtttgtaaacataacagattcttgacttcggatgtattaattcactgatttataattagtaattgactcattaagcattttgatagcaattagttttttaaagaacagcttagacacaataggtaaattattacataaattcagaaatgttttctttctttttttttttttttttttttttgggatggagttttactcttattgcccaggctggagtgcaatggcacgatttcggctcactgcaacctctgcctcccaggttcaagcgattctcctgcctcagcctcccaagtagctgggattacaggcatgtgccaccatgcccggctaattttgcatttttagtaaagacagggtttcaccatgttgaccaggttggtttcaaacctctgacctcagatgatccacccacctcagcctcccaaagtgctgggattacaggtgtgagccaccacgcccagccattgttttcttatttttttgttttttaaaatagagatggggtcccaccatgttgcccaagttgatcttgaactcctgggctcaagtgatccacctacctcggcctcccagagggctcggattacaggcttgagccactgcaccctgcctagcagcattgtttaacactacaaaaaccatataaccactgagctccttctcagaaggaagatggcgaaagctcactgctcaacagtgactagattcataacctggggctttggtctgtttgttttaggcttaactcttgcagatttggggaatgtcaggttccaaaacttgagttcattattcctgtcaattcagggcacacccttaccataagcccatgaaagacaccttgttgggttattttattattttttctttatctccatgctcactccccattttcatcctgcctatacatagatgtctttgaaaataaatattattgccgactccaatttaattttccaaggtcctgttccaagcacttttatacacattctcttctttcatcctcccaacagcactatgagaaacattgttttggcctggcctggtggctcactcctgtaatcccaacactttgggagtccgaggtgggtgaatgacctgagttcatgagttcaagatcaacctggccaacatggtgaagcccccatctctattaaaaataaaaaaaattagcccatgtgataacacatgcctgtagtctcagctactcgggaggctgaggcacgagaatgacttgaaccccagaggcagaggttgccatgagctgatatcgtgccactgtgctccagcctgggtgacagagtgagatcctgtctcaaaaaaagaaaaattcttttgttgttcccatttaacagaagaggaaacagaggcatggatatgtgaagtaattttcccaagatcatgcatttagcatatggcagcgtgaggactcgaatccaggctacataaaacctgagctctagcactctgcagtactgtatctactctatattttaaaatatactgtgttgtttcgcgtgtgtgttttaaaatgtatttgaatgttattgtgcaactactgtgaaaccagaaaatgtgagacaggtctcagttaatttagaaagtttattttgccaaggttgaggatgcacccgtgacacagcctcaggaggtcctggcgacatgtgcccgaggtggttggggcatagcttgcttttatccatttagggagacatgagacaccaatcaatttatgtaagaagtacattggttcggtctggaaaggtgagacaacttgaatcaaaggcggaagattggaacgggggaagggacttccaggtcacagacaagtgatacacaaacggttacattcttttgagtttctgattagcccttccaaaggaggcaaatcagatatgcgtctatctcagtgggcagagaggggtgactttgaatagaatgggaggcaggtttgccctaagcagttcccggctttaggtttccttagtgatattagtggcccaagatattttcctttcgtactacagatacccttctatatcataccttcttcattctacattatgcttttaagatctaatcacctgctaaagatatcactagttgatggatcgccacagagcattccatcacatccatccatctcagcttactctttctttttaatttgaagcacaaatgctttaaaggcgcatctcaattcccgtgtggcgggcaaaaaataaaatataggagcagatcgtggcacaccattcccaccagccaagtggtcaaaccccacatccaagacccagtgagcagccaagttcagcgcaacttccaggcctcttgctctgactccaacagggtgagcacgtccccctcacacacggggccttttacactgcggatgctggagcggctcgtgttgtccataaattccacgcgcacctgcgtgcagtgtccctgagagccggtcctgcccaggacctcggtgaccctggccagcttgataggctgcacgtggctggtgtccatgacggcggcgtggcggtctggcagagtcagttgactgttctgttttttgtttttcgtttttgagacagagacttgctctgtctcccaggctggagtgcaatgatgtgatctgggctcactgcaaccttggcctcctgggttcaagcaattcttctgcctcagcctccgagtagctgggactacaggtgtgcaccaccacgcccggctactttttgtatttttagtagagacagggtttcactatgttggccaggctggtctggaactcctgacctcagatgatctgcctacctcagcctcccaaagtgctgggattacaggcgtgagctaccgggcccagcccagttgacttttttatgtccctaatgaggggcagtcagaatgtctcccaatccctaatccccaaacattctaataaacattctcactcatggccccttacatacctgtgtgaatttctctagaatatatcatttggaatgggattgctggcatataaagtacacactgcctgttagattgatttctggcatgatgatgctaactaaccctcttcccagcagcacaaaagattcttttttctctaatttctcatgaacatttatctgactttataatttttaccaatttgatggttgtcaagtgtataccattgttgcttttcatttgcatttctctaagcatgaatgaaattgaacctctcttcataaacttggaggctgttgggtttacctttctgtgaatttcttattcatatattttgttcatttttgatactgggtctgctgtcttgttatctaggtaccatcaattttagaggcttcaaatattgccttctcagtcttccccccgtcagttaacttcatttatggtgtccttattgaacagaaattcttttttttttttttgagatgcagtctcactctgtcgcccaggctggagtggagtggtgtgatccaggctcactgcaacctccgcctcccgggttcaagcaattctccctgcctcagcctcccaagtagctgggattacaggcacctgccaccacacccagctaatttttgtattttttttagtagagatgggttttcaccatgttggccaggctggttttgagctcttgacctcaggtgatccgcccaccttggcctcccaaagtgctgggattacagtcgtgagccaccatgcctggccagaaattcataatattgatataattatatccactgattttggggggcttttattaaaccttggagtcttgtttggaaaataatttccttagacatcgactggatatagtggagtaatttgtataaaactaagcttctataacaaagaactataggctgggtgcagtggctcacgcctgtaatctcagcaccttgggaggctgaagcgggtggattgcctagctcaggagtttgagatcagcctgggcaccatggcaaaatcctgtctctaccaaaattacaaaaaattatctggacgtggtggtctgtgtctgtggtttcagctactcgggaggctgaggtgggaggatcgcaggatcgcttgagccctggaggtggaggttgcaatgagctgagatcatgccactacaccaacccggcctgggtgacagattgaggccccctctgaaaaaacaaacaaacaaaaaacagaagaagaactataaaaactgaatagcaaacaacagaacagctgtttcatggtattggaaagtaaacaagacaactaagacttgagggtccaaaaagtcagagagaagagtgcattgacataagcctgatattttccacagcattttactctcaggaaatttgctgtaacaagtataaaggtggaagagaaagcagtggcattgagatcgtggtactcactgggatgagtctacaggattggagttaatggctagtaagtcagcctgaacttgaagggctccatcccagaagaacagattgcatgaaatttcacctcaaggcattcaccaactcataaactgtaaaatacaagttcaatacatctttgtttctaggtgctcaaagcataaaaaattaatcagatttttgtcagtctcacagtgctgaggagaaaaaaagtggagatcagagcctggaaaaagggaggaaccctggtaaacttccaggtttccagttgagacccttgaagggatatacctttgaagagagggaaaactgcaaaacaacaacaataacaaaggtttaggaggggacacagtttttgtgcagcctctataagctggctgaaactggcttaaggtccgcagttgcttatgttgtttgtaaggcgtatcctctgtccattggagttgatatggtctgggttgtaaatcagctggtaacttccctggtagctcccattgttagggagtttggcaagagtatggatttcctagtagcctgaggaatttagaaatgcaccatgccagccaggccctgacctctacccctaggtatcctctgtgtccttaatgttagggtctgtcttagttgatataaagaggtgtctcagatcacagtgtgaatcccaatcccagctccaccacttccaagcagtgtatttaggcaaattacctttgtttcttgcctcattttcctgtctagggaatgtggggtggagaggatgatcataactaccatccgtaaactttttttttttttttgagacaacatcttgctctataacccaggctgaagtgcaatggcacgatcttggcttgctgcaacctctgcctcccaggttcaagtaactctcctgcctcagcctcccaagtagctgtgattacaggtgcccgccaccatgcctggccaactttttttttttttttttttgtatttttagtagaggtggggtttcaccatgttgcccaggctggtctggaactcctagtatcaagtgacccatccacctcggcctcccaaactgctgggattacaggcatgagccaccacgcccggccacatccatacacattaagtgtattgagactgtggtcactgctgtactttggcacatgttaaacacggaataagtagtatccagtatcgcaaaagatatgacctagtattcctaattcctgacctgattttcccttgcctatcattgtgttgcaagaagcttaaaatgcatgctgtctttagtctgccctcttattcttttattagaacattgctgaaaagctttggtttccttgtgtcttgttttcttccaggactccattttggattcattcattcattcattcaatcattcaatcatcctgatgactgaatgcattgaattgatgatgaaggcattgacaagcattgatttagtgcagatgtttgtccgtctcctgctctttcaagcctcatggccccctcctgctatcccaccatggcgctctctgttctcagtgagtctgtggggtctgtgtgtggtttttttgttcatttgtttgttttttcagacagagtttcgttctatcgcccaggctggagtggcgccatctcggctcactgcaacctctgccttccagtttcaagtgattctcctgcctcaggctcccgagtagctgtgactataggtgcctgccaccacgcccagctaatttttgtatttttagtagagacggggtttcaccatgttggccaggctggtctcgaactcctgacctcgtgatctgcccacctcagcctcccaaaatgctgggattacaggcatgagccaccgtgcccggccctgtgtacgtttttataatgctcctctcagttcttctttcccccgccccactctcagacacacattatggctataatgtcctttatgggaatctcttggaagccccattaactgacctttccctgatcttcctactgacttcactttattcatttgttgatttatttacccaatgttttttgagcaccttctgtgttccaggtatgatttcagtcactggggatagagcaccaaataagcaaaaaaaagtctgtcgtcattgtatcacaactttctcactgtctttctgggcagggtaggcacagctatgtgtccctatctggaaatgatggctatggaatgaaatttccaccccagggaagaatgcagcccccatctgtatgatatttcctgattatctctgtgccaatctctctgatactcttgggaacttgcccattctttggtaaactctttctctttctacaagccccaacccagatgttgcgtaaaacgtcagtctttccctaaccctcccaagggacctccctgagtgctgcataaatatctgtgttgaataaatagtgacagagataaaaatgatgtggttctggaaaagggcagtcagattggtgaaagcacaggctgcatttcacttgggtgctgcgtgatggaacatagattgctttttttatttttccttaaacagaccaggtaggaagaaggtatggctacagccttcaaatatttaaagagttggcaggtgcagtggctcatgcctgtaatcccatcagtttgggaggctgaggtgggaggactgcttgagcccagtagtttgagatcagcctggcaacacagcgagaccctatctctacaaaaacattttaaaattagctggatgtaatggtacacacttgtagccctaacagcttaagaggctgaggtgggaggatcccttgagcctaggaatgtgaggcttcagtgagctatgattgcaccaccggactcccgtctggtccacagggaaagttttatacatatatacctgcatatatacacgtgaaattatacatctatatatatatatattagatgtatatacatatacatacatatttatatgtgtctgtatatgtaaatacatatatacatatttatatgtgtatctacatatatacacacatataaatacgtatggggtttttttttggtgttgttttgttttgagacaaagtttcactcttgttgcccaggctggagtgcaatggtacgatctcagctcactgcaacctctgtctcccgggttcaagcaattctcctgttcaagcagcctcccaaggagctgggtttacaggcatgcaccaccatgcccagctacttttgtatttttagtagagacagggtttcctacgtgtgatatatagattagaaagatagatatttaaagagctgcctaattgtattagtccattttcatgctgtggatacagacatacctgagactgggaagaaaaagaggtttaattggacttacagttccacatggctggggaggcctcagaatcatggctggagatgaaaggcacttcttatatggtggcagcaagagaaaatgagggagatacaaaagcagaaactcctgataaaaccatcagatctcatgagacttactcactaccacgagaacagtatgggggaaactgcctccatggttcaaattgtctccctccaggctctccgataacacatgggaattatgggagctacaattcaagatgagatttgggtggggacacagagccagaccatatgactaatggagtttggaagtggggatcaaattgaaaaaagctttcaggagagtagataacaggggttggggaagaataccttagaaacaagggcagttcagcagatgagacccaaatacccaccttccagcctttgctgcagccccataccagacaaatggaatcttcacgccctagagctcagtgtccatgttgacctcccccagaatttcccaggggcctagaagatggttccagtatcatcagtggcccttccagcttggtgtacagtgccagaggagtgaagcaaggctctacgctcatctttttttttttttttttttttgagactgagtctcgctcagtcgcccaggcgcctgccactacacccagctaattttttgtatttttagtagagatggggtttcaccttgttagccagcatggtctcaatctcctgacctcgtgatccacccgtctcagcctcccaaagtgctgggattgcaggcgtgagccaccgcgcccagtccactcatctatttttaagcagtagatttatgtagccatgccgaagaggccctgagaagctgtttattatgaaatcaaacttgtggtttctggaaacttttttctaactcagcaggtgatgccattagagttctgacat

SEQ ID NO: 541 - DNA, 762 bp, Homo sapiens
taccattcttcaagaaacggtttgaatcagactgcctttccttttgtcttcattgtcataaacatctgcccccgtgtggttctgactggccgcgaacccctacccgaagcttttattccatcattgtgcaccgttggtggggaatgctgtggcaacaggccacgcctccacttactggttggctttgcgcaggcgccaacggaagtgggtcgcaggaagaggaagtcccgcctctctctcctcaggcagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctaaaaaaaaaaaaaaaaa

SEQ ID NO: 542 - DNA, 860 bp, Homo sapiens
atggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaagcgcattgaacagtcctgggcactacatgtaaattaagcccaaagatggggagaaaggaaaaggagagacaaatatagtccatactgag

SEQ ID NO: 543 - DNA, 3885 bp, Homo sapiens
gattgcctcatccgggtcttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggagacggagggaacagagaccactggaaggagtcagataggaaagatggcaaaaaggatcaagactccagatctgcacctgagccaaagaaacctgaggaaaatccagcttctaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttaaaaacaaaaaatgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctccatttagcagaaatggtaatgacagtgatataatgcctggaacctggttgggcagtaggggagggaggtagaaggaaaagtgtgagatttctaccttttagtttttatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattccttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcatcatcttaagttcttcatgctactcttaacctcccaaaaagcagtatctaagtcacatacatgatgtcttgggcattttctcagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgtttttttaagcttcccttgagagaataaatggtaatggagagaactatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttcaaaaaaaaaaaaaaaaaaa

SEQ ID NO: 544 - DNA, 553 bp, Homo sapiens
gggcgagcatctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagagaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactct

SEQ ID NO: 545 - DNA, 618 bp, Homo sapiens
cttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggt

SEQ ID NO: 546 - DNA, 599 bp, Homo sapiens
ttttttttagttgcagagatctacaatttattattattttcagtgttagagctagagggtaattttttcaaagatggcactcaactccacttatttacctgtcaacaaatacagaactgaactgttagccataagcactttacaaacagactcaggaaactatgcagtagacaatgacatagcttaaccagactctgaaaaagagatacatattttgattcacacttgtacaaagagaacagtcatgtctgcatgacttaaggttccctaaacacaactgttttatgttttagacccctggagtgtgccagtttaccacatcagggaggaatcaagggatgtgtgtgctccttctaaagaaccaagggcaagtggggtgggggtggctacagggaacgctctgggcaaaagagctgcctcaggtttttgtgggaatgaaaattacttgttgcagttaagcaattcctagggtttatctagtttgaggttcaaaacaaaggagagaattatttccttcctcgagctcttcccaaagcaatatgcacatctcataatcaaatctcagtagtacaaagagataatcaattatctaaaaattt

SEQ ID NO: 547 - DNA, 885 bp, Homo sapiens
  misc_feature 621, 628, 757, 760, 764, 786, 799, 806, 812, 813, 821, 832: n = A,T,C or G
gcattatttaaaatggttttcttaaatttatttatttttttaaacataacacgaggaaggtgttaaaactggtgtaatagctcaatagaataagtattccagatttcgggagggatgaagagggagatattcagaacccttcaccagattccccccaacttgatcatagtggattaatggtgtgctttgtggatgtggttagtcaatgacaccagcttgacggatctttctttctgcaccaaaccccattgagttatctggtccccttggctgacgaagaaccattaggcgaggagcactggcatcatccagagtgatattcttcaagcgattgaccaaccgatcaggtcgaggagctgcaacagccttggggccctcacagactcgccaaacattacaggcgctgcacttgccagtgcgctgattaagaatcactgagaactccacctcatctcctgcctgtagctcaatgccatcctgaacttctttcacatggaaaaagagcttcttgctatctcctacttcatagttaatgaaagccaactgatctttcacacattccactgtggccctgcgcaggggtgtgatgttgtaagccatagtttgtgcattttggcccangacacancatttggaacttgacgctctcccctttctgcaggcaaatcccctttgttgccatcccaacgatgccaaatggatagacctcacctttcatatcgccctttctccacatctcaatcatttcttggtactnagnctgnggtgatcaacacttctcaaggnggcaattactttngccagantaaatnngtgatcangcttcctcatnatgccatttcaccttgggggttttgtcaccttttcttgccctacttttgtgcc

SEQ ID NO: 548 - DNA, 703 bp, Homo sapiens
aagacggggattggccatcgcttccggaagttgtgagctttgtttcggagcgggacctccccgagacgcactgggggccggatgtagaatcctgcttatctgtgaaatgcagttaacacatcagctggacctatttcccgaatgcagggtaacccttctgttatttaaagatgtaaaaaatgcgggagacttgagaagaaaggccatggaaggcaccatcgatggatcactgataaatcctacagtgattgttgatccatttcagatacttgtggcagcaaacaaagcagttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaagatatataaactctcttcacaagaagaaagtatcgggacattattggatgctatcatttgtagaatgtcaacaaaagatgttttatgaaatgtcagaaatattaacaaaaattctcagcattaaagaaaacattgattttcctttcctgactataaa

SEQ ID NO: 549 - DNA, 3939 bp, Homo sapiens
acatccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagatacatatagccctctgagtgttaataagagaaaaaatttcagatagctcacatcccagaaaataaaatctcaaaggcttttaaaacacaatagtaaagatctaccttgtactgtttatctcttaaaaatcaatgtaatacactcaccagactggtaaaaagccatatttaaatttatagtactgttggactcttggactcaaaaacacaaccacaattcattaagagttctgataaatctacttccttacagaataggtaaaagagcttcctcacagttaaacttttgctggatagaaaccctggaaatcattcttgttttacactgaaggaaacaaacctagcaaaattaagccaagtgcccaaggtaccagtgctggagaggcaagctgagattagattgtgttgtagtgtggtgttctcttcgtcacatctgctaaaatcttgggagccgatgctgaacacttccaataactgctattgtggttcttcaactaaaccttgtatatttcagaaaacatctaagatgtgtgtcagaaacaaatatgtttcttaaggatgttaagtattacacagtccacttgtgtaggtaaaagtagaatgttaagtggtagaaagctgatttggttaagttaatggacttctggcaatttagttatttcagactatgcagtgacaacacagactaatactaccagtagcctgactactactagaaactgcggcctgtgagatctgttaaaagttaagcctagaaaccaaagttccttcccaattaaagaaggaaaaacaaaacaaaacaaaacaaaaccaccacctattcaaaacaaagcagagaatttgtataatatttgatggtacctaaggtgcctaagaagcttttttgaaggtagcttttaagttctaggaagtcttttgttgaatttccttgtattggtttaaagccctaaataccatagattttatttcctctcttggaaaaaagatggaagtgacatggcagtatttcctgctgttctccagttacttcacaataccaaaataaattaaacgtactgttgcaaaactcctatgagaaatcactattcaaaaaatggtgccagcttgctgtttaatggtacaactgaagaggaaggagccttcccatttccataaaagaggcaaaggagtcatacccacatagcactactgccagtcactcttgccttcacagggtcacctctcctcacagaaagcagactggacaaatatcagggcccacctccctccaacatggaaacaagtccccctaagaaagagctgagactagtgtgctaatacctgttgtattttgtggagataaaggtgcaggagaataaactcctttataaagaagtgtctttcaggtgttctgaaaccctgccttgttacttacctttattaaaagaaccgaaataatgcctaactcaaaaaaaaaaaaaaaaaaaaa

SEQ ID NO: 550 - DNA, 1343 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctataaaaaa

SEQ ID NO: 551 - DNA, 580 bp, Homo sapiens
cttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaa

SEQ ID NO: 552 - DNA, 506 bp, Homo sapiens
ctattaatgacaactttaatatgaacatgtgcttaaccctcaagaaattgtcacaactgaaagacgggagcaagctgacactgcaaggaacacatgatgctttggaatgggtggcctgcgtattcaaacacatcaaagcagcagttacttgaacaatcggaacttcttcaaatactggcccacttcttccttggggtagggccggagagcaatacaagtggcgatattctctggttgctcaagccacagcatgtggtcaatgttcttctgttgcagggtctcggccagctcctttagggtggtctcatctggggcctcgaggaccactttgcgcatgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggct

SEQ ID NO: 553 - DNA, 1488 bp, Homo sapiens
ctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatccaaaaggaactaacaatttgtatggcagtgtcagatatttttattttagtatttcctgttttggtttatttgcatcttagaagagcataatgacattgtttgatgaagcccaattatgctggactgtttgacctggtttaacccttctgataggtagttgtggatgctggggatgagagctgaataatctttgcctggagtggcactacactctagaatttccactttggagaatactcagttscaacttgtgattcctgatagaacagactttacttttctagcccagcattgatctagaagcagaggaatcccagcgccttttaaaagttgttatgtggttttcttttaaaaagctcctgtttttggaaagtagaatttatgggtrcaacgtatgttcattatttgtacataaaataaaaccaaaaaaaaaaaaaaaaaaaaaaaaaaaaaa

SEQ ID NO: 554 - DNA, 814 bp, Homo sapiens
tacaaaagcaggctggtaccggtccggattcccgggatccggagctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggcagcgcgaccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgca

SEQ ID NO: 555 - DNA, 1487 bp, Homo sapiens
ctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaaaaaaaaaaaaaaaa

SEQ ID NO: 556 - DNA, 949 bp, Homo sapiens
gcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactataaaaaaaaaaaaaaaaaaaaaa

SEQ ID NO: 557 - DNA, 511 bp, Homo sapiens
tacaagtagaagttgtacactctaaaataatgattaaaaagtataatatagtaattacataaaccagtaacatggtcatttattataattttcaagtatgtactgtgcgtagctggatgtgctagacttatacaactggcagtacagtaggtttgtgtacaccagggtcaccacaaatgagagtcgtgttgatgttatgatggctacgatgtcactagatgacaggaatttttctgcacctctatcatctcatgggactgtggtacatgcggcccatcgttactgaaatgtgatgaagtgcatgactctagtcttcacagatacggaggctctaaggacagatatcaaatacattagactgggcacctatgggggaacaggaatagggaatgaaggagagaaaagagtaaaataaaaaacaaacatgcaaaactgtacataactggcatggattaatggtgataatgtaccaggcactgagaaatatgacagaaaaatatgagaattaagg

SEQ ID NO: 558 - DNA, 1313 bp, Homo sapiens
ccaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataattttttaaataaaatgttatataataaaagtgtcttctatgctttt

SEQ ID NO: 559 - DNA, 977 bp, Homo sapiens
tcttttacctgagatgtagacttcagcccaggttttttcacaaccaaactaaaaatgaacttactacatgggaacatcaatgcaacaagtagaatttgtaaactcaagccacaaacttagttaataatcatggttaagggacattgccaaagagcaactgatgcctcagtgaagtttgaaagaaactctgctttctgtgacggcagagaagaaatatgcaagcaattctgcttcaaagaaatttgcatagaaatggaaaaatgccagagcctttaacacaagtgaaattgcaaagcctcaacacgttcaactcaatccacagagcaccaaatgtttaatgggagccaaggtaggactgagcattgaacttccagctatgcaactcgcagggcacaatttcaagtgtggaaaccatctgtaggcaagctcttttaaaaacatgaattttagacaccgtaaattctaatgcagacacttttgcattactgtttgaatttcagaagggcaccacaaggcaccagagtctttcaaagtcactcacagcaacaattgcatttttttcccagccttggtagcccctttcagttgtctagcctctgcactgtggcacaccactgacattaaatccagtcatggcctaagtggcatgaggcagctatttccagggcacctcccacctccttggcctggtgaggcttccccagtcagctccctccttcgtgtcccctctttcaagaccctccagagctctgggctccagggccccattgctgggccccacgggagaccccatctgaaccctttccacaggtcctctgctgagaccaaagtgcggttgttcacagacctgtaactttcttcccgtccttctgtaccttgtgatttgacctggatttcagtcgtccccaaccttttggcgcccgaggcagtctctcctggagagagtcgccaatgttgttcacattgtctatagttac

SEQ ID NO: 560 - DNA, 2682 bp, Homo sapiens
ccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaatctcgtgctcaccggtttctcccacatcgacctgattgatctggatactattgatgtaagcaacctcaacagacagtttttgtttcaaaagaaacatgttggaagatcaaaggcacaggttgccaaggaaagtgtactgcagttttacccgaaagctaatatcgttgcctaccatgacagcatcatgaaccctgactataatgtggaatttttccgacagtttatactggttatgaatgctttagataacagagctgcccgaaaccatgttaatagaatgtgcctggcagctgatgttcctcttattgaaagtggaacagctgggtatcttggacaagtaactactatcaaaaagggtgtgaccgagtgttatgagtgtcatcctaagccgacccagagaacctttcctggctgtacaattcgtaacacaccttcagaacctatacattgcatcgtttgggcaaagtacttgttcaaccagttgtttggggaagaagatgctgatcaagaagtatctcctgacagagctgaccctgaagctgcctgggaaccaacggaagccgaagccagagctagagcatctaatgaagatggtgacattaaacgtatttctactaaggaatgggctaaatcaactggatatgatccagttaaactttttaccaagctttttaaagatgacatcaggtatctgttgacaatggacaaactatggcggaaaaggaaacctccagttccgttggactgggctgaagtacaaagtcaaggagaagaaacgaatgcatcagatcaacagaatgaaccccagttaggcctgaaagaccagcaggttctagatgtaaagagctatgcacgtcttttttcaaagagcatcgagactttgagagttcatttagcagaaaagggggatggagctgagctcatatgggataaggatgacccatctgcaatggattttgtcacctctgctgcaaacctcaggatgcatattttcagtatgaatatgaagagtagatttgatatcaaatcaatggcagggaacattattcctgctattgctactactaatgcagtaattgctgggttgatagtattggaaggattgaagattttatcaggaaaaatagaccagtgcagaacaatttttttgaataaacaaccaaacccaagaaagaagcttcttgtgccttgtgcactggatcctcccaaccccaattgttatgtatgtgccagcaagccagaggtgactgtgcggctgaatgtccataaagtgactgttctcaccttacaagacaagatagtgaaagaaaaatttgctatggtagcaccagatgtccaaattgaagatgggaaaggaacaatcctaatatcttccgaagagggagagacggaagctaataatcacaagaagttgtcagaatttggaattagaaatggcagccggcttcaagcagatgacttcctccaggactatactttattgatcaacatccttcatagtgaagacctaggaaaggacgttgaatttgaagttgttggtgatgccccggaaaaagtggggcccaaacaagctgaagatgctgccaaaagcataaccaatggcagtgatgatggagctcagccctccacctccacagctcaagagcaagatgacgttctcatagttgattcagatgaagaagattcttcaaataatgccgacgtcagtgaagaagagagaagccgcaagaggaaattagatgagaaagagaatctcagtgcaaagaggtcacgtatagaacagaaggaagagcttgatgatgtcatagcattagattgaacagaaatgcctctaaacagaaccctcttactatttagtttatctgggcagaaccagattgttatgtcctttgttccaaagggaaaaaattgacagcagtgacttgaaaatgattctgctccctttgaaagcattcattttgctagaactgttagacacattgcagtatgctgtattgaaagtaggaatatagttttaaaaaccctttgaacaaagtgtgtgcataaccagtcatgagataaaacaacacaatgcatgttgcctttttaatgtaaatacccgtaggtatcattaatagtttcaaaatattgtggtttagtaaagttgatacctggttataaatattatgcctttatttttggctagaagaagaattatttttagcctagatctaaccattttcatactcttaactgattgaaacagattcaaagaagtatcgagtgctatgcattgaaacttgtttttaaatgttagatggcactatgtatattaatgtaaaacaatgttaatttactcaagttttcagtttgtaccgcctggtatgtctgtgtaagaagccaatttttgtgtattgttacagtttcaggttatttatattcgatgttttgtaaaactcaaataacgactatacttatggaccaaataaatggcatctgcattcttgttacaaaaaaaaaaaaaaaaaa

SEQ ID NO: 561 - DNA, 1712 bp, Homo sapiens
cgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaaaaaaaaaaaaaaaaaaa

SEQ ID NO: 562 - DNA, 1851 bp, Homo sapiens
tccccccggcggccccgcgcgcagctcccggctccctcccccttcggatgtggcttgagctgtaggcgcggagggccggagacgctgcagacccgcgacccggagcagctcggaggcggtgaataatagctcttcaagtctgcaataaaaaatggcctccaacaaaactacattgcaaaaaatgggaaaaaaacagaatggaaagagtaaaaaagttgaagaggcagagcctgaagaatttgtcgtggaaaaagtactagatcgacgtgtagtgaatgggaaagtggaatatttcctgaagtggaagggatttacagatgctgacaatacttgggaacctgaagaaaatttagattgtccagaattgattgaagcgtttcttaactctcagaaagctggcaaagaaaaagatggtacaaaaagaaaatctttatctgacagtgaatctgatgacagcaaatcaaagaagaaaagagatgctgctgacaaaccaagaggatttgccagaggtcttgatcctgaaagaataattggtgccacagacagcagtggagaattgatgtttctcatgaaatggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaa

SEQ ID NO: 563 - DNA, 214 bp, Homo sapiens
  misc_feature 212: n = A,T,C or G
cgtgacgatcctcatgaatgactatcctaaatttaagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacaccgtgttggtgcttctggggaacacacngg

SEQ ID NO: 564 - DNA, 764 bp, Homo sapiens
  misc_feature 639: n = A,T,C or G
gactttttaaagaagtaagcctttatttccttgttttgcaaataaaactggctaagttggttgctttttggtgattagtcaaagagaccaaatcccatatcctcgtccgactcctccgactcttccttggcttcaaccttagctggggctgcagcagcacgaggagcagctgtggtggcagcagcacaggggcagcagcacaaaggcagatggatcagccaagaaggccttgaccttttcagcaagtgggaaggtgtaatccgtctccacagacaaggccaggactcgtttgtacccgttgatgatagaatggggtactgatgcaacagttgggtagccaatctgcagacagacactggcaacattgcggacacccaggatttcaatggtgcccctggagattttagtggtgatacctaaagcctggaaaaaggaggtcttctcgggcccgagaccagtgttctgggctggcacagtgacttcacatggggcaatggcaccagcacgggcagcagctggcaccttattggccagcaacatgtccctgatctcagtgaggtcctccttggtgaacacaaagcccacattcccccggatatgaggcagcagtttctccagagctgggttgttttccaggtngcctcggatgggcttgcgcatcatggtgttcttgccccatcagcacacagcctttccgcgaaaggacatgcggatctgctgcatctgcttggaagccacattgtctgctccacaatgaaacattt

SEQ ID NO: 565 - DNA, 626 bp, Homo sapiens
  misc_feature 509, 563, 614: n = A,T,C or G
ttttttttttttttttttggcattatggaacctttatttttcatgtgatttctgtacataaggagtatgagagtaacccttttacaaatggaactaatttactagaacaatgacaaaactgaactggtatttgatgtgaatccacaggagtttaagcttcaaatccagccaagaaatttgttacaatctctttcagctttgcatctgattgttctgagatcttttcatcagccctgatagtgcccaacaaggcttggtgctggctgacgacatgagacaagaaagcattctcaaactttgtaatcttgctgggctccagtttatcaagatatccccttacacccgcatagataacagccacttgttcttcaatagccatgggagaatactgtccttgcttcagcaactcagttagacgcacgccacgactcaaaagttgttgagtggcagcatcgaggtcagaaccgaactgggcaaaagcaagaaccctacgatactgggcgcaatancagcgtttatgtacctgctaccctgcgttataggcctggttgtgggaagcgatnccacacgagaacaaccagacaacgttattgcgagcgcgatgtccttgtganaacattatctgt

SEQ ID NO: 566 - DNA, 1969 bp, Homo sapiens
cgggtcgacccacgcgtccgcgcctcggagcaaccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggaatatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattat

(The sequence listing continues in the following parts.)

What is claimed is:

1. A method for determining a cancer therapy regimen for treating myeloma in a patient comprising:

a) measuring the level of expression of at least one nucleic acid sequence selected from the group consisting of sequences recognized by probesets of predictive markers numbered 1-547 in Table 1A, 658-871 in Table 1B and 873-876 in Table 1B in a patient sample comprising tumor cells, wherein the sequences recognized by probesets of the predictive markers:

i) numbered 1-547 consist of SEQ ID NOs: 1-513, ii) numbered 658-871 and 873-876 consist of SEQ ID NOs:614-830;

b) comparing the level of expression of the at least one nucleic acid sequence to a reference expression level of that sequence to determine whether the level of expression of the at least one nucleic acid sequence is upregulated in the patient sample comprising tumor cells; and c) determining a cancer therapy regimen for treating myeloma based on the expression level of the predictive marker or markers, wherein the cancer therapy regimen is proteasome inhibition-based therapy, wherein i) upregulation of at least one nucleic acid sequence selected from the group consisting of sequences recognized by probesets of predictive markers numbered 1-547 indicates nonresponsiveness to proteasome inhibition therapy and the patient would not benefit from this cancer therapy regimen; and ii) upregulation of at least one nucleic acid sequence selected from the group consisting of sequences recognized by probesets of predictive markers numbered 658-871 and 873-876 indicates responsiveness to proteasome inhibition therapy and the patient would benefit from this cancer therapy regimen.

2. The method of claim 1 wherein the level of expression of the at least one nucleic acid sequence is measured by detection of mRNA.

3. The method of claim 1 wherein the expression level is measured for a predictive marker set comprising two or more predictive markers.

4. The method of claim 1, wherein the proteasome inhibition-based regimen for treating the tumor comprises treatment with a proteasome inhibitor is selected from the group consisting of a peptidyl aldehyde, a peptidyl boronic acid, a peptidyl boronic ester, a vinyl sulfone, an epoxyketone, and a lactacystin analog.

5. The method of claim 1, wherein the patient sample comprising tumor cells is obtained from the subject any time selected from prior to tumor therapy, concurrently with tumor therapy or after tumor therapy.

6. A method for determining a cancer therapy regimen for treating myeloma in a patient comprising:

a) measuring the level of expression of at least one nucleic acid sequence selected from the group consisting of sequences recognized by probesets of predictive markers numbered 658-871 and 873-876 in Table 1B in a patient sample comprising tumor cells, wherein the sequences recognized by probesets of the predictive markers numbered 658-871 and 873-876 consist of SEQ ID NOs:614-830;

b) comparing the level of expression of the at least one nucleic acid sequence to a reference expression level of that sequence to determine whether the level of expression of the at least one nucleic acid sequence is upregulated; and c) determining that the patient would benefit from peptide boronic acid therapy if there is upregulation of at least one nucleic acid sequence selected from the group consisting of sequences recognized by probesets of predictive markers numbered 658-871 and 873-876.

7. The method of claim 6, wherein myeloma is multiple myeloma.

8. The method of claim 6, wherein the patient sample comprising tumor cells is obtained from the subject any time selected from prior to tumor therapy, concurrently with tumor therapy or after tumor therapy.

9. The method of claim 6, wherein the at least one nucleic acid sequence is sequences recognized by probesets of a predictive marker set which comprises at least 20 markers.

10. The method of claim 1, wherein the at least one nucleic acid sequence is sequences recognized by probesets of a predictive marker set comprising a subset of markers identified in Table 4.

11. The method of claim 6, wherein the peptide boronic acid therapy is bortezomib therapy.

12. The method of claim 10, wherein the predictive marker set comprises at least 20 markers.

13. The method of claim 4, wherein the proteasome inhibition-based regimen for treating the tumor comprises treatment with bortezomib.

14. The method of claim 5, wherein the patient sample is obtained prior to therapy.

* * * * *